United States Patent 10,407,724 (METHODS AND COMPOSITIONS FOR SCREENING AND TREATING DEVELOPMENTAL DISORDERS) - sequence listing, part 43

SEQ ID NO: 732 - DNA, 2304637 bp, Homo sapiens
cacaagctctccatgtgagctgacaggcgagtggaaacccctcgagtcacgctgcccggcggcggagggagcgctcgcccgcagtggcaacagctgcaccaccgtccccgtcgctctgccttcctcttctgcagcctctgctcttctgattacctccctcccccgtcctttggtgatttttttttttcaagaaggagagggcggggtaggtgtccgttccctcccctcttccccctcctttgccttcttggtttgaatttcctcccccggcgttgcactggcacacagtgcaagaggcaatacccgcacggagggagaacgaaggctgagactcccctgccgctccaagcccggaagaactggagcctggaggggggtgaggggagaagaggaagcgggaggggcttggcttcctcgcgtatttgaggacagcccatctcccttcaagaaccctacggagagtcggactgcatctccgcagcgagctcttggagcgccgccggccgggaggcgaaggatgcaggcggctccgcgcgccggctgcggggcagcgctcctgctgtggattgtcagcagctgcctctgcagagcctggacggctccctccacgtcccgtaagtagccgtctcctcgctctgctctggagcagtttcagtgcggcattgatgtttggcaccagggtatcaactccgaagtgcatcgcagtgctggcaccctgatgtgtttgtgtctccgctgtcacacacttgcagccactgcagtagacaaactcgaaacccagcgtttctgttttggaagagacagggttgtgacgctggtgatgtttctggaaagttgttcctggtcttggtgatcggttggcaagagcttggctagagagactgatgtagatggcagcttcttaggagttgtttgtgcagggagagttaactgcatttggcttaggtaggtcagtgaatgaaaagtgaagaccatggcaaaaccaagtttcttatttttatttatggttataacttaatgagcacggggttgaggttaacaagaggagcatgttttaaacagtttgggcacctatagggtctctttaacctctcccgttcccttaaaaagttaatgcccatttagtacttgcttattaaaatggaaggcagcgaaattgtaactgaaattgctttaattctttgatactttgatatcatggatatgactgatgcagtacggtacttgggacactcagtgcaaagcgtcgttaatgtagtaataaacagattcttaatagggttttcaggaaaataattatattcaatatgtatatctctgcattttaatcaactgtgtgtgtgtgtttgtgtgtgtgtgtgtttaagactgcccctgttttcatgaggtttagaaagaaatggaagattctggcccattttctgcattcctttagaagtgcatactgtgcatgtagagaggaaatgcatgattgttcctttggttcagaaagagttaaacactagaaagactgcctataggaatcttaggataatattcataagcgcatactagtttctgagaatgagtaagttgataaagaattatcgtggagatttcagagtttaaaaggaagatttttttgtccatttaggaaaagaaaagtttaatattttccagaattcgtcatatgcgaagtagtctttgtttctaagattttgggatgtattaatgcatctttgttaataatgatcttattgtagtggtaaatatcaacaggaatagcattgaaaaaggacattataagttgtaataaggaatctactatataatatccggttatgagccagtattactgttttgacatatcttcctaagtacagtattagcttttcttttcccacaatgtgtaaagataaggagataaactaactggcaatctaagtttgtaatgaacttgaaaacattgtatagcattttttataacacaagttaaatcacaaagagttaaatattgttaatatttatgtcaattttataaatttaaacaaattttggggatataatgcttgctgttgatatttacacaaatatgtaactctatcactgggaaactagtttgatgaaatttctgtttccatttcaaggtctggttgtatagaatttcctgccacttttcctggaaaataaactcctcatatattaaatttattatattcactgattgaaggtcctcatatccagggtttttcctgggttctgtgttccatcattctgtatactttaattttgatgggtccatctgaaacatctgccatgagtagcaaatggaacactggcagcccttgggttaatgcattttaagataaaaaagttgttatttcataaatattttctgagttttcaactttatagttagaatttgaagacagagaacatagaaacaattacttttaagatggttaatagttatggccattaagattttttattaacttggctttcattctctattgtttaaaaatgtgtaatggcttaattaaggtggctttttatttcgtttgaatttaaactgtgtgaccaaaatgcaaagttgccctatatcctggaaatgaattaaataataaggatgctacagaactttattgattagaatgagtttcatggattcagtactttaaatatcaactgtactttacattaatgaacatttttatttacattatatatagctctgaagaaaagtatgatagttatattcttaatataaaacattcaaaggagaaaaagatggaaactacatgaatctaagataatgagcaactcaaccaggagaggtcatcacaagacaaaaagtagcatgaaaatctaaaactatcatttttctttggtacacatttttaaaatgtgatgagtatgctaaaactttctgttcctaaatacctttttaatatgagggacagaagatgtttatttcacaacaactgcatttcaaatatgtatttgcttatgacttatttctttttctctgtcgacagacatataaaaactgttaatactatgtgttgtacaagcagactagaataaacttgaaaacaaagctcatcactatggttatgtaaaaatataatctaatttctttgcagatagcgaaaatgaactgctgctgagctgatgtaacaaatcgtgtatcttcccttcctgtaaatgtagatacacgggacacacgtgggaagtttaaagaaaatatttcactcttagggagttgcatttatttgaacatattataaagaccttgatggtgcagttctaaatgatgaggagattaagctagcgcttaataaattcactttttagagttaactgaattttcacttaaataaatgatctctcataaaggccaatttacatcatttagtagaactattaacctataatttcattgaccaacacatttgggaaatgtgttttgaattaattcacatattctctaacaaatacgattttatacgtgtatatatacacacacatgaatatatatgtgtataaatatatatgtatttgttcatatgttttataaaaacatttgaatacatgttataaagtacatagatacatatttaatatagcacatatattaagtattatatgtaaaaatgtgtatatttatatattttctaaaacaccattcaaggaatttaagttgtttacaagtttatagaaaggtctttttccagtgcaattattttaagtaactaacgcaacaatattaagcaatagtatattagtctattttctcttcctcaattcatatacttctcccaaaatggtgtattttaaatgtaaaatatgtaaatgcatataaaagcaaatactgctggtttatagagaccttgaacataataatgaacttgtcttaatgaaaacaatttaaacttaaaaggagctttaggcaagcaaaattcattggttgataaagcatagcacattatttgcttaatgcaactaataattattaactaattggagagaaatgtataatctcgattttattataggcacggatattcaggaagtaagaatcattgttcaaattttactctttaccatcaatatatggcaaaattgggcaaaaaaattaatccacaaatttaatttaggtcttattaacctttatgcagttataaacctacaacgtatcattttagatgatatcaaagttgtttggtgcatatcatattttaaatcttacagttatgtgccccataatgacatttcagttcaatgatggaccacgtgtatgttggtggttccataaaattataatggagctgtcatatataggtgtgccatttttcatcttgtatattatatttttactgtatcttttccatgtttaagtatgatgagatacacaaagaggcattgtgttataattgcctatagtattcagtgtaataacatgcagtacaggtttgtagcccagaagcaacaacccataccaaatagtctatgctatgtgtgtagtaggctacactgtctaggtttgtgagtgtgtactctatgatgttggcacaaagacaaaattgcctaaggatacatttctcaaaatatatccttattgttaggaaatgcatgatgatatatgttttttgtctattttaagtgggaaaacctttcaagttctataatttctttgagatttaattcactgttccttattagtaaattcttctagacaaaaacttactcaaatgtcttaaagtttacataaagcttcctttttttttttttttttttttttttttgagacggagtcttgctctgtcgcccaggctggagtgcagtggcccgatctcagttcactgcaagctccgcctcctgggttcacgccattctcctgcctcagcctcccgagtagctgggactacaggcgcccaccaccatgcccggctaatttttagtcttgtgaatcttttttatgattgaaagagaagaaatgtgacatgtctacacatgtcatctgtttttaaaaagtagatttttgtatttgttgtaaatggtatacagaatcaggagagaatctaggctcagaaattcttaattcaaatgtgcttttctttaaaatattaaacatatggagatccaacttgtgcaagttgtctgtttagtgattgatgtcagtgggatgaagaaataaaacatgtactttaaagattttcccatctctagtcctgatttgtgaagtgctttactttatcattttttactacttgcaaagttataaaacagcgtatatagtaattttaagcctcaaaaccagtgttgtgtgaaataaaataaatttttatatttatatctgtaccagtatctgaaactggctgttacctgtttctagagagacacatattttaagataagtagttatcagaaacataaggtatatttctacaaccagtattgggctgctgaaataaattatatgcttatttttgccattttaataagtaagaataatgatgcaatcatttatatacagctgttaattttcaaatgaaagccttgaaaataatacttgtaacagagtgattcactaaaacactggattttcccatctcctgggctctgtagaagctatatgttttagttctgagcagataaggatgttggaatgtggaggtgcttcctctttctccatcctaacagttcattttatgggaagaaatgtccgtctatcacactcttagagtctatgtctacagttcattcgttccttcctatgttaggtagagttacttatctgtttggtgactatgggaaaaggacctagatgtgcttagctcagcccctcctttctccttccaggctgcctgcagaaagaatagattctgctgaacgatagataaaagtaggctttgcctctgcactaatagtgatagcgcgaagagccttatggtgttcggttcttcctatggcttgagactctgtttaattttagaaataaggttaatgaatcccactgtatcacacatttaagccttattcttttgtatcagcaatacttatataaagaatgttatttcctctctgtgagttattttctaatctagaactcagagaagggactgagattgactgtactcagtaaaaccacaaatatattgaaattgccaaaaataagattgatattaaactaaatgaacatgaaataatttctgcatagtttagaaactagtaaagaataagacttggtttttccattgatattgagttgaagatttggtgttactctggttaggacttccaaactctcccattcattcattcattcattcatattcctacccagtgctatccgtggtattattttacagagatgcttagaataccgtttctttatctgtggtaaataacattgccatttaaaatacagcctatttacaaactttagccagtacacatccaatttcatcctgtccatgtaactatttagtaaattatatatgcctttagttggctgttacatcatgatccttctgtaaaatcctgaaggttaaatgttttaagccaattattctttccaacaaagcatttgcacttagaaaacaaaattgattctttcttcaattgtaagttttgaaaaatatcttcttaaactcttctttagttcactttggaggtagctattcataataacagcttgaagtaactgattttttatgacactgcagattttaaagcctcccctgatagtaggaaatctagatataaagatgtggttgttggctctgaatttgcttgctgaagatcacatattttgggtatactgtaaaaatgttgaaaaaatacagaggagctcctgggggccgtattctgtatttaccttgtgatttaggtttgcttgaaataccctcataaacataaatagtgatatatgctttaatgtttttatgtttaggaaagaggtgaaattagattctgagaatacttttaccaggaaaaattccccaaacatatataagtttttccttaccttttctagtacattcacaaccttcttcatctgcactgggatggtgatctggaaatgtgaatcatagaaaatggcaggcaatagaggtgtgactggcatacgcactgtcaaaattactaaacctgtgttgtctggaacatctaagatggaatcaagttacataaagtttagttaaattcaggaaggatttgttcacctctatgcattagatgtcatattgaaatagtatgtgaaaaggaaaatcttgcctggactcacaatttttatttactgttataatgtcatctatgctgttcaattatagtattatttgaaaggaatacatgaaaaaaataataggcacagtttgtattgttaaaaaaacagtctgttaagtggtgaaataccatgatatgccaaataaaataataactctaagaaaattgtcttaaaattaaaggtgcttctatttttaatagaaaaggcttgaaaccaacccaaatgcccatcagtaatagactggacaaagaaaatgtgacaagtacacaccatggaatactatgcagccataaaaaaggacgagttcatttctttgcatggacacggatgaagctggaaaccatcgttgtcagcaaactaacacaggaacacaaaaccaaacgttgcatgttctcactcataagtgggagttgaataatgagaacacctcagcacagggaggggaacatcacacacccgggcctgttgaggggtggagggctaggggagggatagcattaggagaaatacctaatgtagataacgggttgatgggtgcagcaaaccaccatggcacatgtatacctgtgtaacaaaccttcacgttctgcacatgtatcccagaacttaaagtaaaatttaaaaaaaaaagtgcttattgtcacttctatatcatagactgaagtagttattttgaactaacagaaaacacatgtggattaaattttatcactgttaactgattttttctaagcagtcacctcttaatgggaaccaaattattaagtaacataagtacagactgtctatatatatatgtctttttcagacattggtcaaaaatttataaacagaactacatgaaaaaatttcagcctaattatgtcacatagtgaaattatagcatattttatgggtcttatttttaaaaatttattaagtacgtgttaaataatggcctatgatgcattaaattacttaattgctaataaattctaacttaaaatgtaaattgttacgtagcatatttgaaacattttttggttcaaataaaaatatgtctggactataaaatatgactatcaggttttcagattatgaaactattatactagcttagtgtttttaatgccaaccaactgaagaaaacatgattcgggtgtttttttctatgtattcatagcaacaataacacaatgagttcgatgctgccatcaatactaatgttactaattctcatggtattttactcagtggatttgaatgtggccatagaatctttctccacacaatatgccagacagccacgtataatcccatgagatttggtattcaatataaaactttacttttttactcaagttatatatattgccaccaccagcagtttttcagctaataaagtatacttatgatttaagtcacttggttaatgtcctcatccctaaagaatatgttaaaacgaatgcttaacttatagtagaagagattttcaatggcagtaatgaaatttccaaaaatgaaatttaatcatgcctcatgcacttctgtagtatatgtaagttttatttatatatcttaacgtaagcatttaagttattaagttatgactagttaaaaggaaatagtagcatagttaattgtgtttttgtatgtccacagtacagaattaagaataactattttggccaggtgcggtggctcacgcctgtaatcccagcactttgggaggctgagacaggcggatcacgaggtcaggagatcgagaacatcctggctaacacggtgaaaccccatctctactaaaaatacaaaaaattagccgggcgttgtggcgggcgcctgtagtcccagctacttggaaggctaaggcaggagaatggcgtgaacccaggaggcggagcttgcagtgagccgagatcgcgccactgcactccagcctgggtgacagagcagagcgagactccgtctccaaaaaaaaaaaaaaaaaaaaaaaaagaataactattttattgtgtcagttgacaaaaatagtaccgtgtcagagataaaaatgtgccgtggtggggtattaacattgcttctaccattaagaacataaacaaaaacaaccttattccaatattctagatactgagggggttatttttgtggaattgattccaaagacagggatgcttgatcaaagaagatgtttagtttttggctaataaatgttgcctgattgagttccacaaattctgtaacaatttacattttcagcatcaatcaatgagtgtccttttctagaactccaggcagcagtacatattatacttataaaacgttctgcttgtattacgtaaatagctaatatttgttgtgttgacttcttattaaatgtttcttcccagcctttcaaatcaggcactactctttatgtgtactaggtcatttatttcttataacaatgcttcagtttgcaaatgaaaaaatcagagacacatggagaagtaacttccctgggccaccagcttggcctatttccaggtccagtgctcttcactgtggcatagctggctgagagtgaagtgctgtctctgtgttcaagttctctaactaagaagtttcagcttacatctaggcaacattttaaggcttgattgcttgtatataaaggaaaaagcctattggcataatgtttctatctttttgtttacttattccttgatgacactgtcatatgttctggagacttaaaaattacattggtaaaaaataaagaaatatatttgaaataaagagaggaatgcagctctttcaatggtagcacattaaatcataatatatatgtcatttttgttcttcttcacaataaggtacttttgcagtgtagttctatcatttgagtactattgaaatacatgtaatagtcatgtagtgaaaacatttatttaaagctatgtaaaatatttcttaaaatgctttgtcaggtatacataaaagctgtctttaaatcagttctcaggaaatgttgaagtctgtatcgaaaactgtaaatatgattgctattactaaagttaaaagatggtaattgtttaatctataagcacagttttgagtattcatttcatacaatagctaatccatgaagcttttcttgagagtgctgttgagaaaataactttttcctttgctttcatggcagtgggaaaatatttgtctttaaaatatttgccagtcctaatgcttaaatatttcttgtatccatccgctgctctccattcctatcacagcttctatagttaagattttcagcatttccctccaggcattaatttagtagcctcctggtatgtctcccggattctaatcttccccctctagcttatcatctatatctatgccagaaatactttcccaaaacacaaatcttgttatagtactgcatttctctagttcttccctgtctcttaaatttagtctcctcctaacccaacatttgcaccctataatctaaccgaccatactgagatctttgcagtttctctaacacaacatgctgtttcgaatcatatttctcttataccttgttacattttgtcccctcctttcatttttcctgttttatctatgctgttttagaggaaactcatttacggtccaagcctcagaatcttggagcagactgatgtatcaacacctccctgtggcaatttgctctaatcacaggtgaaatactaagacgcagcaggcaaattctttggtttctgaacttataaggaacacagtgatcacaaataatgaaaaccacctccaattatctgatattaaagtgagaaattaccccatagtatcgacaacagaaggaaggcgagaaatatattttcaaagaataaaccacaaatattttcctcattttataagtaaatgtgtatctatcataagggaaatttgaaaccatgctgtgaaagcttacaacttctgcaaccctttttctaccggattttattttaaaagattttctctgcttttcttaagccacatgggtgatcacgtgcctttaaacccaagcctgactgtcctttccacaagctattatctgaagaattatttgttatctgcatgcaaattaaagacgtgtcaacaaaataattattgcatctaacaagtactttaaatagagtacttaagatgtcaccaaatcttctaaatgatagctgtagcttctgaaaaacttgataactatatatatttagtgtgtaataatccagcagatgcgttgatattgttgaagttgttatgaaatgtcaatgaatttcatttccacttttaatatgacaaaaatataattttataagtataaaaatagttacttctattctatttgtttatattttaaactccgtcttcatccttacctttgcaacttagtacacacttctgaaccatttcaaagttggccagtctagcgaagcctgtttcaaattttatattcttcacaatgatccctgcagtgatgcctactaaaaacacattactctcttttctattagtccacaatctgcatgagcagagcctgtattttttcccttaggctgataggtattagggaatggttgtattaaaggaactagactttagtaaacatgtttcatcatattaggtactgtactggttgcattataccattacatgaaattagcccaaatacctctgtgctgtaatattcaaagtataaggatgctcaagcattttaaagctcactggttccatctttatacagttcttacttttgtcaagtccttccttgcattgatacagatttacactcccataaattccagccagtagttctagttgggcttctcaaataaaagcttaatatttacccaatattctactgccgtaaaatacttgaagacaaatatagaatctaattaaatataatttaagacttagtcgctactacttttatagatagccaactaataccttgaagacaaacacattccttaaaacactgtgatttatatttacttatgtcctccaaattacccaaatatttctaggtacacaaccagtgttaaataaatacaattgaaaatggaattgaaatgggttagctctgtatacaaattgtttcttaaagtgcttatagctaggttatagcaacaaatatacattgttgtgttttgatagctaaaagcatcatactaagaagtattataattgtaatataatgttagttgcaaacaagtgtgtctgtaagtaatcttggtattacagaaaaaaaaactgccttaaaacttacatatctgtatgagtcaaaaccaaaaatgaaacagaaatatttaaagggactgttgtttaaaagtaataggacaactacagttattttaaaagatagtttatacttatttgctcagtgtgaaataaaacatttttaaattttaatttattatctactctttgcccaaagtatattagaaaaatgttactgcaatttgagtagtcttcatattgtgataaaataggtaattattatatgcaataatctgaggcattttcgttttacagagcatataatcacccacgtatcaatttttggaatttaaaatgtgttgttggcacaattagaatcatgtatctactttcaaagagagatttcagaatattgcaaataaaaatgacattgtttcttttatcaaattggcatcaatagggcctttttttcaaaaaaagcttttagatctgctatttgttcatttatatgtgtataattacagtattcagaggatctctcatgctgtgtttgtttccacatatggattttcaaatgacaaagtctcaagtggtggcgctaaagacaaaccatgctagctactcaagcatttccttcctggagttgtactgtgtcaactgctccctaagaaatgggtaaagagggactactcagaaacatgcattgagcatcagcatgtttttgaaagattaatcttctagacctggaactaaaagtatcttccagttattttctttattatccactttatcagcttccacataacacattcagttttctacattttagtttaaaaattgccatttaattctatgcttctatgaagtcacatatcctacttatgctttcttaatttcaaaattatttgcactgtccattttataatattttatctatcttaataatttaccttaaagttctcttttattgaataggtatgacaacatagaaattaaaattattgaatcattccaattagtccacaggtaaggtcatcagtgagtgattaaggaaactctttctgttataacattttagctaaaacctaaagaaaaagccaagcaaacagcaggaaaagactgttccaagaaaaagaggacaacctcacaattccaacattggccaagtttggaagtcactttgatgaggagatatttagtggttttggaattagtcttctgttaaacgtgtaatgaaaagaaaattttgaaagagtaaattatcccgcttaattgtctatcagcaaatagaaaagaaattttcactggttagaaatataggcagtcgggccgggcgtggtggctcatgcgtattatcccagcactttgggaggccgaggcaagaggattgcttgaggccagaagtttgagaccagcctgaacaacatagcaagactttctctctacaaagaaatatttaaaaactagccaagtgtggtggtgtgtgtctgtactgtagtcctagctactggagaggctgaggtggaaggattgcgtgagccccggagttcaaagctacagtgaataatgattgcaccactgcatttcagccagctgagacaagagtgagactctgcctcttaataatttttttaaaaagaatttaggtcagtattaaagtttgtgataattcaattatatttagcttagagaattttgctaataaaaataactttgataatttaacacatatgtatgttattgaaacagcaagcattttgaagaggcaattttctaaataacctttatttcaaagtgtattgtttattgctgtgttagtttgttttcacactgctataaaggaataccagagactgggtaattgataaagggaagaggtgtaattgactcacagttctgcatggctggggaggcctcagacaacttacaatcatggcagaaggcaaaggggaagcaaaggcacgtcttacatggtggcagatgagagagaagagcatgaagcgggaggatccccacacttaggaaacaaccagatcttgtgagaattcactcactatcatttgaacagcataggggaaccatccctatgatccagtcacccccaaccaggtttcacccttggcacttggggattaagagggttacaattcaagatgagatttgggtgggttcacagagccaaaccatatcaatcgctgactttaaagaaaacgaataatattgtttccaatctttacatagtttcacataacatttttgagagtataactgtaacccaacatttacaatatatttgtagttattttttaatgtgaataaaggtaatatgactcatattcttaagaatttccccttggcattactatgttctactgtttcaaaagtttgcttactttaataagatttcaattatttggattgttaatacattgagatagcgactgaggtttattctctcatttaacttatttttcatcctataaatgtaaggtgtacaatataatattttgatatacagagtaaactgattactaaaatcagaacactaatatattcattatctcacatagtttttattagagaggtatgcatttataagctgccaacaagtccaaggattgttttaaaatgtatctttcattcttattacatttgtgacttcctgggttccatgccaattgtttgtttttaagaaatgtagtgttataacaagattgtttcagaacttcaataatatgcaccttcaaatagaatattataggtcttgctttataatttgtaaactttcagcatctttgcggcttaactttgcaacatacttcaaagacttaggcttcatctaatttgacataaaataaacaataaccagcaagtactagatgattatgcatctgatatggtttggctctgtgtccccaaacaaatcttatcttgaattgtaatttccacgtgtcgagggagggaggtaattggattatgagcgcggtttcccccatgctgttctcgtgatagtgagtgagtctcaatctgatggtgttaaaagtggcagttgtttcctgtgctcgaatttactctctcctgccaccttgtgaagaaggtgtctgctttcctttctgccgtgattgtaagtttccttaggactccccagttatgtggaacagtgagtcaattaaactttctttgtttataaattacccaatctcaggtagattctttatagcattgcgagaatggactaatacagaatctgtaataaactcatgcagtatctgtatctcagattgtatctgagattacagtctctgctaaaatacgttctttacagatgatcaatttacttagaacataggccaataagtggttatacacagatgtctgttggccttgaataatagcactggccattgtcagagttggtattggggaggttggtgtataaagagtacgaacttcatagagcagcaattctcatatgctaatatgcatataaactacctggcagattctgattcagtaaatctggagtggaacctataatgtaacatttatttatttatttgtttatttatttttttattatactttaagttttagggtacatgtgcacattgtgcaggttagttacatatgtatacatgtgccatgctggtgcactgcaccaactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgttttccaatttcatccatgtccctacaaaggacatgaactcatcattttttatggctgcatagtattccatggtgtatatgtgccacattttcttaatccagtctatcgttgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcgttgtggttttgatttgcatttctctgatggccagtgatgatgagcattttttcatgtgttttttgtttgcataaatgtcttcttttgagaagtgtctgttcatgtcctttgcccactttttgatggagttgtttgtttttttcttgtaaatttgtttgagttcattgtagattctcgatattagccctttgtcagatgagtaggttgtgaaaattttctcccattttgtaggttgcctgttcactctgatggttgtttcttttgctgtgcagaagctctttagtttaattagatcccatttgtcaattttggcttttgttgcccttgcttttggtgttttagacatgaagtccttgcccatgcctatgtcctgaatggtaatgcctaggttttcttctagggtttttatggttttaggtctaatgtttaagtcttgaatccatcttgaattgatttttgtataaggtgtaaggaagggatccagtttcagctttctacatatggctagccagttttcccagcaccatttattaaatagggaatcctttccccattgcttgtttttctcaggtttgtcaaaggtcagatagttgtaaatatgtggcgttatttctgcaggctctgttctgttccattgatctatatctctgttttggtaccagtaccatgctgttttggttactgtagccttgtagtatagcttgaagtcaggtagtgtgatgcctccagctttgttctgttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctttttgaagcaattgtaaatgggagttcactcatgatttggctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttatgccagttttcaaagggaatgcttccagtttttacccattcagtatgatattggctgtgggtttgtcatagatagctcttattattttgaaatatgtcccatcaatacctaatttattgagagtttttagcatgaagtgttgttgaattttgtcaaaggccttttctgcatctattgagataatcatgtggtttttgtctttggctctgtttatatgctggattacatttattgatttgcgtatattgaaccagccttgcatcccagggatgaagcccacttaatcatggtggataagctttttgatgtgctgctggattcggtttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctggtagaattcagctgtgaatccatctggtcctggactcttttttataatgtaacatttctaacatgctcccagatgatgctaatgctgagactgatctatggaccacacattgagtagcaatattttaaactttgaatctataatgaaagatgtcatagaaaatttcctacttattttaaaattaagaagcacactttagaggaagaaaattttaaaaatatataattatgatatctcatttttattttgggtataaatagaaggtataatagtgtagttctatgatatgattagacgaaaaaaattcagaaagatgtagatactccactaactagttggatagccttagacaatttatataatctctcagagtttaagtttttgtagttatgagagaataaaactagattatctctaaaatccattccagtttttaaatctatgattctagtctcctaggcttctgagtctgagaatggagaagcacctcttataaacctcagtcttgcttttatatctaactggagatttggaatagagtttccaggttatttatgaagtttaaataatattatacatatgagtgtggtgcttaacaaattgccttaccaataacaagtgcctaactaatgttattaatgtttcctattgacaatatttttacctaccttagtaaaactgaatcttagaaagtgagttaacttcttccaggacatacaggtttctagacatatgctgaatcactgtataataacaaaatacctatgtaattgataatatattagaaatatacctttaaataaagccagtaattataatgaaataagaaaaataccaaggaagaaaaaaatgcttgtctctctatgttcaagctggtaaaattccatcaaaatcaagctaatctcaattacccaaatactctgtcctcttgtttgatagtctgtgtgtgcatactcctttttattctaatataatagtgaaaatattaagcttaccgatatgtaaatagcccccaattatattgtgtgatgtcatgtttgtaaagcacacattcatttactaaaattattcattgtttattatttatagctattatttctactaataaaaagcatttccacacatgagcaaatgtatcaaaaaaagtctaagaagatgatcagattgatcagtgtactctatgcccttcttaatagtaactgagtgtgattttttacattgcatactgccagaaatcaccacatgtagcatggcagatggctgccaatagtcttgttatcctttcataaattatgtggcatttatgccattagggtgatttttcagtttagaaaagacaactaagggtcagtcttttctatgataatggactcacaagggacctcaaaactttaccatgaacatattttatatcttaagttatcttccagagactttgaatgtttgaagctggttgaggtcgggaagtcaggacagaagagggagtagagcacacctgctctaagtataggcatttcaacgttcagaggaaattagtgtggcgtggaggggcaccaggggtggtagagagttcatgctgtgctctctcgaggttggattctacagaagctcagcgttggtgtgattgttggttagtctggtgtggtttggtttggttctttagtaggtggggcccctaagaacctgagtaatgtccccatgcactagttctgtaaacgcggaagcaggtggtggcagttaagtgactcacactcatttaggctctaagccggccctctcattcaatatccagcaattcgatttctactgttgggtttacgttgctttgctagtctggggcctgcttcgaagtgtcaaaatagcagtgccattgttcgtggtgaatttccagcaaaagaaacagacagaatgttttagcaccaagttgtgtgatttgagattaaaatgctctgcatggctattcctcatgatggcacttttgagtgattactacaagaaaaacgaactgttaaaatttgaaaaggggaaaatgttggatacagctcaaatgatccatatcaactactcagttattcacctgtgttaggtatttcccaacttttcttggggtatcctttatagagtagcctttgtcaagtctcataaaaacagaactaatatacttccacagtatgcagtattaattttatatttcgatttgctctgaaactttgttctctcttgagactaacaagtaaatcataaagtgaatatttttcaatgtcgaagttgttctgaaagtataattttaaaagttctttcgggccataatatatgcctttggagaagttaatatattattgaaatatctacttatttcatctgccacatgaaaataggactgtttcatctgtccttaaaagcaaggtggaatatttgcttcttttgaaatgtctgtggcattttttttcttttgcatattctgcaacacaaagaaatatttaggacttgaaagaagaaggtgagctgcttgattacgctgtactagcaaactgtgaatttatgttatttacaaattataattaaaagcctaagaagaaaatgcatgcattattttatttaaagaaaagcctctgcataaaaacactcatggaagagttattttcaatttaaaaaatagatgattatgtgtaccataaaatagatgatttcatgtaccataaactactatagtaatttgccaagagataagaccaaggttaattttttttcaaaattaacttttaattacaatttaaattaaatcactttaagtaaaatcataatttaaaattattcttttaatcaaaaggtttttattttaaaaataaacatgtagaaaagaattatatatacttaatatttaattctttaaaagtttactgaaaggtcatctagttacttcttaatgagcaccatatttaaatatatttataatgaggtttgggtttttttattcttttcaaattaggtttaaatatttttcagttaaatttggtttttgcaaactacattccttgcacatcatgaggctaaagccagatatgtgacataatataagaaaagcatcctaagagagaaaacattctcaagctctaaaactataaaactttaagtataaattgatgataaatgtcacattgttattttaacattttttgtctgggaattctatgaagaagtaggtgcaaaatgttactatgtggaaaatgtaatgtactttgtgcattgaattttaaaatgacatggaaggtctgaagaacacagaaaggttgacagctcaccacagatttattaagtatattcaggtttttatctcaagatttttttaattacttgagtgttggtattgataaatttgttgttgttattactgagaacttaatatgttactatgtagatttcctaagttctctttcaatattactactgaatttgtaaatgataagtgatcatgaaataaacttatatgttgaacaatatagaccatatcattcacaagtattagggacatttcattatgggtaagaaatataacctttggacgtgtagaccttgtagtccatttcagtttgactaatcaacatgttcagtttataacatgtttgatcctctatatctctaagaatatatgtgtttttgtgtgtgtacatatgtgtgtgtgtaggcagattttatttagttgatatcatggggaaatctgttgctcacatagttgacatttctttataaatgcaactcacctcatcaaaatgacataccaaaagaactttaagaaacacatttgtaaatggcttacatattctatgctttcttaacccaaccacagtgtaaaaataattctgagtactttggaacataaccacaaacacttatcaaatatatgctccccagtttgcaattgggtccctataaatccactgtaagttgaaaatatagttaagtcgaaaatgcattgaatacagctagcctacagaacagcatagctaagcctcacctaccttaaacatgctcagaacactgacattagcttaaaacaaggcaaaatcatctggcagcatgatccactatagtgtattggttgttaaccctcgtgattgcgtgggtgactgggagctttgacccacttcttcctcccagcatgtgagaaattatgataacacagactgcaagcacagaaagagatcaaaattcaaaatttggagtacagtttctaccgaatgagtattgctttcacaccattgtaaagtcaaaatatcataagttgaacccttgtaagttaggggtcatttttatgctattttaattatgattgcaatgaccaatcaggtctgtggagctgttttttcccaccacaaaatggcttaagagtgctgtattttgctatcttttcttattgatattagaataactttttgactgttgacacttaaatttaaaagggtttctaaaaatcaatgagaaagattatggaagatgtgtttgtattagaagatgtagcaaacttccatttgaacaaaactctgcccaccttaagagtttcttctgtgtttatgattaatttgcttcaagatttctgtttgtggctgttgagttatcattctttttttttctcagtgtgctcattccttcattcagtcagttattttaaaaaatattaatttgttgcacaaatgtaatatgtctttgtataagacagacctaaattcaactaagggaccctatttaagaagtttgtggaaatagaagtgtttttaaggtccataaacatcagttttctcatttgtaaaataattggggcaataatacatgcttgagttcatagaaagtacatagcacagtgaatagcacaatttggggggtatttaacaaatgtcagtcatctttgcattatctttgtatgaaattaacatgtaattcataagcagttttaggtatctagcatttccattagctccagcgtccagtcaaagccctctgttggaatatctttgcagctacaggagtctgacttgatcaaatgtaacactttcatacctgtgtccctcccaccctttcatttgcttgactggcttctttgtatcagactatgactcaatggatttttccttttctattgctgaagaaagctccatttccaaaaattccattcaacaattcactacagcagacgacttataaaagagaaaatgagatatcatcctgtgttttcaagagtagataaagaagtagtagggttcttgcacagtcccagggttgatggcagagtcttcttcctgttcaatgtctcaagtttcatctgtccatctcctattcatgcacactgatgccatcctctgccatgctccctcatcacacttttgccacacgtgtctgtcctgaggcatctaatgtctgtggcaagtaaagtctcagaaccataccatgaagatctatggtgaatgaaataattaggtagatactaagacagagcatttaaaatatattctcatatattaattctcattcttagccattaaaatatttgtacttcaagtgttcggcttgaggttgaaaaatctgaaggactgacagcatctctcattatttcttttgggtagttaataaatgcttggatttcagttcttgatagggacaaacgatattttgttgataatggatcttcacttaaatcccatcatgcaatttactctctacatcacaaacaaccatgcgaagaaagaaaaagaatcagtgatttttctcttccctctaaggaagagattttcatagcggaaacaaagggaatattttggaaatttactgtggtgattttctggattattatgaagggggtggtggctgttgacatttagagggcgaaaatcggaaccactagaacatcttgcaatctgcacgtctggcctaccctacaaagaatttcccaccacccagtgactgtaggtttgtgcaattgcaaaatctctttacaaatttctgaatctggaaacaaactcaaatttgtatgtagatacaaagtatattgcatagttttaatgtgcactaattttctaaatataactacagtgtcagtggaggaaacgtactttgctcaggtcacaactgttttcaccatttcagaaagtcacagataccaatgctgctcatggtgtctaagtggcacaaagggcacctgtgtgtcagcctacatttgtcgttgttatattgaaggtgattctaggtgtgagtaaaacatctgactacttgattatgtcttctaatgtggtggtgcttgaatgtttacatatcaatatattattcgtgtagatcactatccttttattgcattgaaacaatgtttaaattttgtgtgtagatagactgtattttttatggatttacttcaggctgagggacagattgttctggtagccatttgttacttggttgtcaagaagcaagctaggttgatggtgaaacactataagaaatatagttttcattttctttaacatttgtatataagtgttctatatttaaataacaattacataattaaaagttttagattcacttgtgaattatttattaattgtaagattgtacctttcaagaaaactcaaccttattttttcctactttaggtggttttcttttcaagcattaaaaataatgttattgagttctattgatgaagttaaaaatctgatttccttttattttataattcattaggcattattacattttcactaaagttgcaacttgaaaattcctgtaagacacgcatcattccatataagaaaaatgtaaaattcaaatattgtgcaactcaaggtaaatttacaaaataaatttagtaagcattattaaagactcatagcctttaggttactaatatttaatattatagtccaccaggaaagatgatctcaaagagggctcagtattgatttgcttgttggtatttcagagatactgacagctgctatgacttctgctgttttttcttaactttgcccatactgagtttgctttgtatttccttgttattaacccacatctcaccatattgcaattaactttcacaataagcactccattgaatatattagaaatatttgcaatgtgaatagaaactcttaataagagcaggcctgctgctagatgataagaggtctgcatgaattagaaaaagttgcccttccatatcctgaacagatgtagccccaaagttcaggggttagtgaagagagggcttctttcttcactcccctcattcttttcctctggggagacactgtctttcacaacttcgtggacagcatgtggactaaatttcagacagacacttgccccttcagtgaggcatctttgtgcaaggtacaaactttatacacaggcatgatgatccctaacacaaatgtgtctatgaaagaaaagagaaaaataaagaacacccaagttttcatgaaagagcagttatacaggaatgaaagaagctttctaacaagaaggaaacagttgagagggaggaattaaagatagaaaaatctattgatagccaatctaatttccctgtttttaaaattcaagggtgattcactctaccacttatgagcagaaaacaaaccttagaaatagattacatgattacgatctatgtaaactttcacttcgtattaccctaattgggttctcttctaattctgtgtaaaataatacatcttttggtttatggtaagagagagccatcctactatgactgccaaattttgattattcccaaattgagagacaggaaggaaagtgtttacatttatcatattgtaaaatttgaaatatgtatttatagcccattttagaaatgtttcaatgtaagaaaatgacttttaaaaagaagtccaatgtctagaaaggcatccagtagttagtatgactgaagtacatagttagtttcttaagaactctgcctttttggtatttttccttttagggaataaataaaatcaagcctctcaaatgattttccaaatccagagccatgaagttacaggatgatggattgctaggctgccattgttatctgtgtcaatggtggtcttggaatcactctgtgtggctctatgttgtggccctctctgcacctcctaaagaatgacttcattgctgtttgacttttcaaatttccttccaaattgaaaactcaagacatttttcttcacattttattttctttttattatgccagtttaaaagtctttgaaaataaagaactgaaactcaccttcttctgaagtcgcaagtgagcaaacagaaataatggattggactttgttaatgatatgcctaaaattagatgttaagttattaaaattttagttttccatgaataaggacaaaaacctcatttctaaaaccttgtcacatttaaattacgctgtctcatttgagtctccagaaaattatgtccagtcttctgattgtcactcctataaacttatttttatttaaatgacataacctccagaagtataaaatgttgaaattcttttcagaatgacttgcattatagcttttccctcctgtggtattgaaatactatgtttcatattagaatgttttcaaatatctactctcctaaatagattagttaatggtattgtgtttcctgaaataatctgtgtaatgaatacgaacatttctacaataagtttacagtcttcttactttagagtatcatagatctaaattctaatttatttttttttttgaaatggagtctccttctgtcacccaggctggagtacagtggcacagtcttggctcactgcaacctctgcctcctgggttcaagcgattttcctgcttcagtctcccatgtagctgggactacaggcatgtgccaccatcccaggctaatttttgtatttttagtagatatgggtttcaccatgttggccaggctggtcttgaactcctgacttcaggtgatcctcccacctcggcctcccgatatgctaggattacaggtgtgagccaccatgcccagccctaatttactttcaataagcaaaattacactttgtgtcacactttccccacacacaagctttttgtgacttcctaaaatatttatttatttatttatttatttattttgagatggggcctggctttgttgccccagctggagtgcagtagtgtgatctcagctcactgcaagctctgcctgccaggcttaagtgatcctctcgcctcagcccctcaagtagctggaaccacaggtgcgcaccagcgtgcctggctaattttcatattttggttagagaggggctttcaccacattgcccaggctgctcttgaactcctgagctcaagccttctgcctgcttcagcctccaaaagtgctaggattatagatgtgagctactgcaccctgagacttttaataaatttaaaaaacaaaaaatagaaaacaaacaacaacaacaaaaaatttcattccttcctgttcccaggctaaaattactcttttgagttagtggatgagtgtatgtgtaaaactctagcttactttgctattgctgaatgggctgttgttatagccattgttattcattgacatttcagggctgagactatgtcattctagaacttcgactcatactctcatgttaatttggtataaaagaaacataatgaagaaagtgtatttatctcattattatttgttgtgttgtttcttcctgcctctctaaatcccacttttttgtacaactaattttttctttcatcaacttttctattaacagcttttgactttataactgcagctaaatggatgataaaacaaaataaggtgtgacacaaagaatgaaacagtgaatggaagggcttaggtataatggaaggaaatgtcaggaagaaagtcccagatgacttttcaaaacttcagggttggcagtagctcatggtgggagagatgtaactcagttgatggatttgatgaattttgtccaaacgttggaatttggactggtcagatacaacagaaagcccccagacagtgactctgcaaaataaatatacaaaatgtgatcctgacattcagaaactcatctttttctgagatgctttaggccatttttcgtgattgaaagaaagcgacaacagctctatcccccgtgtccatgatcagagaaagagaaagaatgaagattcaagggccgaaagcgtgaccagctgagtcacatttgaagccttcctgaaagcctcactcagtgacttctctttaaacagctttagctagaatgatggcacctggcctctcttacttccaaattagacgagaacatactacattttagctgggcacattactatcccaaaccaaactggggtgctattagtaaggaaggaaaagagtagatactgggcaggcaattagaaatctttgcagcaagacattcgggaaaggtattatttagaaaagtaccaaagtctttttgtgtccttgatgtggattgaatagagtgagaaaaattgcctgtgtgccggtttcccagtggaggtacatggagaaataagaattgtttccttctgcatggtaagcagctctccttgtccaattgtcccctattactgaccatggtcccacagcaatatagttctatttctaggaatggactaggaaaaaaatcccagaggagaaactcccacactgatttctacttctaaaattcaatgtatttgtacctcgcgtctctagaaaaattgtgttttagtatatcagcttttgaagacagctgtacctaaatccagccatccaaatgggacaaaggaagcagactttcaccttcagaagcagccatgagtttgtgtctgctgcattgcactttcaatatctaggacagaatttcatacttattatataattacagtaatacaatttgttattaaatagttgccaaacaaaatagaaatacaataaaaatttaaaccactaacctttaaatgatatattttgttttaagaatattgttcagctcagatatcagcagattaatgatgagtacaactaaaccccaatcagttgaaagaaatgtataacatatcattttaagatctctgtagtaatttattttttaaaaggaacttaatatcgtggattttaaataattgaaaatattttttacacttggactaaatgttcagatgatttttattatgcaaacatcacatctaattaaagatatttcaatattatatttcaagacattcagtaaccattcattaagggctgaatattatatagtgggataaactaaggccatagaatatttatgtccccagccataggaagttcgccatttattggaggagataaacacacacataactgaatttggttttgatcttcctctgacctattctattaattcaataatgtaggcctaatcattattgatatactttattcttgtcaagatttgccacattatttgccttgaagttatttattgcaaagggatttgttctctttaatggatggctctgcattttagcatatgcgtttgtctttgagaaaccaccaagaccaccaggctaagacattgaataattaacttgacataatatttataaagtagtgagctagaaagttttgaaagattctattaataaaaatggttcatcaaatttcgggggcaaatgccttaaacatttattaatagctaaacaatatatgaacttttcctgaggaagaaaacatttcttcctaagtagtttctaagtagtaaagtctaatccagatcttgttatatgcactgtagagttcttttttcagaaaacaacattgcatagtctatatttctttttataggacaggcagctgcgttagtgaatgattcactaatggtgcgaagtctttctgtcaaacaaacacacagttcacttagttgggcttcaagtactttagtttttttcctaaacaataactgtctttaaaagaaagaagctgtgtaaacattgaatacagactttaatttaagacagatgataacccggaagtgaccacttctctttatcatcaaaataccgctgaagccccagtgattcaattgccaggaattcttctttgcttgaatttgatcattcttctttctctttaaaatactgttgttaagcactggatcggcaatgtggcattgtctctagggattgaattatgtttaattgggaaggaagcacactctctcttgtttttagttcataaagtaagaagactatcaattagtaggcagtgcagcccaattggagccacgctgcactacagacagtttggaggagattcatagtaacaaacaagatttaaaatacatgtcttgtgaaaggccattataggtggatggctgggtttttcctgtcttttcatgctgtagcagcattatattagaatgtgaaggacactcatatccataaaataatggctttcgtaatgcagatgattaaagtaggaagcctacccacttctatttttccctaggcatataccaggatcaaatttcaattagtgacctaggaactgcaggctctgtattctgttatcaatccctttagccagctagaatcaaagattcacctgtcactctagactctcagtgactctaaggaggatttagaatagacatctgctctatcctgttacgttgacttctttatactgtctgtctacaaaatgcattatgaatatacagtgaacattacaaatattctaaggtccattaggaaatttcattttctgtggacaaggattttaatgttaaatattgatagtgatttctgctaatttattgttgatttgctaaaccaggccattttacggaaaaattttaaatatgccctgttgatcaggaaccaatatatatatttttcaaagtgtcagaatggttaccttgaaatcatttttagatatgaattgcagaattcctagaaagaaaatatgctctcttataggactgtgctttatcaggaaatggcaggttatctagttatattttaaagataccaaatttgtttagtgcagattttacttctatagtgctcaccttgatgagcatcacaatgatgttcttttatttttaaaatgatgcattataatcccattagagcctttgccaaccagtaaattattaataagacgatgatcatgctaattaagctactttattagattttgatggattttgtgccagaaattatggtggggtctttgaaatatatagagtattttctcttagagcaagtcgtctagcatcattgaaaactttactgaaaactcttcattactcataacattgctcgtctgtttcaaaatgacacgatagtcactttcacagaaacataatagtatgcaattcaaatgtttaatttgctgctgcaaaagaattcacaatagaattctcaatgtggggttaattacatagtaatgaaagagtaaacctattgggaaaatgctctaagtaacattgctctgtttcctactgataaagacgtgcacgcctgatttattttttatgctgggaaattcagaagtaagagaaaaccttgaaaaggtatgcacatgaataataaagttttttatcatttgtcaacatgatgagaaaatgatgaacgtggataattattatattacaaaggctataatcacaaaatagtaatgtataagaatatagcattctattatacacaggagaacatgatacattaaaatcattgataacataatctaaggaaagacatcgctaatcagaacaaaaaaaggaagaagtaatagagcaggcactcaaaattgtgtccatgttttctacaaataatcttcaccctctctgcctatgagtatagtgttatattgctaggtatgttatgtttactccatatatgtcaaagactccactgggggaattgaacaatgagaacacttggacacaggaaggggaacatcacacaccggggcctgttgtggggtggggggatgggggagggaaggcattaggagatacacctaatgtaaatgacgagttaatgggtgcagcacaccaacatggcacatgtatacatatgtaacaaacctgcatgttgtgcacatgtaccctagatcttaaagtataataataataaaaaatttggaccacaaaaaaaaatatggtatcttaataaatatctcaaaacagttataagattgacaatatgatccctactttgttaggtgaagaaaatgacacttttaaaaacataaaaagatttcctgtatgataggattcaaattcatatttgtttgtttccaagggctttttctcattcattatcctatgctgtcatgtaaattaatccatgaatattgcagcttgtatcagaagcttgaaagttcacagaaagaatcattttctacctaaatttgcccatcaaatttgggtggacagtgacagcagcacagtgttaggcttacttttaaatgacattatttaggatagtgagaggataaacaaatagactaaaagaacagaacggagtccagaactagatccacgcagatatggccaattgatcttccaaaaaggcaccaaagtgatgtaatggagaaaggaaaattgttttaaccaccagacctagaaaacttggtatccatataggaaaaaaataaatcttgatacttcataccatacacacaaaagtaattatagatggcacatagacctaaatataaaatcttaagctcaaaagtttctagaagaaaatatagaagaatatttcctggacctgagctaggcaaagatttcatagaaacacacaaacagcattagccacaaagaaaaaaaaaaaaaaaaaaagaccagtcaggcttcatgaaaaacaaaacaaggaaaacctgtgctcttcagaattaaacaaacaaacaaaaacactaagagaatgaaaaagctaagctatgggagaaaatattcacactatatatctttgacaaagcagttgtacccagcatatataaagatgtcatacgaatcaattgtaaacagacaacacagtaaaaatgggggaaagatttgcactgtttacaaagataaatgtctgataagcacaaaacatttaatgtaataagttattagctaaatgtaaattaaaagcaaaatcaaatactattgcacactcactagaattgctaaaattacaaaagattaacaataccaattgttggtgaagaggtgaagtaactaaactcacatactctgctggttggaatgaaaaatcatgtaactttgagaatctcttgggtaataactgacaaagttgagcatatagtcaccctatgacacatcagtttcacttctaagtatttactctgtagaaataaaaacatgtttacaacaggacttgtaaaaatatgtttttaataactgtttacagagagccagaatatattgcctaacattatttttatatataaaggttacagattttttatattaattttatatctttgtagattttttatttcttttattttaatctttagatctactactatatcacctacataggggcaatttaactcctctaattcttatatttctgattttgattctataattccttttattaatactctcaatagaacattaaatagtattgttgatagtggcccaactttaggtagaaatctactacattttttgaattgatgaatgaaaaattattttagacaatgtggaatgagtcaataatgcttattaccatatatatatcaccactaatctttattattttttgtaatgagaatatttaagatttactctcttattagtccgttttcacactgctataaagaaaaaactgcccaatacagggtaatttataaaggaaagaagtttaattgatactctattgagcatggctgaagaggcctcaggaaacttacagtcatggctgaaggcgaagaggaagcaaggcaccttcatcacaaggtggcaggaaggagaagtgtgtgagagtgcaggaaaaatctaccatttgtaaaaccatcacatttcatgagaattcatccactatcatgagaactgcatggaggaaaccacccccataatccagtcacttcccaccaggtttcttcctcaacatccggggattacaattcaagatgagatttgggtggggacactaagcctaaccatatcattctcttagcagttttcaactatgcaatacattattattaactctggtcatcatactgtacaatacattgtgagtatgtgaatatagtactcgtacttattcttcctgtactaactcaaaccttgtaccctttaatcaatattcctccatttggtgccacccacccaatacatagtaaccaccattctactctctgctttatgaattcaattttttttttacattttatatataaatgagatcatgtggtttttgtcttcctgtgcctggattatttcccttagcataatgttctctaggctaatctgtgtgttcattgaagcgttatttgcaatagccaaaatatcgaatgcaatgtaagtgtccatcactgatgaatggacaaagaaaacgtgatatatatatatatatatatatatatatatatatatatatatatatgtatatatatatatatgtatatatatatatatgtatatatatatatgcgcaatggaatactattcagccttttttaaaaatggaggaaatattttgagaacagtcatctacaaattttattttaccatcattgtttaatttacattattacttagaatagctatcatcagaaagacaaaagataataagtcttggcaaggatgtggcaaaaaggaaactctcaaacgctgttgggaatgtaaattagctcagccattgagggaaacagtatggaggttactcagaaaattaaaaaaagaactaccatatgattcagcaatgtcactactgagtatatagtcaaaggaaataaaatcagtatgttgaaaagatatttgtacttttatatttattgcagtattattcactatagccaagatatggaatcaatctatgtgtccatcaatagatgactggataaagaaaatgtgatgtatatacacaatggaatacaatttgaacattaaaaataatgaaatcctgtcattttcaataatatacctgaacctggaggaaattatgttaaatgaaataagccagacatagaaagacaatcactgcattatctcactcatatgtagaatgtaaagaagttgctgtcatagaagtaatgagcaaaagctgtgtttacaggcgagggatggttggggtactgtggagactggggagatactgatcaaaggatacaaaatttcagttagatgggatgaataagcccaaggggtctattgtacaacgtggtagctatagttaacaatatattgcattcttgaaaaatgttgaggatggatataaggtgttttcaccagaaaaagaataattatgtgaagttatccatatgttacccagctggatgtagtcattccaccatgtatatatatttagaacatcatcttgtactgtgcatggtaaatacatacaattatatctgtcagtttaaaataagataaaataaaataatataattactttaaagcttgtgaaggagtcaccacatggacaatataacagaaaatctctgctagattgaactttgtgatgaacacgaagtacttaataaacatatttctttgatctgtctatgcatggatcaatctgttcctgttgaggaccttataacttcctactgctcactcaacaggaaattgttctgaaagtgctctacccatcaaccttcaatataaaaatatacattttatgatttactcccagagttttgcagtggcacaactttacacaacaaatttgatcaaaatagaaatacttcaatcaattttctttggcgtaagtcaccttggtacttgtcctcatagggtttcgtgtatttcacattgagttgcatcatagtaaaatcaaggtgtatatcattcctatttccatttcacaaattatggaaatgtttcatgttactggttttgttttgctatttatttcagtgttgcttcatggaaaattgaacatagtaattaaaaatgacaaaattttaaaaatctatcatcttgaaatttgtacaatgttttcatgacattattaacaaaactaattatcgagtacagttacacgttccaaccagagctatgttgaactagagtacacaggagagctttttagtatgaactgatactcacacgtaagaattgcttatattttaggaagcgtggccaaatttctatatgaaacatccacttttacaaagtctgactgtattgttgtttatttggaaatagtagtcaaactgtaacaaaggtggaaaatcttttgcacggctgttgagaaatgggtggatcacgtagaataaggcttacaaaaccactagtgggttagcagccccaaacatctgagactatcagtacaaggaagaaatctctatttctgtagcctctgatttgctctatctcatatggagggcctaatgaaggaaagaaactgcattctaaatgatgcagagcaaataccctaaaagggaagtgcttggatctttattactttggagacctaaaagacaatgtactttgaagttagtttcttctggttaatctcttttacttgatgtagacacattacataaatccattgtcgtatgaataatacgtaacagcaataatctattatcataatgtttttaggtattcataaagtacattttctatgtctaaaggaaaagtagcagattattaaacttccagttttattttatgatctgctctgcctcttcaattcattccacctttttgttttgttttgttttttaaatacattcatatgaatgtatttttcaatttcttaccaaagaagcaatttggaaaacactgattgttcatttcccttttacctccttgtttcaatttatgttttgagtacagtacattagtttatagagactgtgattgaaaaaaaagagcttacaatcttcctcagatagctttgctctgagttttacaatggatggtttggaaaaatagtgtaataatgactgagcttctaaaatagtgaagtaacagttatttttgtgatgtaatatagtgatgtatatgtggctcaaaagggttgctatatattccccccaactccaattttatttttaatttttggttgtttttcagttttatgcaagacttgctatacctaattctacaagctatacagtgttttttaatattgattccagaatttgtttcatcatatgcaccagaacaaatacttcagtaaaacttcttctgcactttcttagacaaagacagcatgatacaggcacagctaagtctcttaagctcttaggtatccttaaaacattgacaaggaagtcaatattgaatttcagataacaactggaattttgacagtactcattagttagtttggtctgacccaggcttccatcagtgcaaactttatgccccaagagtctcacaaagcatttacagcatatgctacagaaacatagaaagggagcaggcaactggcagagtatgggcatgaggctgacagctcagagatgccactggacctgcctcatcagctctctgggcactactcactcttctgaaagtatttgaaaccttttgggctgttactttacacctggtaaaaagcatctatagaccagaagaacctgggaagagggtattccttcccttcagagccaaaacagagagttttatactcttcagggggtttccttcacaagacagttactcacaaatcaacgatattgaaattgtatatctgggatttgccctctactgtcactcatattgttcataagaacaggaacagataatatttattggtttgcaaccacacatagatataaactctaattgcttcaacagagttttatggtaagaattgtttagtactaccatttcacagatgagaaaattgaggctttgaaagcctgaataatttgtgaaaagatacaaagctcctatgtggtcagactggaattttaatctacttgtacctgacattggatcctagactcttcaataggttacacttccttcgaactgggaaaaggtagcacaaatcatttatttttaaatcaccgatactagttttgttgtttaaggcatttaatctaagttgacttccccaaaggactgtgcagatgttttctcaaattaaagtgatatttcagaacaacaagtactagaaaatttaattcaactaaacagtaaattctagaaactgggggatcttttggcctctcatacaattttattcgtataactatgtgtcccggccagtcatgataacatatacttgttcaattgataaaaactgaactgaattcaagtcatagacttactgtagaggcttgggcacatttgcagaatatacacttggaatatgcaatgaggaatagaggttaagaagaaaggaaataagtaattacataagtaataattatatagtaattacataagtaaatacaattataaataattgcataaaacaatatcattattattattattattattattattattcgaaatggagtctcgctcttgtcgcccaggctgaagtgcaatggcgggatcttggctcactacaacctcctcctcccaggttcaagtgattctcctgcctcaacctcccaagtagctgggattacaggtgcccaccaccatgcctgactaatttttttttgtatttttagttaagatggggtttcaccatgttggtcaggctggtctcaaactcctggcctcaggtgatcctcccacctcggcctcccaaagtgctgggattacaggcgtgagccactacacttgggcgacaatatcattattataaatacagaaaattcctgtttttttatatcagtcatcctagaacagagacgctatcagctcctggggataactcttcccacatcgtctggaacataattatatttaattaaaacctgaagtggtatctaaagataatgacaaagtattaaatgtgcagagggtttcagtctctcaaacaaatgtgagtttgttactatgttatgtaccatagtagtctaagggctattatgttgtttcttacattagtgtaaccatggtgaaaaccaaagagaaaataaagaatgattgttcatgttttaatgtataagagcacattgatacattgtaaaacacccagatcagttatttaatccatcttttgaaatcacagaagaaaactggtgatatacatgtgatgaggaatggcaactgtagtgatttatattcctctaattttttgcaaaaaaaagaaagttcactgaaaaaattacaactttcgcctatgctaaacttaatttatgtaaaatagtggtcacagctattaaattattgttatttattcacaaagttctcctctacatattgttttaaagtaataactgctttacagcatttttttttaaatggagtctcactctgtcaccaaggctggagtgcagtggcacaatttcggctcactataacctctgcctccagggttcaagtgactctcctgcctcagcctcctgagtagctgggattacaggcacctgccccacacctggctaatttttgtatttttagtaaaaacaggtttcaccatgttggccaggctggtctcaagctctggacctcagataatccacccgcctcgacctcccaaaagttctgggattacaggcatcagccactgcgcccagctgctttacagcatttttatagacgctcttctttgaacttactaagagttcattgaaatcagctgtgcagagtttaaatccagcaaggaaattcaggcacagacaggttggaggtaacaaaaagtaaaactggaaagtgaatcaaattttggctgaaaatttaatatatttaatagtatgtatgattcctcaatctaacttaggttaaaataatcaaaaataaaataaggtgaactactttttttttaatgggcaaggtggcagaaatggaatttccaaacatctagatcttaggtctttattattctaagcaatttttaatacaatttgagaatctttatttctgtactcttcttcaataataacattaaagcagaaggaggttccaagatggccgaataagaacagctccagtctgcagctcccagcgtgagcaacgcagaagatgggtgatttctgcatttccagctgaagtaccggcttcatctcactggggcttgtcagacggtaggtgcagcccacagagcagggtgggacattgcctcatttgggaagcacaaggggtcaaggaattccctttcctagcaaagggaagccatgacagatggtacctggaaaactgggacactcccactctaatacagcgcttttccaatggccttaggaaatggcacaccaggacattatatcccgtgcatggcttggagggtcccatgcccacagagcctcactcactgctagcacagcagtctgagatccaactgcaaggtggcagcgagactgggggaggggcgtctgccactgctgaggcttgagtaggtaaacaaagtggccaggaagcttgaactgggtggagcccactgcagatcaaggaggcctgcctgcctctgtagactccacttctgggggcagggcatagttgaacaaaaggcagcagaaacttctgcagacttaaacttccctgtctgacagctttgaagagagtagtggttctcccagcatggagtttgagatctgagaatggatagactgcctccttaagtgggtctctgacccccgagtagcctaactaggagacacctcccagtaggggccaactgacacctcatacagccgggtgcccctctgagtcgaaacttccagaggaaagatcaggcagcaacatctgctgttctgcaatatttgctgttcttcagcctctgctggtgatacccaggcaaacaggttgtggagtggacctccagcaaactccaacagaccagcacctgagggtcctgactgttagaaagaaaagtaacaaacagaaaggacacccacaccaaaaccctatctgtatgtcaccatcatcaaagaccaaaggtagataaaaccacaaagatgggaagaagccagagcaggaaagctgaaaattctaaaaatcagagcgcctcttctcctccaaaggaacgcagctccttgccagcaatgggacaaagctggatggagaatgactttgatgagtttagagaagaacgcttcagaggatcggtaataacaaacttctctgagctaaaggaggatgttagaactcatcgcaaagaagctaaaaaccttgaaaaaagattaaacgaatggctaactagaataaacagtgtagagaagtccttaaatgacctgatgaagctgaaaaccacggcatgagaactatgtgacgcatgtgcaagcttcagtagccaattcaatcaagtggaagaaagggtaccagtgattgaagatcaaatgaatgaaatgaagcaagaagagaagtttagggaaaaaagagtaaacagaaatgaacaaagcttccaagaaatatgggactatgtgaaaagaccaaatctacgtctgactggtgtacctgaaaatgacagggagaatggaaccaagttggaaaacacttctggatattatccaggagaacttccccaaactaatgaggcaggccaacattcaacttcaggaaatacagagaatgctacaaagatactcctcaagaagagcaactccaagatacataattgtcagattcaccaaagttgaaatgaaggaaaaaatgttaagggcagccagagagaaaggtcgggttacccacaaagggaagcccatgagactaacagcagatctctcgacagaaactctacaagccagaagggagtgggggccagtattcaacattctaaagaaaagaattttcaacccagaatttcatatccagccaaactaagcttcataagtgaaggagaaataaaatcctttacagacaaagaaatgctgagagactttgtcaccaccaggcctgccttacaagagctcctgaaggaagcgctaaacatggaaaggaacaaccagtaccagccactgcaaaaatatgccaaattgtaaagaccatcaatgctaggaagaaactgcatcaactaatgagcaaaataaccagctaacatcataatgacagaatcaaattcacacataacaatattaaccttaaatgtagatgggctaagtgctccaattaaaagacacagactggcaaattggataaagagtcaagacccatcagtgtgctgtattcaggagacccacctcacatgcagagacacacataggctcaaaataaagggatggaggaagatctaccaagcaaatggaaaacaaaaaaaagcaggggttgcaatcttagtctctgataaaactgactttaaaccaaaaaagattgaaagagacaaagaaggccattaataatggtaaagggatcaattcaacaagaagagctaactatcctaaatatatatgcacccaatacaggagcacacagattcataaaacaagtccttagatacatacaacgagacttagactcccacacaataattatgggagattttaacaccccactgtcaacattagacagatcaatgagacagaaagttaacaaggatatccaggaattgaactcagctctgcaccaagcagacctaatagacatctacagaactctccaccccagatcaaaagaatacacattcttctcagtgccacatcacacttattccaaaattgatcacacagtttgaagtaaagcactcctcattagaatcaaactagaactcaggattaagaaactcactccaaactaaacaactacgtggagactgaacaacctgctcctgaatgactactgagcacataacaaaatgaaggcagaaataaagatgttatttgaaaccaatgagaacaaagacacaacataccagaatctctgggacacatttaaagcagtgtgtgcagggaaatttatagtactaagtgcccacaagagaaagcaggaaaaatctaaaattgacaccctaacatcacaattaaaagaactagaaaagcacgagcaaacacattcaaaagctagcagaaggcaagaaataaccaagatcagagcagaaatgaaggtgatagagacacaaaaaacccttcaaaaaatcaatgaatccaggagctggctttttgaaaagatcaacaaaattgatagactgctagcaagactgctagcaaggctaataaagaagaaaagagagaagaatcaaatagatgcaataaaaaatgataatggggatatcattgatctcacagaaatgcaaactatgatcagagaatactacaaacatctccacgcaaataaactagaatatctagcagaaatggataaactcctggacacatataccctcccaagacttaaccaagaagaagttgaatccctgaatagaccaataacaggttctgaaattcaggcaataattaatagcctaccaaccaaaaaaagtccaggaccagatggattcacagccaaattctaccagaggtacaaagaggatctggtaccattccttctgaaactattccaatcaacagaaaaagagggaatcctccctaattcattttttgaggccaacatcatcctgataccaaagcctggcacagacacaacaaaaaaagagaattttagaccaatatctctgatgaatatcgatgcaaaaatcctcaataaaatactgggaacccgaatccagcagcacatcaaaaagcttatccaccaggatcaagttggcttcatccctgggatgcaaggctggttcaacatacacaaatcaataaacataatccatcgtataaacggaactaaagacaaaaaacacgtttatctcaatagatgcagaaaaggcctttgacaaaattcaacagcccttcatgctaaaaactctcaataaactaggtattgatgggacgtatctcaaaataataagagctatgtatgacaaagccacagccagtatcatactgaatgcgcaaaaacttgaagcattccctttgaaaactggcacaaggcagctatgccctctctcaccactcctattcaacatattgttggaagttctggccagggcaatcaggcaagagaaagaaataaagggtattcaattaggaaaagaggaagtcaaattgtccctgtttgcagatgtaaaatacctaggattccaacttgcaagagatgttaaggacctattcaaggagaactacaaaccactgctcaacgaaataaaagaggacacaaacaaattgaagaacatttcatgctcatggataggaagaatcaatattgtgaaaatggccatactacccaaggtaatttatagattcaatggcatcaccatcaagctaccaatgcctttcttcacagaattggaaaaaactactttaaagttcatatggaaccaaaaagagcccgcattgccaagacaatcctaagcctaaagaacaaagctggatgcatcacgctacctgacttcaaactatactgcaaggctacagtaaccaaaacagcatggtactggtaccaaaacagagatatagaccaatggaacacaatagagccctcagaaataataccacacatctacaaccatctgatctttgacaaacctgacaaaaacgagaaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaagcaataccattcaggacataggcatgggcaagggcttcatgactaaaacaccaaaagcaatggcaacaaaagacaaaattgacaaataggatctaattaaactaaagagcttctgcacagcaaaataaactaccatcagagtgaacaggcaagctacagaatgggagaaaatttatacaatctacccatctgacaaagggctaatatccagaatctacaaagaacaaatttacaagaaaaaatcaaacaaccccatcaaaaagtgggcaaaggatatgaacagacacttctcaaaagaagacgtttatgcagccaacagacacatgaaaaaatgctcatcatcactggccatgagagaaatgcaaatcaaaaccacaatgagataccatctcacaccagttagaatggtgatcattaaaaagtcaggaaacaacaggtgctgtagaggatgtggagaaataggaatgcttttacactattggtgggactgtaaactagttcaaccattgtggaagacagtgtggtgattcctcaaggatctagaactagaaataccatttgacccagcaatcccattactgggtatatacccaaagtattataaatcatgctgctataaagacacatgctcacacatgtttattgcaccactattcacaatagcaaagacttggaaccaatccaaatgtccatcagtgatagactgaattaagaaaatgtggcacatatacaccatggaatcctatgcagccataaaaaaggatgagttcatgtcctttgaagggacatggatgaagctggaaaccatcgttctcagcaaactatcacaaggacaaaaaaccaaacaccgcatgttctcactcataggtgggaattgaacaatgagaacacttggacacagggtggggaacatcacacactggggtctgttgggggtttgggggagagaggagggataacattgtgagatatacctgatgtaaatgaccagttaacgggtgcagcacaccaacatggcacatttacacatacgtaacaaacctgcacgttgtgcacatgtaccctagaacttaaagtataataataaaaaaattaaaaataaaaataacattaaagcaattgaatgtacataataatcagtgacaattttctagtataaaattttctttgttacattcttcatcagttctcaaaatatcatctaaaaggaaagggtgagccagacgaggtggctcacacctgtaatccgagcattttgggaggttgaggtgggaggatcacctgaggtcaggagttcaagaccagcctggccaacatggtgaaactccgtctctactaaaaatacaaaaataaaaatacaaaaccccatctctactagaaatatcacattatatatatctatatatatctatctatatctatatctatatatctatatatatctatatatatctatatatatctatatctatatatctatatctatatctatctatatctatctatctatctatatatatatatatatcagggcgtggtgacagacgcctgtaatcctggctactcgggaagctaaggtaggagaatctcttgaactggggacggggaggtagcagtgacctgaaatcttgccactgcactccatactgggtaaaaaaaaagaaaaaaaaagaaaaagaaaggttgttttaagtgtgtttgtaaggaagagggcagacaaaagaaagagatcattcaagatttacacaagattgtttttatttaggaatgcctttcttttgaaggtttataattggcgtttggttgagtttagtaagtgttccagacccagctctcttcagactgatggttcggaatccatctcagcctcatctccttttaccccagcctgtgacaagaagtgctttctctgaaaataaaaatcagtacacacagttctgttgatattatatttgcttctttgtcatatgtttaggtagaattagtggtaagttttctgagttttctcagtgtttaaaaaattcttccttaaaattggtgagtcaacatttatttccagttggactttgcagacatgttataggtgtataccttgaataactttctctttttaaggtttgctttctttcacgataaatgcagtaacatttgccctattaaatatgttctaagacttcattaaacacacactaaaaaacagaatcttaagtataggcattttctgctcatgtatcactcatctacttactccaagaaaagttgatcctgaagagatgaattactgttttttttgttttttctttttaaagttatttagggaaggcagtgtgtatttaggtaggtatgtacctatgtggttatttggttgttactatgttatggaccagccttctgtgataaattgtagagtttattttgttacgttgttgcagcaacttccttgacattattagaggggcagatttccatttcctgaacagcaacttaataacaactcttgatgaacttgaataccatcagtaggtctattctcagtttccttctcatttggctaaagaagtggtctcttccctgctttattgcataggcatgaacattgagttattttttcattgctttggacattgattctttctaatgacttccagtaggctacctttcagatcattcttctttatagttttacaaaatgcgtcatacattttaaacgcatcttccgtttctctatgtttcataaaaagacaatttgtgtttagatctcatctttctgggagttctttgaggcttatattcctaatctttcaggtgggaccagtcttcaggaagttattcggagtttgaaaagataagcagtttatgtgaagtgtgtgtgtgaaacaaccctaagttaaagcctaaagtaatctacaaaatagtatttttgtctctttgtatatatttctgtgaacattcacagtttggaattaaaatacggtgcccttacgaactataatctatgacaattatctttaaacgtccaagctgtgaagcagtagaaaaatctactgtgatttgggtaaacttttcttttcttaactttctttgttatcttggaaaaacataacatattactaatatatttttttaaaaatttgtcaatgttcagtaaagtacagaaggcacgcttttaaaataaaatgcttaatgtttaattcagcacaactaaaaaagaaaccaaagttttcttaattaaaattagttatgataattgtattatgaatcagcaatattcccaaaaggtggcatgcttgaaacgtggaatatgtttgctaccaaacagtcttaaaatctacaaagaaaagaggaatattattgaaagactcttatgacaattgtcttttttgaaacatttgtgcacattctaaaacaggttataaaagttatccaagtgtgatgctcttgattattaaaagctaaacatttcaagtcagtctgtcaattagtatttttgactgaataattgaaatctttttcagtaatgtttaaattgcactatggcttttccagattttatatgtatctaaatctgtatctatctgtatgtcttcaattaaaatccccactttattatgtcacaaaaatgaattaatgttggaaatatttgtgaatacataaaaactttatgtgagatagatacagcataaaacaaaagttagcaggttataatatacaaaaataaaatattttctttttggacctagcagcatcatttgtgtaatgcataatgataaaagatgcattaggtcatgatagttcccaacatgtattttaatggtatatcaacccttcttttccttgcagtatcatagtaatcacttgtgtgtatttgcatgttcaattttacaaaatcaaaacaatgtgtacctaatacctaatgtttaaaataattataaattataggtttattttgttactttgttgcagcaacttagcaacttccttggctcacattcccccacccctgtttttttggtggtggtgttcttgcttttgttttgagatggagtttcactcttgttgcccaggctggagtgcagtgggatggtcttggctcactgcaacctctgcctcttgtgttcaggcgattctcctgcctcagtctcccaagtagctgggattacaggcacccaccaccatgcctgggtacttttgtatttttagtagagatggggtttcaccattttggtcaggctggtctcaaattcctgacctcaggtgacctgcccatcttggcatcccaaagtgctgggattacaggcgtgagccaccacacctggccatatttcccccatttttaatcaatccattgctaagcatccaatggactgtactccaaaaagctaatttgttttgaaattggaatttgttttctatagactcagcagtaataacattgggtaaggtttcatactaacttcatgaacttacttaaatgataatgcaaatgaaatacacttaaaaattttctaatgtagcaatatacacggttgcatactagttattaatcactattcactagaaaataaacttggaaattaatgaacatttaagctatttttaaaaaacttactatgaatacttaaatccagccaaaaccccttggattgttaactctgtttaccttaaataagatcagaatcgagttagaagtggtcagacacagtggagcaaatctttctgtagaagaagaaacagaaggtttagaagatagcgggaaataatgcttgagcacccaagggctctgaaggcataagccaggtagtgaaagctcaaatctggtccaagagctgtgaaatggtaagaaattaaaaaagaagtccgaaaccacatgtgagtaacgtgaaagacatggaatgaagcaggcttcccacctgacatgtagggggaaggaatcaggcactttggagaatttcttcccagacatgaagctggggaattttaattgatagtgacaactgggcgcatagcagttgctctgtaaactcaaagagaaagaactttgtagaagtcttactaccaaccaacaagtacttttcctctttcttcaacagaccctgtaaccaaaccacaaatccataaatcatacaggtgaattcccatagctctagtatgaattacttatacattaaacattttacagataaatgacactcattgttggtcatataaatattacagtggacccatgttaagctattgtggaaacacagaagaagagactcaaatcaaattggagagaatatgaaagactttcagatggccacaatacttcagctgaaagttgaagagaataattttgttaatggcattgcagctgttgtgtgctgaggtattaatgagcccctacattggctcaggtgagaaatattataggattgatatgtagcagaaaggatgaagaggacataaactcaaaagttatttaagaatctaaaaatgtgtggttcagatgaaaaggagtttagaatgatgctttgatcttcttctagtacaactatatctttgttgttgcttttcaaagatacaaggaatacttgaggaggtgtatgtttgaggagaaagatactgaatttttgtttggacacagcaaatttgagttgatcattgcattagggttctccagaggaacagaactaatagtatagatgtatatatgaaggagagtctattgaatattgactcacacgatcacaaggtgaagtctcacaataggccatctgtaagctgagaggcaaggaagcaattacaagtcccaaagcctcaaaagtagggaagccgacagtgcagccttcagtctgtggctgaaggcccgagattcccctggcaaaccactggtgtttcagtccaagagttgaaaagctgaagaacttgacaggagactgatgtttgagggcaggaagaatgcagtatggggagaaaaatgaaggctggaagagtcagcaagtcagctccttccaccttcttctgtctgctttattttggctgtgctggcagctaattacatggtgcccacccagattgagggtgggtctgcctattccagtccactgacttaaatcttaatctcctttggcaacagacacacccaggaacaatactttgccttcttcaatccaatcatgttgacactcaatattaaccatcacagtcatgtattatacatgaaggaaaatttaatataatattggaaatgtatgctcatacattccctatcctatagataatgtaaggactcaatattaaccatcacagtcatgtattatatatgaaggaaaattttatatcatattggaagtgtatgctcatacattccctatcctacagataatgtaaggacagagactcccgttattttttctatatgttgaaagagatcttcccaaccctgcccctgtatgtaccatccttagatttctctaccacagattgtagccagtctgtttttctccagttgttcagtccaagaatatgaggtcttatttgactcttctctcctgctcacatttacttgaaagtcctgttaatgctacctaacattacatctggatttcaaacacttctctgtgcatccactttctcactcctttcaattcattatcatttcaaacctgaaatattgcaatgacctacccaatggtttaccagcttctagcttttacccaagaactattttcaatgtggcaaccagaatgaccccttaagtaaaagtcaaattatatcacttctctgctcaaaaccctgaaatggctgtccatttcactcaggatacaaaccaatgtctttaaagtgacttacacaaaatgcctacattacctcttccctcataacctactattctccctcctgctcactcagctccagccgcagtggcctttttccaggctttcgtacatactgtcatatttgaacctcaggacctttgcactggctgtttcatcttccaaatatcctcattagcagcacctttgccactttctgctatcagttcaattatcactttctacgctctgttcaactattctatttagaaatgcaatccaaccaagcacttttctcttctccacattttcttttccagatagaattctaacttacccaatttatttgtacatttttcctactgtctctgctattagaatgtaagccacatattagggatatttatctcttttttccacagaggtatgtcaagaatctaaagtagtacctgacatatagtaagtgcttgataaatatttttacagctttaggagataaaattgagaaatgaaaaatgtctatattgaaggcataatgtgatgatttgatgcaaatatacattgtgaaattattaccacaatcaagctaacacattggttatctcacgtagttaccttattttttgtgatgagaacacttaagatctattctcttagcaaatttcaagtatacagtatagtataattaactataggcaccatgttgtacatttgattctcagaacttattcatcttaaaacatttctccatttcccatacctctgatcccctgacaaccacccttcttctgttgctgtgatatgatttttttttttagatttcacgtatcagtgaaatcacatagtatttgtctttccatgtctggtttattttatttaacataatatattccaggttcatccatgttgttgcaaatggcaagatttccttatcttttaaggttgaataatattttattatatatatcattgtttctttattcatttattcgtggataggtacctagtttgttttccatatcttagctactgtgaataacgctgcaatgaatgtagcaatgcaggtatcacttcaagatattgatttcatttgccttggatatatacccaaaagtgggattgctggatctagacttcctttcttttctttttttttttttttttggagtggggtggtctcactctgttgcgcaggctgaggctggagtgcagtggtgccatctcggctcactgcaacctctgcctcctgggttcaagcaattctcatgccacagccttccaagtagctgggattacaggtgtgcaccaccacacccagctaatttttgtatttttagtagaatggggtttcaccgtgttggccaggctggtctcaaactcctgacctcaggtgatctgcttgccttagcctctcaaagtgctaggattacaggcattagtgaccgtgccaggcacaatagttctagatttctgatgaaactttgcagtgttttccataatggctgtaccaacttacattccaaccgaagggcacaagggttcccttttcttcacatgcttgccaacatttgttattactcatctttttgatagttgataaatacttgttgtattaaaaattagatgttgaatatcactagttttttttttacaggtgcaagccactgcacctcaccactaatatttttaaatatggtttttgtggtcatatgttaacatagaaaatatgaaaatattaagaaaactaatttttaaaaaattgaagaagaatatgattaggttgagttaaatatgaatggcttttagagctatgcaaacaattaaaactaactgacaagagagaatttgtaaagagattaagagtgattcataagtgctgggtatggtggctcacacctgtaatcctggcactttgggaggccgaggcaggcggatcacgaggtcaggagttctggaccagcctggccaacatagtgaaaccctgtttctactaaaactacaaaaaattagccagacatagtgttggctgcgtgtaatcccagctactcaggaggctcagggaggagaatcgcatgaacctggggggcggaggttacagtgagccgagattgcgccattgcacaccagcctaggcaacagagcgagactccgtctaaaaataaataaataaataaataaataagagttattcatatgtgtggatattcacctagcaagggaacagctttctggattttttgtgtgtttgttttttcattatattctgctatactgagtagagttttccattaaaatttttcctgattattatcaatggacaatcaccaatccttcttagctttaaataacctctctaggcaaacaagaactaagtagaaaaaaatatatttgagacaaaacaatattttatagtatagttaggtaattattgcgtttggtagtttttgcaaatttaattgtatttctttgagcctatttctttgatattcgttatttagaggtgctgaaagagggaagcaccaaaatgaatcacatatgacaagtatacatacaagcaggtttaaaaaaaaccagcaaaatattttaaatagctaaataattttctatttgtcatattttaaatctcacttaattataatcattataggttcaaggtttgttttaatcaactcaagtaatattttctggaaagctatgagcaagtgttttatgaattctaactctttggtatcaaaaacacaaattggcctgtttcgtttttcatcatgcatcaacaccagtttgggaattttctttggccaaaatttctattaatatgtaaaagaaaagatgtgttttcttaaatgctctggaaatagtatcataaaacatatataatgtgtaaatttaataaacttttaaaaatattgaaatgaacatcatatatttttgaatgatgtgttgatatcttaaatagtgctacagaggtaacaaagtttaaattaattaaaattatattcaccttgaatatggaatctatttcatgtcattaattcagctaaaaattagaaactaaataaattatattattgaaatttaaaacattgtagaaatttcaaaaaatgacaaatttgctttgtacctttatttcttctacaaattcttaaaaaatgctcttagtattttttttttttttttttttttttgcttatgatttaaaatatgatatttactttggaagtttcttcttttttttgttaccagttcgtgttatttcttgggttttctttttcacctaccatccttgtatttcttacaatttgcttctgaaaatacctatttcttctttttaaccaaatagctcaaggctgggataggatgcctcccaggaaacatctggcaatatttggagaaatgttttgttgtcacaattctggggagaggaatgctactgacatctagtgggtggaggccagggatactgctaaatatcctactgtgtacatgaccacccccaaagcacagaattttccagcccagcatatcaatagtaccaaggttgagaaattcttattgaaacatacactgcgcagccaccttagtggtccagatttctctacattccaaaaattttattgaatttattctcctttttgaccacaaaattcctgatttttctctcctctttcttgttttcatttctcagattaatgattctgactatgatgtgattgaggggcattgcctttggaaccattcagttaccaccacactagatcttcaataattaattaagttctgatcattacgtgttttcatttctgtgtggataactggaggaatcttgtaattaattagcaaccatgtgtagtacagtgttaacacttgctagaaatgagtgggctctttcagaattctcagtttaagaactcttccttagtgtttttcaacgcattttgtttggaatacagacatgcaagatattctgcaggggaagatcatggtctgatagatctggaaaatgctgactttttggtcccaagaagctctgtgatatttaccaatgaacctgagaggtcctgaagtactaaagcctgcttagtttggttttctgcagctgtgtgtgtgttttttttctaataaaattgttttgtttcgttttaatcccttaaaattcctattaacatcaggaaatattgatataatcctatctgctttcacaagattctaaatgttcaaatctcctcaccagaacaagtagaagtaaatctgctcaaaggatttttaaaaaaaactggcatttttagtgaattacgtgcagagaactttatatttagttttaattttgttcagttaccttaagccttttttatcttattatacattattagagtaaatttacatttttatctaatctcatattaaggattgaataatacactttttgaagtttacaatagtgtacatattatatgtatcttgttttaattttctccaggtgtttttaataattgaattttccagtttgtttgctgtaaacattgaccatttagaaaataaattgatgtaacactatctgcttcctcaaataatccccctcacctccccccacaacacacacacttatatcttgcttgtgtagtttatagcatagtaaatatacatgcgtattttagggtataaggctaaattcaaatctgtgatgctatatgccatatgtttcctgacctatttgacaaatttaattgccccttaaagtttctattgcttctgtaatgttataacttattttttgtaatagttggtatatttattttctttacagaacaataatttccatgagaactaggactctaaaaattgctcagtactgtatggtatgtcatatagagatcctgacagaatgccgtacatgcaaatatactcagcatgtgttagttgaaaacagatgatgagactcctaacttgtagtagcatgtaatctatatgtggataaaagtgtgctcaagcagtagctattaccaatgcacagctctgaatgactaaatatctcaatcaagaatatcgacaataaatccaggagctgtggctcaagcctgaaatctcaatgcctagggaagctgaggtgggaggatcatttgaagttaggagttcaagaccagcctggccaacagtgataccctatctctacaaaaaacaaaaataataaccagagatggttgtgcacatttgtagtcccagctattcaggaagctaaagcaggaggattgcgttgagcccaggggaggacgcagtgagctataatcctgccattgcactgtagcctgggtgacagactaagatgctgtctcaaaaaaaaaaaggaaagaaaaaaaagaaaaaaaacccaacataacaacagaataccgaatacccataataagaaatgtaagattctccatgaactccacatttttgggcttagtaacttgactcttaccacctaaattcaactcatttaaaactataggccaggagcagtggccacacctggctaatttttgtacttttagtagaaacagggttttgccatattggccagagtggtcttgaactcctgatctcaagtgatccgcccacctcggcctcccaaaatgttgggattgccagcatgagccaatgcacacagcctatagttttaaatgaattttgctgattctactataggctgggcgtggtggctcacacctgtaatcccagcactttgggaggctgaggctggcggatcacctgaggttggaagttcaagaccagcctggccaatatggcgaaaccccatccatctctactaagaacacagaaattagctgggtttggtggtgggcagctgaaatcccagctactcgggaggctgaggcaggaagaatcgccttaacctgggaggcggaggttgcagtgagccgagatcactccactgcactccagcccaggcggcagagcgagactcatctcaaacaaacaaacaaaaactataaagaaagcacccagaggaggaaataatcaataaattacatatttcctggacaaataatacttcatagatgcccccaactttcccattcattgctaaaatctcatcataaggttgtaaatccaggattacatggagcacaagtttcacagatgttgtttgactcattcattcattccttattcattcaatatgaatttattatattttaggtaccaagctatcggctgaaaccagctgttagaggatggagagtatccagattgttaaggaagaaatgggtagatcatctggtcagtagtaataatggtaatggatccccagaggcagagtcaccttggggaatataaaatgcattttaatttgaatcgataaggaggctgatattgtgaatcattaaaaaataaatttgaaaaatgtaaagtagtgacagaagcacatggtcaccaggcaagaaggctaagaggcagttttgaagccactgcaaggtattctttgaggaagtgaaggatgaaagctctgtgtttaggtttctggttctaatacatcctttaacaaggccatattgtaagagaatggttaaggtggggctgttcagttggagtgaaattgaccgttaatgatccatctcagtatgatgggcaaagatgtattacatgaacctggtatcagaagagtgtaatctttgtagctctcacctatgattacatgattgccattaattttagaatctacgtggaatcttaatgattgtgaatgactgaaaaccattaagaaaactttagagactttctggataaaatgcaatgactaagttattattcgatttatatgaataaatatattcttagtctttatgtgcttttcggtttccatatgcacaccctttagttctaagtttggattttcctctataatattacaattgctatttctttgtctgtctctctcttccctcctcactccattctttccagtatccttgtctatttttctttctttctctcttctttttctattgttgcatcactggccataaccctattgcagttgtgaaatatttagtggcctcagcttatgtccctagtgggagctatggaaagtacagaaaaatgaaaagtgactcacgttattctagtgtgtctctcactttccacagctacagttattgctacccttggggaaatttacatacactataaatagaaatatatactttagaaagacatttaaacttcttcttttacatgtcagaataaacaaaagtactagtaaagaaattatttctgcactaaataatgaattgatcctcataatgccctgtaggtatggcatattgagggacaaaaattataagtctgatttcaaacttctaagtgttgaagactcatgtttgataatttgataattgggggaaaaacagagcaaataattccctttttgtctatggatcatattgcctctcagttcctttagaaaaatacaagttaattaagcttagggactggaggcgtaaaggatagtaaaaggaagaaaaataatttagctttcagaagatcaagagtactaggggaagtgattttggctctcattttttattgaaataaaaattgacagagaatttggacatcctttggaaagccaggcaaaggaaattcagtttatcataaacaggataaaaatcagaatatccaattccctgggaatcagaaattctccatgaagctgaattctgcttcagttcatctctgactcattttgtcattcaaatatgtgggatacctactatgcaccaagcattgttttagctgccggagattcaatagaaatgatacggctaagttcctggcctccgtgaacccgacattctgatgtgactgctttattattagataatgtgtaagcaaatttgccattgtgtgttctaaattaagtaaattggatttaaaaaatttagaaagactatcttttggtattcttacaacttactatttaaaataatacaccatttgaaagaaggttttgtgcctctagctatagccacaagtggcttcatgccttcagaaggggtcagggaagacaagcagccaggaggcagtagggacagaatagttgctttgaatagagacaggtttagtccagttttgcctgagagggttagagatccattctgctctctgtccttgccatggattctgttgtctttcactccagccccttctgctcaacatgcatcattctttgtttccactctgcagtcctttcatgctgcttacttaggtgttgtaaattttgaatgactctaatgtctacagcatttcctgaattttacatctggacagtattgaagggcagcggggcctcccaaagagcctgttttgcttgactaagttcttttgctgtattgatttagtataagaaattctgggataatgttcaatttcttcatggttcttaaaaatttcaggcatcaacaaaggctgtgtattccaggcaagagatacaatatgaagaaaaaaaacaacaacagactattatcagcttgttcaaacacaaatctctacaggttgacattttcttaggattggttcccagaatgtgatgtattttcttctgtgggtgttcaactcatttgctcttacaactgaaaaaaacagcagtaaaagccaaattgaaccagtccagctgttatactattacttttaaagaatgcctcaaattcttagtgtttacttctagtttagttcgtaccggatttctcttcacatgtcaagctatgaaaaaacaagctgacaaatcaaaaggttgacttcccaatgtcttctgataaaaataatatttgaactattctatctgtaacacaagaatatgtatttatatgtaagaaatcctttggctcttccctcttttgttatttacaatattgggtgcattctcatgatctttctttgctattcattttatttatttttactttcctacatagagagttcttattgtttctgttgtttcataaattttagaagcctccaattttagaactaaaagaaccatattgtagagatttcatgatcgccaagtttaatccttcctcttacctatgagaatgcctgtaggttgcttgtattttattttatttcataaactactggaacatattctttatttttatttttatttttttattttttgagacggagtctcgttctgtcacccaggctagagtgtagtgacgtgatctcggctcactgcaagctccacctcctgggttctcgccattctcctgcctcagcctcctgagtagctgggactacaggcacctgccaccatgcccggctaattttttgtatttttagtagagacggagtttcaccgtgttagccaggatgctttcaatctaccgacctcgtgatccgcctgccttggcctcccaaagttctgggattacaggcgtgagctactgcacccggcctggaacatattctttatgtgcttgtatttcttttctgttaatatttagatctatagtttatttgcagctactgtaaattttgatacatcagatttatcgaacatgctacaaagagtaaattatgtcatagtttgctattttctcatttagatattactccatacaatacagaacataagctttgggcatgtttgattagtaatttaagaatcctttctatctatacaagtagtgacctacgcatcctccatttggcctccagtgtgcaattctgtgtgattaacattttaaaatttcctatttttttaatgctaacttttgtaatcttcaggtgtcagacgtttagatgaaaacagtacatctgctaaattattgctcaaaatattacatattttatgcaaaattgaatggttcacctacaggtagaatgaagagaaacaaacaggcaaaattattctttcagttctgttcttatcatcatacagttgggtctgcttattactaaggttagatcaaaggcctgagataatttagctagtttcctatctagataaacctagacttggtctaaagccacctagcagctctgtgacttgctatgatttagggctgctgttatctcccaaatactggttgtaaattaatgaatgaatccagaagttaaagataactgagacttttacaacatgaagattttcctgactgaaataaaccaggtcatgtgtcactcatttatattttaaattggtttaattagtctgctcctctgtgatcacctagtgaacataagctcttttggggaaacagaagttttgagagagaaggagatgaggggatagtaagaaagggatggttttggagtggataatgaaagctatgatcagatgaaagtgttgcagatgggaacatggccgttctggacagggtatcgccatggatgacttaataacttgggacatggggtaaataaaaatagaaccgtaaggaatacttggggagggggtgtaattgaccctaaaataattgtggaaagccaagactatctgatattttttgatatcaaagaaatataacctagaaagtcagaaaaaaactttagcatttagttcactaaaagaaataatgatccaaactaattgatatgcctgccttaaacacagttttctatgaattttaggctcatatacccttataggaaaaacatgatcacacacacacaaatagcatgtttttcgagaattattaaatattgggaacctgaaggtatcctagagatcctaagatccaaactcttcatttagtaagtgaagtaaacaagtcccagaagattaagtgaattggccaggtcatagagcccatcttcatgcaggattttatagtctgaagtgatatttcaaaattgggggataaatgcttcagacctttcaaaatttaattattgtagaatatagattagtgactaaaatgaaaagaaaaagtttcaggaagataatctctattattttggtataaatgttgacgaagaagagataaaaaatatttttatggcaacggcttgttggatacgttgccgaattttctttaaacaatatgaaatgatttttagtaggaaagtgtcagtgctgtatgtgtgtgtgtatatgttacactttctccgccacttccaagccattcacagttaaacaggatttcactcaaacattgtaacagcagttgccaaagcactaaactctgtatgtttttggatgtcttggtacaaagaataagtaacaggagaaacaccctcagggaaagtttagaaactctgtgtagcttttttcactttaataattacaacagtgttaattcacagcctctttgactagacacttaggatttaagtagcctagcaattctgccttcagctactagtgagttcttttgcatatttatcagatgtgcccgcctttctttttatttcatttttttctttttttctttccttttctcttcctttccttttctttcttcctttctttatccttcatttttctttcttttccttccttttaatttattttttaaagttgttaaactttaagataaaatcaatggggcatatatccattctctatcaaaatagatctgccttataaatatgtttcatttaaaagtcgataaatttttaaattcccagtattaatgtgtgattattttatttgcattatctctttttttaacctagtatattaaaatgtatgtattcaacacacagctgctgaggagctctctcccaccttcattcttcctcaatcaacagccctctctatactaggcactgttgtaggaagtaatgattgttgtagcctccatttattcttcataccaaatactaaattatttaggttcaatttgccgtaatgtaatcttcaccacagtctttgaagttgtatatcattgtcctcactttatgtattaaacaaaattttaaaaaatgttcaaagaagttaatatcaccaaggtcagtaaccagtaagtaagtttgtcgtggttcaaaaccagttcatctgaagttcagagtcgggtgtatgtgctgtgccttgtagactgtgtttgaacacaaaagcaggaggagggatatcatatgctactggttttcttccttctactctgcctactatcttctttcttggctccacttttcccagggcatagtctataaatttctgagaaacattttgcacttctgttatgagtaggaactctttcatgacttcaacgttgcatttgaatgcatatgcttctgcaaaatgtaccatcatcaagttactttaagcactttgggggaacaacatgatgactatacccaactttgccaacatacccatgatatgcatgattcactttcattattttagtataaatgatgccaaaataaatagaataaggaggttaggatttaggagagttgggtgtttcagctctgccactaaacatctctgatatttgggactaatatcttaatatttattggctttagctttcttatcagtaacagaaaaaaagttctagatgtgtttagggtaacatgccatgataaatttttattattatttctaataagagtagcacaaggcttagcatatagtaacatttgcaaatcttaagtgtctaaatcaatgcggttttacatatccttccataaccgtgccacttgataatacatttttttctcatgccatccaataactttttttctctaaaaataggactaggatagtaactgcagaataactaaagacttcacttttttactgctcagatgaacattcaaaataagtattatatggaattttgctgtagttttatgcttacttggcaacacaagcctggccttgtttctgtaactcaaggtttttgaccatgaatggaagttaaattttataatcagagcattttctaagtcttgtcccacaaaaaaataaaatataataaaatggaaactgttcaggccctagagagaatttgctggtcaagcacatatttacacaagtagagtgcatggcactcttgatattgtttctttttcaggagctgatttaatatcctgccttatgttgatgtgcaggctcattggtcatgtaggttagcttagagcttatattcccattcttattatttctggaatatattttaatgtccaggttatgttgaaacttattctaataataaaaatagctgcaatacagagtctccagtgctcacagaaataatgtagaaacaatactttatttaataaaaaagaaaaagaaaattttaaatctaaaatatttagtatcttcttccctgaaagcaaactggagaggaaatatgaatgagaataactgtgtacttgtgtgagaaaaagattctagagacaagagaatctttttgtttgtttgtttgattttgtctaggtaggatacttcactagtccaataatctttcctctaatgtttaacaacattcccacagtaacactcctgaaaatggctatgcaattgggaagctcaaaaatttgtaggagacatgtacatattatctgtacatattttcattcttaggaaaatagcaagtctacatataggcaagcagagaaccatttcctttctttctggttcatcacacttccccaagaatacatagaatgtgttcttccaaagcagcaaaagggatcctctcatgagttctttttttcacagcttgttacaactgcatgtttatgcatcttttcttatccatttccatcgcttcactttggatctctgcacaggattctgacaagctctttctccttctggcacagcagattaatccttttctaacacaacttttaccctttaaattattgatttgaaaatatccttcccaaatctaacttcattctgtttgacttcgtaggcactcacgtctgatccagcctcacacatcgaacttcctcactgttcccttgctaactcatgtctctctcactcttgtacctctcttgtaagatcacatttaaccacttcctaatatgctgtatctgtactccaattttctatctaggtcctgctcatctttctatgtcctattaaataccaccttttagtgagagcttctcttgtcattgttcgtatttcttgttcctttattttatacattaccatttaattctattaaaaattccttttagctaacaactacaatcacagttatcctataaatgttctcttcttggaatggtatttttggacattccatgttttgcaaaaggcttctgttttcaagatttaagcttgattctgctttactttataaatgtgtgccatgtccagtgcctctgttattacctcccaccagaggatgccaggccttgaagaaccctgcctgcatctcacaatataaggagaagaaaccagaacaattggtgtctgggattctagcaggacagatctcccacttggtcccatcagccatgggattcattagctgcagttaacccttcattggtcccaaactcttctctctgaatattgatgagaagatacctggaactttcatggccttccagcattttccccctggttttaatcaagcctttggtaatgagtttgtggcttgctctcttaatgaaccctatggtatgatgaaaactggtaccctcagtaaaaggccatccaactgtgactaaagggctcagaaacaagaggctgagtcagccagtgctgccgcagatctgctgtcagcaccatcaggagaatttatcaccacacaaataataataataataataataataataataataaatgtgtcactgcaattcctactagaaactcaactgccatcagagtgcacaaagtcccaaatttatataaggaacagctgggtcacttccatgacattcaagcttgggctggagtagcgacgttttgtctaagccaactcagaaccctttataatactcctcccacctataattttctgttttaggctctctgaaatatcctccctttctgttacctttacctgaccattacctcgaggaatctctcaaggctcacactcggaatcttttttactgcagcttgtagtccacagtagctggctctttactttgggcacagctattgatctctgcccggaagtatggacttgatcttgggacttccccctaggtctcaaggtctcccttgtgaaggctacctattttgttttccctttcttccatatgcccatgctcaactcccaagatcccagatgcagaaaagctccagctttgccccgaaccaactactcagtatgctcaaaagcaaaaatcacggactataagtatgaggaacttaggtgctgtactgaactttgcaactctcatagtatctaacagaatgaggttacatgttaagtattatttgattaatcaattgataaaatgtcttgtagataaacaaacaagaatccaaataggaccacaaaaatgaaacctgagacttccaaaataaccgaaatggcaggcagtccatgagatagtgtggaacataattgacactaaatagactccaaacaacaaaagattgtgtaatcctaaacactgaagcctactgtaagaaattataatactgtatgatgctaatatggagaattacagtagggattaattaaatgataagagctaagagaagaaacattagttaatagaatatattttaatttttatttttgtgttctgctctattctcttggtctcaggctcagctaaataccatacgtagaaggattaccaacctcttcctgaaagcttgaattacagttccccaggtggatattggtacttcatgaaggatggttggagttgctgaatattttacaaaggaaatgcgtgtggctcaaaggataatctagttatcttgatgaatttatcctttgtagttgaaagaagttttgaaacattagacttcaaagaaaagcaggaaagtgattgagcatttatgtaaatactccctaattgcaaaaaagtggttcttagacatttctaaattgagtgagataaacatcaaaagtgctacattattttctattttacaagtgtcactatctctctttccctccatattcagagatggtttttctgtatcatttctgctaaaagttaaagaaataaaaacgaacatcccatattccaaaaatcacgctcaaacatgggagatattttgaattcagaacacaggttgtccaaaaattaatattacgtccagtggtcagtttcccaggccaatccataaacattctataaaccctagactatagcttaaatctagtctaaacataacacatttgtattaaaatatgtagagtaagctatcctgtaaagattgtaagaaagaagattaaaaaacacaattgaaaaaaaaatactactttttagtgcgatggctgggaggaaagtatgtttaattagagcaaggaacagcaaaccaaactgcagactaaatcaggccacccacctattggtttatattttttccatggctctttcatcctaccatggcaaagttgagtaacttcgatagagaccatgtaactctcaaagccaagagtatttacgggttggaactttccaggaaaaaaaagaaacacacaaatgctggctctgaattgaaagaggaacaggagctagatggaactctctgtaaattttaatgttaacttctgtactgtgagctcctccaagggagcagtgctgtggctcgggcatcctctctccagagatgaggctcgtgcctggcacgtagtaagtgctttgatacagttctagtaaattccaagggcttgataaagcaattcctctagttctttctcatttcatttcagttcaaaaattacacatataattaaatattattttcagggagtgaactttttattattctttttttttttttttttgtagaacacaccgagcttctttctgtgggctaaagtaggcttcagttttctaaaccatgcatgggtatttggtgtaggtacttggaattaaaataaatattctgtctggagtatgtcctcagatataaatttttaagataaaagtcagtaattatcttattcagtaatctttccatcaggcatttttatttatgtaatgtatcataccgagagaggtgttaaaattgtttctctcaacttgtttggcaattgctgacaattattgcgtaatagatgtgtcagtgcatacagccagatttttgttaaggattgtaatcactgtcagtaaaacaaaccctctcaatcccatatcataaaatgtgtgctaaattctactctgcatattactgatattgcattcatgtttgcctatttccattttcttaattttattcagtggtgtttactgaatgcccccaataaagaatagggaattgtggctcatttttatcttacctttaccttcattcccccaaacagcagcaacaaaagcaacagaaggaaaaatgattttgtttttctgtcttctttcatgctgtacatatctttcttactgtacactttccctcaagaattatacgctttaaatttgatttgatatatgcttattcaattatacatgttacttgataactaacttttatcatagttattgaagtctacattcaataggtatgaatcataaactattcaattgaatctgtactttcttccagtttcatatcataattaaaaataacttaatcacttttatagtgtcttgcatttccttggtgtattatgtatttcaaatagactttctgttgcctttatatatgaatgacaatttggatatgaaatccttggtcacattcttttttctgcccaaatgctgtaatcttctggtatctaatattatggaagacaaatctgaaataacttgatttatttttgtattgtggatggcatgtcccttctacctggaagtttatggcatcctttatttttggaaccaataatcctttcacagaatgttttcatgtggttcattttcattaattttatgctatttacattttaagaatgcataatgcattcaaacaacttacctctattcaagaacctagtaaatattaaagctagggccagaaatcagtctcttatatcccgtttctatcctctttcttcctagttactccactagccctgcatcttaaaacactcattgcagtgtaattgtatttattcttgcagaaaaagtcttagtttagtctcaaacttagaaataattttttaaagtctagtcaggtcactagtattgttgagggaagcccacgaatggctttttcctaagggaagagtgattctgagagcaggtaattgtcactcagaatatcatcccacccaactctggtaaatgtgagtagaacatgaaagaaccctcaagcgttagcacccttgcttcagacatcttctgctctaacagaagatgggtcacagcagaggtgttacatgtgggaggtagaccacactgttggcaggcctgatggctgcttttggcaatggtagaagcaaaggaagttcacccactgagagccgaagaagagaaaatggcatgggccacaaagtagccaaggatattctactccatagcacatactatgtggaaaaattctgcagaatccacaaaactatacattatcacagaatcaaatcccataaatattgtcttgtgattctttgtgaccctgtgactttcctctttccaaatttgatatgacctggcttaagtaagatatattgttttctttttaccctctccctttttcttaccttctcccattcatatactctctctcctccccctccttccctctctttctccctctcctattcttttctctgaaaacttactaagggccatctttgtgataagaaattcaaccaacaacacggaactctctcttattcagattcaggtttattatggccacattttctgccttcctttgacaaatcatggattattatgaagcatgaaacccttcagtctgaaaactataataacaaatgtgaggtagtttttccacaacccattaatacgtttctattgctaacctgcctgttcccatgctcttgtgcatttattattaatactgtgagcagaacagttcctctgagatttggatagttttaaaactcacaattctatgcctttctctataatcgtaatattttagagtatgtattaggctatggataaattaaaacatatcacaatagaatatgtaatgaagaccttaggtgagtttatcacaaatgacaaaggaaaactatccctgaagaaaaaacaatccatattgaaacaggataagaacaaccacaaaaaattccataaggaatctgatgaacatttgagtgactgatactgaattcagcccattcttcttgatgtgagtgagatttgaaacagtacagtgagcttttccagtatagcatttttggaacgtgaattaccgtacataccactaacatagaactcaaagtatattaaggctgcaagagagcttggcagtcatttaatatcttacttttcagatggagaaactgatgcagataaaaggcagttgcacgccctaagcatttagctagttcgaggcagaacctgaactaaagccaaatgtaaagtctcttaatgccaagttttcttcactttatcgagtttccttctgtgtcctgcaacacatggcttagacaggttaatttgttctagaaaatgttagatataccttggactcatctgattctaggctattatgtcaaagtaatatgtcatttcaggtgattctcttaatatgagacataaaattattctcagcatgaaatttgaaatggtttaaaaattttgcaatcagcatacccaccaccaaccaaataataaagttcatttattttgcatcttatatcatgaatagactagagcacaccaaaccactgagttattgaacttgcatctggcagaaatcaatttgacatcccaatttggctatttctaggccatatgagtaatgtcataactgtgttacatcagtggtttttcaaatgtggctgtacattataaccacccaggtaaaattaaatcagaatctctggagggagggcctgagcttctgtttgtgataaactaattagagagttttactagtaatgatgtgttatagtaattatgaattttattacacaaaagctacttttaatcacaatactcagaaacacagattgataataaatctatttgtaatcataaagtaaaaatcaaagaatgagaaatgcttcaattttagacattttctaattctctcaggtaatgaaattcggactttgttctttgatccatactctctcaatctgtaaaatagaataacatttcttgtctcacaaaacaattacgaaaattatgttggccacatgataatatgccttacattgtgtacatagttaatgctcaattaatattatccttgatgacaatggtgatgatgatgttgattaataatacttaataatacttcagcttcaataaattaaataggtttccggtcctatgcccattcaaggcttgcatgaggattccagcttgcaatatagacatcttagtttaaattcttactaccacttatagattatttagtggaaagctaaaagtattagtagtttaagactaatggggcatcttagagaaacacagaaggtggaacaaagtctatacatatgcacaaagcagtttaaaattaaacagatttaagaatttagacattgtcaaagagaaagttaaagagtagattttctggtttgaccttttagcaagaaagtaaatgagaagagaagagataggaccatggaggtgacattttgcaggtgcgactgagtgagggcccttgaaattcaacataaatcatttgaatttcaacattcagatgtgattcttgaacacttttgctcatttaatgtaatcatttgaagccttatcacacttcaattgaaagtaacttacagctgtttatattgagagtttatcatgtagaacactcttttaacaatatgaaatactgtccaatcactctggttgccatatctaatgtttcttttgcacatgatcccataaattactttaatggaggagtaattttctcacataagtttgtgattttgtggctaatcttctgagaacatacgttcacagacactaaagacagcactctgacttataatatgtcaggtaataacggagatatacttcaaagaagcgatttccttactgacccttggtaagaacccaggaaaatgatgcaaacctcatgcgttcgtttgttaattaggagactgaacattcatttctactgccttttatatgtgcaggaaggcttctggctctggccattctgcaaaccaaggagataagcagtgacctgcagtggtgctctttccctgttctgggctttattcttctatgcaggaaccaatatcagcactgtcgttgagttgtacttcatcaacttagaaagactgttgaagtacgataaaggatgcacaaagctgttttatttcagtagaccctttttatcagtgtctgtgataattgtagcaatagcatggctctaccacatcaacaaaccatctgtgggccctttttcaccattgctctggccctttccagaaaaatgtgccacatccctgtggtaccaaaaccctttggcaggagatatcatggcttcaaaataagagtgtccaccttcgccttacaatcaggattgatgcattcagatttggtaaagaaacacataagaagcattctcaaaacttttataagtgataatggaaagtaaagcagaattgttacattcctcatgaagttcaagaggtatacatgaataccaaagtgacaaaatcctcttgctcacagcaccaatagtgacagtgaccatttaatacatgctttttttaatgaaaagaagaagacagatcccttctctctctttctaaacagacatctagtcattaagaacatgaaaaatgtcattcatgttttccctaaaaagcattttctaaaatttagtggtccaagaagtaaatgtccagtgtagcaacaaattacaacacagcaaaatttgactttaatcatatgaatctatcactcacagttgcagaggtttggctaagttcataatgtaggtattatgtgtatgtagtattctttctggtcaccaattattgggggaaccacccccaataattcaatgtaggttcttttcagatatcgggggaaccacccctgataattcaacgtaggttcttttctattttccctgagtgttggctggtctgagtaataaagggaaagagtacaaaacagacaaattttaaagctgggtgtccaggggggacatcatatgtcggcaggttctgtgatgccccctgagccgcaaaaccagcaagtttgtattagtgatttttaaaggggagggagtgtacgaatagggtgtgggtcacagagatcacatgcttcacaaggcaataaaatatcacaaggcaaatggggacagagcgagatcagaggaccgtggtgaaattaaaattgctaatgaagttttgggcacatattgtcattgataacatcttatcaggagacagggtttgagagcagacagccggtctgagtaaaatttgctaggcaggaatttcctcgtcctaataggcctgggagtgctacgggagaccagggcttatttcatcccttatcttcaaccgtatcaaccgtataagacagacactcccagagcggccattttagagacctacccctgggaatgcgttctctttctcagggctgttccttgctgagaaaaagaattcagcgatatttctcctattcacttttgtaagaagagaagtatggctctgttctgcccggctctcaggcagtcagacctaatggttatctcccttgttccctgaacattgctgttaccctgttcttttttcaaggtgcccagatttcatattgtttaaacacacatgctttacgaacaatttgtgcagttaacgcaatcatcacagggtcttgaggcaacatacatcctcagcttacgaagatgacaggattaagagattaaagtaaagacaggcataggaaatcacaagagtattgactggggaagtgataaatgtccatgaaatcttcataatttatgttcagagattgcagaaagacaggtgtaagaaattataaaagtattaatttggggaactaataaatgtccatgaaatcttcacaatttatgttcttctgccatcgcttcagccggtccctccgttcggggtccctgacttcccacaacaaccaataactttatttagtacgtttaaaatatagatttttctcttgactttagtgttcaaagcagcctgtaaatacttgtaacatggaatttttagcctgccccccaaaaaagcattctagtttcttttcacaacatactgctaaatcagaaaccctaagatattagcctgttctcatgctgctaataaagatgtacccaagattgggtaatttataaagtaaagaagtttaatgaactcacagttcagcatggacggggaggcctcataatcctggtggaaggcaaaggagaagcaaagtcacatcttacatggtggcaggcaagagagcatgtgcagaggaatcctctaacaccatcgtatctcatgcgacatattcactatcatgagaacatcatgggaaagacccacccccatgattcagttacctcacactggatccctcccatgacgtgggaattatgggagctacaattcaaggtgggtggggacacagcaaaaccatatcattctgccctctgaaatctcatgtccccacatttcaaaaccaatcatgccttcccaacagtcttgcaaagccttaacatatttcagcattaactcagaaatccatagtccaaagtctcaactgagaaagggcaagtcccttctgcctatgaatctgtaaaagtgaaaacaagttggttgcttcctagatacaatggaggcacaggcatagggtaaatacacctgttccaaatgggagaaattggccaaaaggaaggggctacatgccgcatgtgaagcaaatccaaaatccagagaggcagtcaaatcttaaagctccaaaatgatctcctttgactccatgtctcacatccaggacatgctgatgcaagagatggattcccatggtcttggacagctccacccctatggctttgcagggtacagcctctctcccagctgctttcatgggctggcattgagtgtctgcagcttttccaggcacatgctgtaagctgtcagtggttctaacattctggggtctggaggatggtggccctcttctcacagttccactaggcagtgcccctggggactctgtgtgggggctccaaccccacatttctcttctgcactgccctagcagaggttttccatgagggcccctcccctgcagcaaacttccacctggacatgcaagggtttccataaggcctctgaaatccaggtggaggtccccaaacctcagttcttgacttccgtgcattcacaggttcagtgccacatggaggctgccaagacttggggcttgcaccctctgaagccacagccgaagttgtaccttagccttttttagccatggctggagcagctggggcagagggcaccaagtccctaggctgcagagcagaagggccatgggccctgtccacaaaaccatttttacttcctaggccactgtgcctgtgatgggaggggctgccatgaaggtctccgagattccctaaagacattttccttattgtcttgctgattaacttttggctccttgttacttatgcaaatttggcaggcaacttgtatttctcctcagaaaatgggttttccttttctattgccgtgtcaggctgcaaattttccaaacttttatgctctgcttcctcttaatcactttgccaccttagaaatttcttccaatggataccctaaatcatctctctcaagttcaaagtttcacaaatctctagggcaggggcaaaatgccaccaatctatttgctaaaacataacaagagtcacctttatgccagttcccaagaagttcctcatctccatctgagaccacctcaacctggacttcattgtccatatcactatccgcattttggtcacagccattcaacgagtctctaggaagttccaaactttctcacattttcctgtcttcttctgagctctccaaactgttccaagctctgcctgttactgaattccaaagtcacttccacattttcaggtatcattacagcagcactcctctctactggtaccaatttactgtattagtctgttctcacattgctaaaaaagacatacctgagactaggtaatttataaaggaaagatgtttaatggactcacagttcagcatggctggggaagtctcacaatcatggtggaaggcaaaggagaagcaaagtcatgtcttacatggttgcaggcaagagaacgtttgcagggaaatttccctttataaaaccatcatatcttgtgagacctagtcactatcatgaaaatagcatgggaaagacctatccccgtgagtcaattacctcccaccaggtccctgtcaggacacttgggaattatgggagctacaattcaagatgatatttgggtgggaacacagccaaaccatatcaccaactgtatctaaattctaatgttaaacaagaaaattgtaaaatataggctaatctttgctttttatccatacactaatgagctttatttatgtggaaataataacaaagttattttatgctgctaaaactaacttatttgaagttcatgatattttatcctttaatgattctaaaatatgcttgcaaccacaatctgctgtcttttctgagacaatgttttctatatataagaagtagcaaaatgtagtaagaaaatgacagaactgggtctggagacctgaattctagtcctaaatacactgctggtcacttctccaatctggggtttccatttgtaaaattatattccacagatattgaaatatttaaatactaatctgtgaatgtttgtttctgaacctcactttgtcactttaaaacaaaattatgtaattattttacaataaagaatatgggagaattaattctccagctttgtcattttattctttcttctctaaaacagatgctgcaagtattaccaagtgtcttcagccttggaaagataaaacttcctttgcttgctgcagtatttatgtatacaattgattcattaaacaagggatgcatttttaagaatggcttgattttctttggaaaaaacggtttgcactaaaaacattaaatcaggtgcagtttatgtgccaatgaaccaaggaacagcagacagtaaataaagttgagaatactgcacattcaaacagaaagaaaatgagaagaggaaactgcaccagtattgaactaacatggagggcataaactaaacagtgactgacacagtttaaaattgctttcattctttctcaacacttttcactcagtggcttctttacagctttcaattaacctgctccctctgcttccaattgctctttcttactgccaatgatatttaaaagatacactaaattatagattcagaaatgtttggaaaagactctgttaatagttttgctatcctcagatggctttaaaattttgaagggtgcaaactgctaaactaagaacaatattggtgtcaggattcttggagaccagaacagtcaatcccagggtgaccagccagcccagcagatactgagatactgactgcactcctgccaatggaagaccatccaggcacaacctcctgaagccttggccctttgcctacaacgcacgcctcagaatgatgtcagcatttgaaaaggatttgtatttaccacatcatttatcattatatttgaactttttaacatgtactctggaaacatgtaagtcaaactcccttcatgaccacttccatcatgatggtgtgaatctcatgcctattataaagagatccatcatccatggcagtctactgctcctgcacctctagactggaattgacttgccatgtgagttgtcttggtctctttgtttttacaaagtttgacttctgcttccccaacctttagaatgctgtaataacaagaagtttgcatatgcatatggaatgctcatgcacaattacatttgagtgcacagtgagtaatgtggtatattaaccaacagtgcttaaccttaaaagacatttgacagagaatcacccacacttttcaatgaaattaaaatgaacagttagaaataacacttccatggaattaccttatttattttaggagcaaaatggaatgaaatgaattagagactcttacacaggcgttagttcatgtttgtcataacagcaaacagagccattggcatatgtataccaataactacaatgagaggtagaaagaaatgagcaccagccaagcacatgggagttttgagtggaggattagttacagttcagaagatcccaaaatgttttgttgattgtcatcatttaaggtaagcccaagactatagggaaaaattatatacagagagtcagagggaaaggagggagggagggagagagagagagagagaaagagagagagagaaagagaaagagagagaattgtgggacctagagataattacaggatagctgcttctagagaaaccagaagagaagacatggcatgtatagaaaactataaatagttcagcagtctagataatactaatatatttttatgtactgtcaaatataagtatatattcacatagaaagaaacatatgcataaagagacatacaccaagagttaacaggaggcttttgtattgtcgcactactattggaaatttcccagtttctttactttgtgcactcctagtactctaggaggcttcattttatttccactaatgacagtttatcttcaagttagtgtgaaagctgcaggctattatcattgaaacactgggtaatatttttgtacaaatttttttccccagtgaatttcatttatttcctcataacctctctgttttgaagatggtctctattcagtgtaggaaaatttctctactggaaaaaaaatggaaagatctgcaatattatacaggttgaaaagtttttccactttcatttttcctagtgtatgatagcataaactagcatttttttacgttgtaaaggcaagaatgatgtaaaaaccagaaaagaattaatgtacgtaagctcattgttattattcctcatagcaaataatatcacaaaagacaaaacaaaggaattatttgtaggaacttactaaagaatgtctgtttgcacaagtttaaaatttgctaagtcttctcatcaaataaatttaaacagcttactatgaagattgataggtatttaaactgaccttagaaatcaggtatataatttctgactttttggttttgtaattaagacgtgacagtgtgactgaaatttaaattcaagaaattagaccagcagctatacctttaaaagtacctgtagatttttgttccatgatactattttaaaatgtactcaaagcttgcaggtttaattacaggatcactaatttgtttccagatacaagagacttaaaatttaagtataactttaagccaatatttaatcattcaattgttcttcaaaatattaatcttctctgtatttttaaggaaaaatgacttatctagtctaacagtatgctgacttcatttcttttttccagcattaaattacatataaaccagtttttcaagctttaaaaatatggctcaaattaaaagccggtttcttgaggttttcaggtatattagcccattttcacactgctataaaaatactacctgagactggataatttataaatgaagaggtttaattgactcacagttctgcatggctgggtaggtcgcaggaaacttagaatcatggtggaaggggagggggagcaaggcatgtcttacatggcagcaggagggagagaagaggcggagctccaggcacttatcaaacaaccagatctcatgagaactcactcactatcatgagaaccgcatgggggaaatcacccccatgatccaatcacctcccaccaagtccctccctacacatgtggggatgacaattcggattataacttgagatgagatttgggtgggcacacaggcaaatcatatcatcaactatcactaatattcctgcttacaattcagaaatataccccattttggtacaatttggaaatatagggaaagtgatatattctctgagcacttttccctaaaatgtcaattataaattgaagattcagaaaatgtgttgatttttccaaagttgtgtcaaataggtagatatatgactggaacgattaactcaaaagtgaatgacttattcgttatattgaaaatagaaagcccaagtcccaaaataagagatatattctaatttctatgtatcccccaggatttgtgcctcccatttgtttaattgggtgttgctagtgaaatggcagtcttattagctttaacgtatttaaatttatgttcctgactcatgtgccttgttttcaaaccagttcaaccatctacgttatggtatcatcttacatcttctatcttaaatgttatacaaagtgtgtaagatctcaacttgtcttcatcctaagaaaaattcctgcaatgttgtcaaatttgaaatcctttttcttatattctaggtttcagtttttacagtgccaataagaagaaaaatgaccctggcatagaactttttttttttgttttatcattggtgctatatgtgaattccaaggtagtgttttgatgaggaacatgtttagtgagaataatttcattgatttcttggcatttttattagtatatattgaagatccagaaccatctattctttcaagaattatcttaatatatcaacatatactacatttccctaatctctactctgtattcatttagtcaacacaaccaaattcataatcttctttgtatctacatttgtcgattttttccaagacccctttattttccactatctccttctccaaataatgatggttgtaactgtaagttcttattcatatccacctaatcatcaagtatttctgttaattctccctttaaaacatgcctaaaaattattccatctctgttacttgttggggacacaataacctcttagagatagaatccagcaaatggagtggatgtcatttttttcttgaaatatcaatctaaattttagtagagaaatagcagatataattgtttacttgaaatcaatataatgcactaatccaagatgccagggactaagaacttgagacagttcaacaggctgagtcataggaatgggcctgtagggatgggtagaacagaagattgcacagggcaggacagaggaacaaatgagataggaaggaataagaaggaaagatagagatcaaggtgggagtacctactataacatacagagaatgaaaaataagatcagttaccacaggagttaaataattaaggttgtaattttatcactgcacatgactggaaggaaaatatcctgttttgtccctttttacttgtatacaaatgtttcagctgtaataatttactgtggccataaaaataaatgttccatttgaaaacactttacccccaccttttaaagggtgtcgacttcattcaggtcaatagagaaattagagagggtagaaggaaaaaattgaagatgtgaaaggtgatgtagaatcaatgtgacaatgtaattcatttaccttttaataaaaattacacacaacttctcattgcttttcttttcttaaagatcatgagctgaaattttaatatttctgtttctatgcttgaaaaacagtctttctcccttgcccctaccataagcagtggctagctaaaataaactaatccaaaaagtttcagttctttcctcaaaaaatcccattcaatgaagtccgaaaattagttctaaggatatctcaatttatgagtgacagcttctggtagtgtgaagaagtagaatctgtctaaaatattcacatgataactgttttctttttccaagactagagccattataagctgaaatataggtagagccaggtgcttcacaacaatgtttcagtgatggaccacttccacatacacaaggatggtctcataaaattataatactggccgggcgtggggctcacgcctgtaattccagcactttgggaggctgaggcgggcggatcacgatgtcaagagatcgaaaccatcctggcccacatggtgaaaccccatctctactaaaaatacaaaaattagctgggcatggtggtacgtgcctgtagtctcagctgctcgggaggctgaggcaggagaatcacttgaacccggaaggcggaggttgcagtgagctgagattgcaccactgcactccagcctggtgacagagcaatactccgtctaaacatatatatatatatacacacacacagacacacacacacacacacacatatatatactgtgtttttactatgctttcctttgtttctatgtttttagatacactaatgcttaccattgtgttacaattctctacagtatccaggagagtaacatgtaccaatgtatagcctaggagaaataggacatgccatatagcctaggtgtctagtagattatgccatctaggattgcgcaaatgcactctgcgatgtttatatcatggaatcccctggaggacacatttcttaaaatgcagcccatttttaagtaacacatgactctgtattccatcttctaacccttctgcttctggaaaagcacagacttcaggccaatactgagtatggcctctgaacagaaccaaaagagacgttgcagggtaaaaaggagttaatgaaaagttttttgtttgtttgtttgtagcctggataatttgggttaagataatgtttcaacaggaacagaccctgaattactgaatccaaaagggatgtcttgggttgtttctcacgagtggtcatcagatttgtatttctgcaaaatgagattttccatatttttgttagacttcagccaaaacttttgctgtgtagaaaggggaatgcaatttttcttatggtatcaatgagtgagaacatacaaatatataaaacattagtgttaatgaaaagaaaaaaaagctaaaaagtgtaaaagtgaatcaccctgttaacatttatctgaactttctgggggagaaacctgatgtcatagaccacaattagaaaggactgcacttaataggaactttgagtaattatatgaaacaggacaaaatatttaaaatacttttaagtatcctaaaaaagaagaaatatcacattaaaataacattcagagatgattattggcagctcctaattgccaatccctctgctggatgttcaagatacattaatgcaatatagacaatagcctgagccttaccttccacaagtttactgtttgttggattttccagcatatttaaaagtggaaaatgataatgcaaaagaagaggatcaatatatcctgaaagaagaaaaaattccaaatgaaacagaacttttttttaaatgtcccacgagtgtgtgtgtgtgtgtgtgtgtgtgtgtgtgtgtgtgaatcagaaaaaaatatttattaaggaagaactgaaaattgacatattgcttcaattacattgtgtttggaatcatacataatttttctttagttaatactttgtgaaatatatttaaatatactcctgaatttaactggtcacaaatcactttgtcaacttcataatatgccaagttagagaaacacacaataaaataacatctttggacagtcggtcttctttagagcaattgtagtaaggttagtgatacagcaacaacacaaaacaacaaaaaaccaaatcaaatcgacaaaaaagtcacttttgctttcacattttccacatagtagggccttagggatgacaatcctgatggtggtgagtgagattctcatttgtatataaaacatattgtcttcatttatactgcatccttatctgtgcttgtctggagaagctgctaatggagattatcaggggctcacatcacatcatgccacctttttgagttgccacagttgagttgccataggcaaattggtatattttcatgccacatagctacatgaaaatacaccagtaacagtgtagaagagttttttactggtctctattcataacctacattatctgatttcagccaagatatttttttaactgatggctaaatgttattgaaaattaaatctcctcttaaggataaaactagatcagtcgtctcttgagtgaatttctcagatttagttgtagaaaatatcatatgtatctaattctaatttgaatgttaaaaatgttaaaaaacttaatgcctgtgtataaagagccattaaaaagaaaatctcgccttgactcagccattacacttccggcaatccaaactatatagaaacctatgcccccagaatttattgttgtatgtttaagacaattaatttaaatagccaaaatatttaaaaatggtgaacaactgcacagaatataaaatgtctactagatgaaatgctactagatacactgttatgtagctattaaaattgcattcataaaatatttataataatatacaaattaaatctgtcatggttaattctattatcatataaaactgcataaaaataatgagttcaactatgattacagaaaatgtacattatagaggcagaaataattacatcaaaatattgacaacagttgtctttggtagtgggaatttgaatccattatcttttcctatttttttgtacttcatacaataagcatattttgatgtgtaaatacataaacatcttaactattttgtaaatcctgttctctgatacactttagagctacaagcctttggttagtttctgcaaaagttttttgttctgtgttgctttgttttcgtctctataaaagaacaaacttttctctatgctcttacatcacaacaatcaacacagaaggtttttgtgaccaagtgagcttgggttttcccacacacatcaagcaagcaatcaattctgcagcagacacaggttgagtgtcctctaattcagttcaattctaacactatccatctggagttagcatcagatcccagggtgaggactcagttttcaagaatgccccctcccaccacttcagaagtcaacagaaaggtctgcctctttctgatggacaagctacaaatcattcctacaaacccttcctttgggttcagttaatttattagagctgcttacagaactcagggaaacatgcttacttgtttatcacaaaggaagttacaatggatattggtgaacaccagatgaagagatgggcagggaaggggatgagtgtggcagtgtacagcttccatgacctctccaggaccctccagaagcccccaagtgttcgaatatccggaagctctttgaacacttctttttgggttcttacagagttttcattacaaaggcatgattgactaaatcactggccattgctgatcaccttaaccttcatcctctttctcctctcctgggggtgggttggggcagaaagtcccaaccctctaatcctgccttggtttttctggttaatagccccatcctgaagctacctagggactgccagccctcagtctactagtcaactcagtagcatacagaatttattactttgaagattccaaggattttaggaatcatatgccaaaaactggggatgaagaacaaatatatatataatatcacacaccaaattctgaaattgaaaataaccaaccctgcttatgaaagcatagttgtgattttttggggggaatcctttaattcgtaaattatatactgtacctttactacatatatgacttttcaattatttaataaattattgatggcatcatagcattagttttaatatattcatgttgacttgctatcaactcaaggacttcctttcagctaaataaaatatatccatggggaaaattcttgtaaaactttgttttatgcactattttatttacatctcagagatctaaattatctattctaagattaattgggccaacaatatcttaagaaaagaaatgacagactctaaattggaaattaaatatcagtccactaattagttaatagatcttttaatactgtctctaagtgatcaaaatgttctgtgcttctgctgacttctagcactgaaacttgttcttaaaacctgtaatcagaggaaagagtataatgggaattgtaataggtatacctttttttattagctattctctgatatgcactgatatggatgctttgcatatgtcacaattatgagtaaatatacattatatctcttctgaagtagatatttacatgcctagtttacaaacagaaacaacagtagaaaggttatgaaaattgcccaaattccaaaacccagaaaactgacagattatctttgtatggagtctctctcatgccagtcgtttgttggtggtggtttaatgtggtcgtggatcatatagtaaatacttttcaaatgtttcaaccatagagttaaaacatcttagatatttaaactacatttataattcatattaaaaatatcagctcataattttgtcatcccccagtgtttttacaactgattattgtatataactaatggccccacccttcagcaaaatgtctttaatattttaatattcctatttttaccatgcaatgggacaggcaatgtaaggagtgccatattttcaaattgaagccagacatgggaacattacataaaatgtataaaatatacttccctaaaagaaaacgaactctccaagagataaaataaggaaatatactgaggcattgacagtaatttgccttcacagtgtcctccataactggagacttaagaaatatgagtgaagatatatgtcagtaaattgtaggcaagtaagcaagtgttttaattatcttcctgtgattttctgtctaaatatgaagatatctagaatccctttctctattccaagaacacatttattattgttcactgacagcataagtttctccctaccatcacatttattattgtttaattaaacagagacaagtcaagtggttcagaaagaaaccaagtaaatgaatccccatcagtctttacataattaatgatattctctgtagactgcacaatttattaaattgctgagcagaaccacttcagatacacatatttatgtattctgagtcaaagactattctagaaactgtagaacattggaaactaaaataagtcagtggattttttttaaaaatgtgtaagtatgacaaaatttaggagagtaagaactattaatagtgccccattacttcttttttcattttcagaacctttaatgtagtgctatagcaattttgaaagtaaaatcacttaagaaaaataatatgaaaaattaagatattggaaataaagtatataataaaaaagtactgatttctagggaaaaataaataattccccacactcagaccagatacttttctccctatggagtaaattacaagtgaaattttacatttgaatgaatccggccataggatatatattgtaattattaaaagtctaacatagcaacttgaatgtttcaagagacttgctattttatatttaatatgagtgaaaatatgttttaggaatatgttttttgttccttaagattaagttttgtatacagagtcatagacagaagttttattctttctgtctctgggagagcacagcagtaatgattctctatgaggctaccaacatagcaaaattaaccaggaaaaagcaggctcctatgcagagcctattaataaagaaggtaatgacctctaagcattttatttgtgtttcgtttaggcagaattctgttttgtcgtattttacacattattcacaatactgtttttcaaggacatatcacagactaaaatcactgacccagatgacaaaaattataacataagtttgtattgtgaatgtcaatcatagctgttaaaactaatgtatgctgttaaagaaagagtgtgttgaaccattccagcaaaatttttagtgggaaaatccattaaataattcaggagaaattgtaataattaatcattggccttgaataaattgctagaagaaaacaacatactatgttgtgcttaatgaaacatatacgtgaaattattttcaatttctgaaacgtatcatttcaaatataatgagaattctttcattcatgagtcatagataatatcaaagctgtcttggatgctgttaggacacagtatttctgggatactattaatcaaactgaagaaagtaaaaataggtttataaagtagtctagacccaaaagggaggatagacattaatttcttgtgtgatatattggatacattaatatacaatgcatctttagtacttgaccttaagtgtcaagaatataatgcaccatttctcttttataagcagtactttaaagaggtgtttctggtcaacattattttgtactgcaaggttaaaatgatgaaatgcataaaaacatgaaatacacaacttattaaaatgcaattcaccagtccatgttcaggtgtttctttaatgtcagacctcaacaacaacactttcagataaaaattaatcatcaacatgatgctgtatggtaatggcatgaattttatttccatttaaatgtttacatttctctcaaatcaccaaattaatagtacctttaagtctacaatcaaaatacatatttagatttgtttcttttatgctatttttgcagcaatttttattgatagagtatgtgggtccttagctaacaccaagtattcattggtaatgatatcaaggtaagagctctcaaaaaacaacattggcctcaaatattcacccaaaacctagctgtatgattactgcttgaccaagtgcctttgacaaaatctatctaaaaaaaatcagaccttacctcccttttccagtggagccttttaaggtattcacagctttcattctaatttattgtgaccccatatatctacaagtgtaattggactcttaaagtttttagaccaatccaccactagtagcatagtagaatgtatcatgcggtaccgtgaaaaataatgggaactgaaataagaaagacattcatttatatcctgtctaaatcaattactctcttggagacttggttttctttaatggggattaaaatgctttccattcaagatgtactgagtttaaaataagcatcatacaaataatatcttggtgtatggtaggtttccataaattttatctagcttccttcaaataacattatacaaataacatactacattcctactagatttccatcagttttagttgaatcctttcaatctccttcttttcatttatcaatcataacaatgtgttagacaacagaaattttttttagttacaaaatactttcttcaaacagaacaggactgtgttttttttttttttttttttttaactcattcatgaaacaaacattttttgaggcatggttattagcaaaaacattccaaataacgaaagagtggaggatggataaatgaacctgctgttggtttctccctttgttctaaataatagatgtagacatattttaataatagcgattagatgaaagtctgcattatatagtttaaattactttaaaatctctgatggaacttaaaacaagagaacaagtaacaggaacttgagagttagaaaaatattttttaaactttaggcagaaataaagcccaaaattttagtatatttcctgccagattattttatatcctagagataccattaagaaatgaaatagaaacaaaaagctgttgtaatgtagaaacagttaccacaattcagtaaatacataagtaggacttaatttttttagttcctaaagtatgttcttattcatactatatatgactttagcagacttatttacttatttatttactttgaaggagggagtggtggtgtttgggtatataaataaatgttagctgatgacaaagcaactcttttaatttatgaataaaaactgctaggcattaaaagttatttcctgaattatctatttcccaaggtttaaatctttaacttaatactcaatatgtaagttttcatcctgtgaaaaaaaaaattactaagtgtaacagaatttctatatttcactctcttctgtcaagaaaaatttcttttaaaagactaattatttatagttgaaataagactgattagtgttgcttgttccaatgactaattaatgaggaaatggcatgtccttaccctttgatttcttgctgattaataaatcaataaagtattactggaaggaaaaaaaaagcacagaaccacactcatataatgagataatggttgccctttttcactttctgaaaactcatagtctgaaaaaaaaaaaagtccacatcataaatgaaattagctgggcccattgccagacttttgaaggaggactagaattgatggctcatgaagattaaattatttattcactcctggaacatgaaacaccaggacagagttgggacacagccattatggtcgcagcttgtcattgcccttgctgctgtgggtttcatttcttaatatacaggaatttcaaacttcaggtttgttattataggtcagttcttgagatgggcctcaatctagtccacatcttcatgacacatccaagataaaaataactgctaagatttttggtgtttcccagtctgagtttctaaagacatcacagagtaataaaaaaaaaagtaacctatataatgtaggcaggcattagccacctttgagccttttatgctgtgtggatataacagctccaaagtgaggaattaggggcttcattgtaaacccctaaaacttgagctcctttgatgcctctttctgtaggtgatgctgtcgccatttaaatacctggaaatgagccatatgaggtgcagagctaatcttaaaatccaagtagaaaagacttcagccttccattggccctcaagaagtcacagtcagaaccggtttgagagacaggtaggctacctcacttacaaccctacgagtaggctgtctccctagccacaggattctctgggtctcttatgggcactgcatgcaaaacttccttcaccttggatctcttaactttagcctcctgaatcatcctgttcttatgcaacatcagctatcattttgaactcaactagtccattgcctgaagcataagagtcctaaagtgtcaaggccagttgaggcctcacccagctttgtgattttaaggctgcacttttatagatgccactgaaatattctttagatttcatgaaattttgagttcacaagactaatatttataccttaaagaagaatgcttatagatgatctggctttattgctgcagacagaataaattagacattttttacaaaagtcaaatgtaaaagtatagtatctaggatttttgtgctagtacttaaaataaaggaaatgtttgaaataaagggaaatttatccaaaatataattatgtaatcaatcaattaattcaaactgattttagtaaaacttccatctatagaacagctttcttttaatgaataaaatcattaatgaaggcatattgtaaacataaatatatggacagaatagtccagaaaatacagaatttggatgcgttgcgtgagttgtcgaggtgaagaataaagcatcttggacaacaggttgagcatttcaacaagaagaaaacttactgtacagggcctggctgctgtgtgctcccctagatgcctgaaggttctgtctcaaatataccattcccacctcctcccttctcccccagattaaatctgttagtgttttgaaatacccaaacttttcatgtttttaatagacattttgagtaactctggacaaaaaggcattgctagattatgatgaatatatgcactctggagttactatatctgaattcaaaaggtgccctgaaatttgctcattctgcagcctttgtttggttacctaaactctttaaacctcagtgctaccatatgtgaagtgaagatgattgtcttcctattaagactgtgtgggacttgagtgatgtagtacacaaaagcacttaatacataagatgacttggaagagaagagatactaaaatggtgtattttaatttttctccgcctcccgggttcaagtgattctcctgcctcagcttcctgagcagctgggactacaggcatgcaccaccatgcccaactaatttttgtatttttagtagatacggggtttcacaatatggaccaggctggtttcaaacccctggcctcaagggatctgcctgccttagcctcccgaagtgctggaattacaggtgtgagccgttgtgcctggcctgagtatactgttaatatagttttccaccaccggttaccaggctatacctatatcataaatcaagtaatcctataaatctcttatcagaaaaatatagctattatccccactaaccattgcaagactgacggaattctaatatttaccagagtactttggtctaatggcaagggggccaagttctctgttgcactgtgaatgggttgtcgggtaagacagacaagactacttcatttttttttttttcgtggtcacatgtgtctaaccctggacggtcatctcatttccacacacttttgttttaaggtaagaggcctaaataattaagaaccaatcaactaccctgagataagattttgcctcaatagtggaacataacacctgaaaggaaagtgaaattgaatgttgattttggagaaaagaaagaagaatgaaagcaaatttttatgtgttgacttagatagaggccttgcaaacataaacacatttaaccagcaaacaactctagggccctttgcaccaaacgatgcaaaataaaaatgcattaatttcattccaaaagctgcatccgtgcactttatgtaagttgcttaaagattaggaaatcagttactgtgcataaagttgaccttcatttcagacatctgaaaaaaatatagttttaagttaggatgatgataattttcctccggcaatttcgaaagaggtgtaattttgtagctaaagtcgaaatcttgaaagaaaagtctacctttcaaatatgaattcttaatcattaccttgatgtaaaatcaattaccattaccaagcaaaaataagtaagtgctcacttttttgtgaaggtgacattattcttttaatgctgtatttttaatattttcctttttgctttataatgggcccacttagatgtatttttgttttccttagtccaaattttagtaacagttttgtgctttggatcctgtcctgatgggtttgtaataatttttacagaatttttaaagagatattaccctaaaatattagagttccatataggttcttgaccacaaactagcagaaatgtgaataggtatattggaatagcttggccacttcagaattagtgagtcaaacatgaggaaatactataaactagagacagcagacctagaatttatatattatttattcaacattaacagtattatcagtaaatattctaaaattacagtaatgctattaaggaaagaattttctgtagagtatataaagacaaattctatattttttaagtttattaattaagtatattaaaatttcttatcacagaatgactatgaataataataattcatccatagatagatacagcttttctggtctgtagaaactgctaaaatcttatcggattcatatactgaaattttatattttgtcatgctgtaatgctcattcaaagatattaagattctgataagaagtgttttctaaaagcaaaataatatttttgaaaatccaggatatatagtttaatatacagagcttcttaaaaatacatccagatcgcagagtgtattcaactaatagtgtgtgaaacaattaatcactgggggtcagttttctaatttaaagtgaggtggtttggcctgaagtacattattttgaagcccctactatgattctgtgaactatttgacttactaaataaatgtggatggaagacgtagcattcaccaatggtccaggggatgctaaaaacaacagaacccttgctagattgacctaattgggagtctggtgtgtccctgttttaagatggtgagttatctaacaggcacagaacattcagcccaggtatgtaccctacctttaatcatctggacgtataatgattttgagcattagattcccaaagtcatgaatcctgttgaaagagcaccaatgaaattccaaattgaccagagtattttgccataatattatcaggttattttatgagtaattacattttattatagcaattaagacatctaattttgccagtatggaacaactaaatatgagtttaagtttgaatgatgagaagatttcaacttcatcagggtgatgaaaaggtacatagaatggtcatgaagtagaatgaaatacagttagaaaatactgatcactccagcatgtctagggcatggggcccttatagacacaaacaaaatgctcttcataggtgatgcttggtttctgttcagtacattgtgttcttccaggtgactaaaattgattatttgatgatgcctgctaatatctcccccttactggagttaacctgaacatgagatgctgtgattgccagggctgtcttgtgcttaacagtgttcctcattgattcagtctgaaagtctaaagtgctctcaacagtgtagccccttatgccattggacggctactgtagaagtgtccttggaaaacactgaattttatcaacgactggggagtagttgattaatttttaacgtacttgcttctataaatctaagttgccatttccagattaatttcatttcagcagagttgtttatgtgcatataaaggtataatttttaaaaagtgaaatttcaatacatgtccaattctgttggcaaacctcaaaatttaaaagaagctttctttatatttttaaattatgcttctatggtagccataaatctcagtgcacttttctgagtggaagccttggctattgatcaacctttggtcttctgcagctgagttaaatatcatggaaacattagtgttgaaaactaaatagatgaaattgtaaaacctactttacttaactcagtgacagtagtatttgtcatttatttacatgacgacactgaaaatcaatcaaatgtcagattccttttaactactttaacagaatatgtgagattgttgtatgttgggcaactcaagaagtaatttattcaaaccctaatgctggaaattaaataatatgactagaatgactactctggttagtagaacacttttcatcagaaagttgtgagttaaaagattttaagtaacccaatgggaactagattcaaatatcccagttcccaagccatgttctctaattcagatataaatattagcaataaggatgagtacctcataatctttgtgtttccgtctgtagaaatagcttaatgccacctgtcaaccaatgtctgaataaactaaatttggtaaataagatgccatcattgtttttccatggaattcagaggattcggttactgaaatccatggcattaatttttctgcctaacagcctacactctatattgatttttcatatagattaaatttcctttttaaatttgcattgactctttaggcttcggtttcctcatctgaaaagctggtaaaacaatagtgctaggaagaggcttcattgtgaagtcaacaaagattacacctcaaggctacatttgcaagtgcctacacaatatatgtgcattgctatatgttgttgtaaaatttttgaataagacattaatgcattcattttcttaaagaaggactctcatattctttaaaactcagaccccacaatacccagatctacttttatacaaaatccctaaggatgtgataaggactaaataagatcatgtaaatgctctttttttgcaaagtatgtgcttaaatataaactgttgtcattatgaaagtcattcagtgtagggttctatacagttcaggagtcaaaatactcacttgatacagtgactgtcattgtatttaccattcaacattgtttacatttacatacctggctttgttatttccagaagggaaaatccacgttcaccttgtttgcctttcaaccccagacactaggatggtgcatggcacactgaagacactcaataaatatttattttattaatgaatatgaaatatgacttagcagtacagaataatattcaaattgtgaaataaaatacactgaggatcaacactgttatttaaaagattctgttgatcctaaattttacaatgagtcattaaatgtattgctcagctttcataatcttcaatctataatggtttatttttcaaaaaggctttaatttccttggattgttgtaaagttcagagttattcctttaagaaacaggctatattgcattgcaacaataaccccagaaaaataacattagtagaaataatataattaaatattcatataagataattgacttatctgctttactcaaatggattttaatgataatattggactaaccctatgtgacagcatctgctgcttttatgcactgtccccttacctccctcggccccctgctttgccaatccttccgaacataccctggaacatttggcttaaagtttcagaaaatctgctccgtttgataatgtcaactcatcacatttcagttaagcagacatcaaatcaaatgactcatgtcacagatacataaatattacgtacatggaaaggaaatttttagctataaatgcataaaatcttctggtttgtaaacctgaactacattttaaaattttgacagtaagaggaaactgatgtgaaactaatacataactctcaaataatccaatggccaactgatttggaagctactcatacaaaataatacttgcgttaaaaaatgtcctttccttaaagttactatcttaacaaatgtacaatcataaatctactaaaggtaaacatcatttcttataagaaggatatattgaactgcatacacatcttactgtcttcaaattccttcaaaaatataattaacccatccaccttatcagggttagctcaaggaaattcgaaaccatcataagctaaaaatcgttatgtgattgaacctcatcactagataagtgattctgacaaaattgccattttatggaattgatcagaaatgccattccaagaaagagggttcgccttatgaaaaaccatatatatttttatatctatattatcttatatgaataatatatatatatttttttacttgcctttggaaagaactttgtaaaatttgttaaacttcctgtatggaatgaagtaccttattacacatttctactcttgttaaataactgggggaaatgtgttatatctaggcctcactttataaatatttgttgaacttattgaattcagacaaggaaggccagaggggtttgtgtgagctgttctctgccgtcggctgatatcgcatttgctttgataaataatattttaccttcccatttgggtaatgcctgccttaggttgagttcttcttaaagcagattcttagatgaagattcatacaagtggtttatttgtgaattgaaagaaatacatggggttatggggaaatgagacagggaagggaggccagttgctaaagtcaaaacaggtgcctctaagctagctgccacgggaagggaatgtagatgagtgtccatatgtcaatgccattggtcattagatgtttttgatgaggactgctccatgatggttcatttcctggctcttgcaggctgtcatgaaggtggcaaatgagtcttcagggacaggagagcaccctcaggaaaagaagccaagaagccaggggttggctttctcttggaagttaggcagtggttgatgaggtgatcaaggtgggagatatgagtggagaacaatcagcgtctgccagaatgacaaccatttttcacatcttccttaatattttaaaaaacagatatattctaagacttttcttataatgactagagagggttttaaaaagtggttttatatttgatggaacccttgttggtgctgcagttaaagagttacttcaaaatcctgcctcagcacaccctgttcctttttctttgcactccccgaagccaatgtttcagaagcaactgccgatcagcagaattcatctgtttctcccacagggctaatccctgaccgacctggaagccaagccaggctctaacctggcagactcactcttctcctgctcctcttttacgtaatcccatgcttattgattctctagaaaatctgttttccttttgctcaaagcagagtacaaagcaagaaactgcctcgcactctggagaaaacacatgaaatcacaagctaaccagtgactgtcattccataaaatagcagttctattaaagtgcattatgtaaaaatgggatttgtactagagttgttttataggaggttggtttatatcatcacctgtttcattgaaaatttggtcggtgatgagtcatccataaaactggcagaataaaacttcaggagtggctgttgtaaagttcttctaaggctcataaaaccgggttatgcgcttccacagttttgatattgctcaaacatttcatcaaaagaacgtgaatatcatcagtgctacattttaatttgatttttaggaactttcatttttaactttccttccatgacccctgatcttttatttgaaagtatgggaacacttgacccattgttcctcttcacattggatcagagaatacaaaagttaaactcttacacactgctatagataagagagagtttaaatgttagttatagaataagaaccttaacgcttttgtgattatataaaaataaaagctagcatttgctgaacatatgtactgtttcaaacattacattgacttatgactcactgtttacgttcattgcatcacatactctttatgacaatcctgtgaaatagttgctcttttcttaacttttatttcaggatcggggtacacatgcaggtttgttatacaggtaagttgcatgtcacaggggtttggtatacagatcatttcatcacctaggtaataaacatagtacccaatgggtcacttattattatccacacgtattaatacttagaagaaacctgaggcgcagggaaattaaataaccatttaaggtaagagtcaggaatcaaaccctagtttctctacacgaaagtatgctttaaaaaactctactgtgttatgaaataatatgtgcccatgtgaaagaaatatatagacaaaattaatctaggatggaaaatatcacagtggtggttgcctctgggtggggggattgagactgacctggagggagcatgagagaactttccagggtaattgaagcctcctatcttaaccagcacatagttatatatagattgtaagagtatatgcatttgtcaaaacatattcggtggtaacacttaagatcaatgtaatgttgttcccctcttaacttatggatactaggcttaatatatgggtgatgacataatctgtaaataaacctctataatacaggtttacctatgtaacacacctgcacgtatatccctgaacttaaaatacatgttttttaaaaagatcaatgtatggaccaaaggcaaattatacaggcacaccttcccaggtgtgctatcctcccacctctgtttttagtcatagaatctgaatggaagcagccactgccctcatcctgatccccaaaccacgtgagagttcaaacgttgtgcacaagacccagtccagccagtaagaatccttaccaagaacttttattaaaacattgccatcggccgggcgcggtggctcacgcctgtaatcccagcactttgggaggccgaggcgggcagatcacgaggtcaggagatggagaccatcctggctaacacggtgaaaccccgtctctactaaaaatacaaaaaattagccgggcgtggtggcgggcgcccgtagtcccagctactcgggaggctgaggcaggagaatggcgtgaacctgagaggcggagcttgcagtgagctgagatcgcgccactgcactccagcctgggtgacagagtgagactctgtctcaaaaacaaaaacaaaaacaaaaacaaacaaacaaaaaaaattgccatcaaggttaaaataaataaacgaaaaaataaaaatatatatatttcttttttttcccctgtggtgagaaatctgtaaggacatgagtactacttgctgacaaccaagtcctccacttttggagaaggtagtctaacacttcaaatgtggctaattcaactaatgaacttttatttaattttaattaatttaaatttaaatagccacacatggctagtagctaacacacggaatggcaaagctttgggagaatgagtcagatatccacagggtgtaagacataagtaataagaagaaagagccctgatggaactggatctctctggaagggcagctccacccctgcccttcttgtaatctggagatgtaagtgtattagtccattttcacgcattataaagacactatctgagactatataatttatagaggaaagagatttaatggactcacaggtccacatggttggggaggcctcaggaaacttaacaatcatggcagaaggcaaaagagacgccaggaccttcttcgcagggtgacaggaaagacagaaaagttcaggggaaattgccatttataagaccatcagatctcacgagaagtcactcactatcatgagaacagcatgatcataaatcacctcccaccaggtccctccctccacacgtggagattatggggattacaatttgagatgagatttgagtggagacatagccaaaccatatcagtaagctaatgaatacacatgccttcatctctgcaaatgattcccctccagaatattaccctttaaagttacgattaataacataaaaatctttataatgctgtttgtaaaaagcataaaatgcaaatgtgtgggctgaggtaacacttcactataactaagtttccatttatctaacaaataattagtagataaacccaaatggctaattattgtaaacttttccatcttcataaaaatggaagataatataaatagacgaacagcactagcaccttcagggcaccaagaagacaggaggctgaggcttggaaagaacaatcttcacaactttttctaggattggttgtgttaattttcaaaagtctcaggtaaatgagatgggtctggagcaatacctttgcatgatttatgtgattttttttacacttgaattacttcaaggagctttccaaagaatgttttaacatactgtgaccaataatgtcagagctgatggcagcatctgtgattatacttttgaattctggctggtagtgtcagatttgtagactgacattattatttttataatagaagttataagaacacaactctaaagattatggctcatagaattttagaggtggaagaggcccttagagaacatctagtacagccccttaattttacagatgaagaaacaaaagcccaggagaggcaaactgagttgccacaggtgatgacacctaattactgatcgagctgacactaaatccagttctcctaatccccaaagcttgctgtcagtgagccaatcccaatacatcataccattctgacttttgccttttcaaatgatgtcttaattaccgttgatatattttataattttgtaggagctgacaaatttgtcaggacaaaatttcatataatgtgatatattttgtgactttggcgtcaaggaatgcttgtataagatgtttgcccttcatgaaaatcttgaagtattggggaatgcatgctaaaaaaaaaaatcactagttttcaatgaaattttccagctaggtctaatatcaatgtatgcaaaattatcttaaaattgtctgtatttgccacctatatcatcatttacagtatgatagttgcaggaaggacacaagctcagatttgggtagaccaggttcaagtcagccacagcaacttcttaactgttcaggctttgtttgttcttgtgaaaaagagattaaaattgtactagtatagaaagcacctggtattatagtttgtcctatagagataataaatatatagtaaaacttaatgaattggattatacactagaacattttcacatttgaactaatagtgtgattgttatgtaataaatgtggttaataaaatattgatacagtataaaatatataatatctgattaatactaatataattctgttacacaaaaacttttaaaacgttatgaatgaaaaaaattagttataagcatttgagaagattttgcctgggatttggaattattggaaacctagtagatccatcttcttgcagacctagaatagaaacactttggaactgaaaagagaacaagagataaaattttgttgcactgctttctgttcaccttcctcctgacccttcaaatatttcatcccacccagtctgaggcctatgcccaaagtttgattatacattgttattagataatgtttgtgcctatcatcactgagaagtacttccagagtccagagtcgtcttcacttgcattataccacaggttggtccttaatccgtgtgagaatgaatctgcatgagttgaatcactccatttctgaatggaccctgcaggtcctcttcccacaaccatgaacaactttaggatattgtcacttttgtaacttttttctttcccacatcctcacaatatcctccctttgtgtccttcccaataatgctcacacatgattcaataactgcaacaatttatactgaaggctatatatgcaacaatatatactgcaacaatatatactgaaggatatactgaatttatacagaaggatatacgtataaatatacgtttaaatatacttttaaatatacttatatttaaacaatatatattgcaacaatagatactgaaggatatactgaatttatacagaaggatatacatatccactgcttcagatccttgtcttaaaccaatctggagatattcaaattattgataaccctccagacctggaatctgaagctgtagacctgaagattagcctgatatatttattttcccaatatttataatcaatcagataaagagtccgatattttctgggtaaaatcctaggtaaaatatcaaataaaattcactggaagtactcattatatagcagattactgaatgactaaaaaacctaatagagaattctgttgtgagagcacttctaacataaatttattttataatggcaaatttcattagaattcagaaaatgtaatgtctattcaggactgtttacttcttaacatattaaagacaaactatattttgctaggtgaacaagtatttttcttaagtcaatacaaaggattggaaaattaaattttcattgcattcaaggaaaagacaatgaggttcctatcatttatgtatcctcagtgcctagcatggtagcagcacatcactaattcacaagtgtttgtgaaaggaaggagggaggacaaaagagaaaaggaaggaagaaggtttgttacagcatgtcaagaaggtggaaatagaacttagattcaagactctggtttttgatttccctttgaaatacccattttttaaaaatgcttatgttacctagaagtggtaattactaagtcattcattctagcaagaaacatctgagctgctactatgtgcagacacctctggggatacaatacaggtgaaacacaagccactgccctccagatatccacaggctgacaagagaaaggatactttgtacatttctgtaaactgctatcaagaacatagtaatgtcctgtagcccaatgatggaaggaggctggaaaatggcaagagagcaaataaatttggagaataattgcttgagcaaaatttgaacacttaagagaaaatcaatggtcagatatgttaaaaagatggaattcctggtagagaggatggcaaatgaaaggattggggcatgaaactgtggtgaaatttccctaaacattcagttagtttggtatgactaaagcatagtgtgtgtgtgtgtgtgtgtgtgtgtgtgtgtgtgcgtgcacatgtatgtaggtatatgtgcatgtgtatgcatacatggatgtatagaacatagggtaggggtgggaaaaggtaaattttttttttttttttgagacggagtctcgcttgtcgcccaggctggagtgcagtggtgtgatctcagctcaatgcaagctctgcctcccaggttcatgccattcttctgcctcagcctcccaagtagctgggactacaggcgcccgccaccacgcccagctaatttttttatattttttttagtagagacggggttttaccatgttagccaggatggtctcgatctcctgacctcatgatccgcccgcctcggcctcccaaagtgctgggattacaggcatgagccaccgcacctggccaggaaaaggtaaattttttaagatgacagtgaggacacttggtcaagatgaaacaatagtaagatcagggactatgtatgatgcctatatgtgccaggcactgttgtaatcattttatacacactaacttattcaatgaacacatagacacaaacccacacacctttgagctatatcccattgtgatcatcctgaggtacacagaaagtgctttgttcttgtcacagagctaggaagcagcagaggcaagagttgaaactagccagtctgtagagactcgcatatttcatgccaagatgtttggacaagagaggaactgaagcatgctaataacgtgattaatatccctagattctgactaagtttgtggaagttatttataaggaggaaagctggagaaccaaggcaacaggtcttcttggggtcagatgcagtagctcaagatagcagaaagaggtcagtgaagagactttgatctagaacactgagacctggtcactagcttcagtaagagtggacatggggaggactcactgtcacccttctgtctagtttaggtgaatgagtgagaatgaggagtttgatttccttagtgaacctccataggaagtgtctggcacacagctggaatgcataagatacagctctggcaatcttgactctagacaaacatggagttactatcttcttaactggaataggtagaaatataggacaaataccactgtcaagcttcccgcttttcacttttatttgttattataatgtagctatggaagatatgcaaagaaggaaaataaagtaacctccacaccaaagtattattattaataaaaaataaacacctagctcttatcctaaagaggttattaccaagtggtgagaaatagttataaagtataataagtacatataagccttaaatttccaaacagatttgcataatttagcatagcttgtgggtaatgatgatgataaaatcactaaacatctgctaagcatttaaacaacattttccttccgttagcatcagttgctggaaaataacatactttggctcaaattgtcctgttaaaaatatagtttggggccagcagaattttattcatgcttttatatggagtctccacttttttctgtaaatgtatttatagccaaaagctttcaccagttaggaaatgcagcagatgccaataagtacattcattattttgattatggcaatgtcagactttcagaaaacttcctccatctctatctgtagcacaacctcacatagggagggaccatgtgctggtcaggaaataaacagctttctggcaggagttaaatgaaaatactgtttattactcttataagatgttataattgacggttttattgtaatacaatagcgattatgacatgttgtcccaaaccctaattttgttgttttgtagcaagttacgtttttatcaaggaacacagtggtttaaaaaaaaaaaaaacccaaaaaactaagatttggggccgggcgcgatggcttacacctgtaatcccagcactttgggaggccgaggcgggcggatcatgaggtcaggagattgagactatcctggctaacacggggaaaccccgtctctacaaaaaatacaaaaaaaaaaaaagtagtaataataaaagtagccgggcttggtggtgggcgcctgtagtcccagctactcaggaggctgaggcaggagaatggcgtgaacccgggaggcggagcttgcagtgagctgagatcgcgccactgcactccagcctgggtgacagagcgaaactccgtctcaaaaacaaacaaacaaacaacagcaacaaaaacgaagatttggataattcatgtgtcttttgttttgatctcagaatttcctcattaacagatgtgaaataatttaccaagtttttcttcaaattgactaggcctgtataaaataacagaaatgccctttgcagtgaaagcactttgtattagggattgatcactcaattacattctggatgagaagaaaaaaaaaatcctattggtgtttttatgtgattacatttagggagaaaaagtttggaaagctaagaatcttttgtgggaagacaaaaagaaagagcttttaaggggcactttgaatacagagagtgactttagatagctagcaatgctgtttaaaagttacatcatggctttaagcaaaatcaacagcagtgaaacaaactgaacaagcagaaaaaaatataactcgaaacactgatgagtagtagtttttgaaagtgaattcatccaataaactacatcaaataaaggcaaataaagacaatctaagcttcattcacaaagtacatagagaaaaatgcttgaaaatatatcacatccaggaagaattttttaaactgacaggtgaagttattttactatatataaattctttaaggtggcagatatcttgtcaaatgaccacccttacaggaggacagtcaacttgattctaattaataaacaaagttttagtggaaatcctagaacacgtagattcatgagactcagcattcaacttggaaacccgcagaaactgtgtatctaagccactctaaccaaatagaagaaaaccttctacatattatgtgccagggagacgttaggcattagcagtgcacagacagtcatggttcaggctttgacgctgatgacaactggtggaatgtgtgttatctaccctgttattgtactaacctatcctctatcctcatcacacagtatgagaactacagtagcttgtcttctgcctaaaatctcctaccacttccacagtcatttaatctgccagctcactgttatgctggtatttttaagaaataatttcatataattagtctctttctggatgaaacactgctaaggtgtttattactaacctaaattcagtccttttcagctctttcactctttgtaatccaattccattctttgcagccagtattcatttctgcttgttctgaaatctatcccatcacttaggatttggaaactagcagacatgaagattggctacaaagaatgtaactagatttttaaacagatttagctctaatcccatttcttagaacaattcccaacttgaaacaggaaatatctagatggtttcactgtccgattctgtggtgacccaacctcttagcactcagattctgcctcggccctactgagattactagtcttacccaacatacaacttccttccacatctaccaggttgaggaatgaagcaaattatgtgaaataggagaaatacttttagaggaagcttgagtattggtgtattgggataatttatatgggatggtaaagttagagggtagatgatggcacttcattacatctgcaaaattttaaaaaaaattatcctagggctaggcatggtggcttacacctctaatcctagcactttgggaggctgaggtgggaggatccgttgagcccaggagttcaagaccagcctgggctatatagtgagaccccaagtctacaaaaaatacaaaaattgaccaggcatggtggtgcacacttgtagacccaggtactctggaggctgaggtggaaaggattgcttgagcacaggaggttgagactgcagtgagtcaagatcatgtcactgcactccagcctgggagacagagtgagaccttgagactttgcatcagaaacaaaacaaaacaaaacaaataaacaaacaaacacgttctggaagtagtatgaatggtaggttgagagatgagggtaaattcaattgagaaagggatgcaaatgagaacataattattagtaatctaaaagagaaatggtgaggggaaatttttaattaagataaagtaaaataatggtgaaatcatgaatttttttattttgtatttcatttttaaaaatcataaccacatgtacacttcattactttaagaaatgttacttttgaaagaaaaaatagtcatatccattgactctcaaatattcttatgagttatttatactaaatgaatgaaaaaggcagagaatacaactatgtataaaatatgagcccaattttttaagacacacttatgtatagataggcatagagagacagatgggttaagagatattaagagaggaatgatgagagaatagaaaaaaactttaggggctgggtgtggtggctcacgcctgtattcccagctctttgggaggccaaggagggtggatcacttgaggtcaggacttcgagaccagcctgaacgatatagtaaaaccctgtctctactaaaaatacaaaattatctgggtgtggtggcatgcatctgtagtcccagctgctggggaggctgagacagcagaattgcttgaacccaggacgtggaggctgcagtgagctgagattgtgccactgcactccagcctgggcaacagagtgagactctgtctcaaacaaaaaaaaaaaaaaaaaaaaagaaaaagaaaaaaatctttaaggagatatgcataaatatttcattggttgactctagttattgacactataactgatttgcatcttctttcttgcactttcctaatttagaaaattcaattaatatttctttaataaagagaacattgagtgtatctaaaagtatgtcaattggtgagtaatgaaagaaagtgtcaataaaaataaccggaagagtgcagagaacaggtgtagaaatatcaaaaaggacaagctgacaaaagttttgattggtggttcagggataatagagagagggagaaggcaggcatccatgataatttacattttcagctgcatgttatgcatggctgttgatggaatcagcagtgcagaaggctcagcataaataaataggaggtgagaattgttccaagtgaaggagaggttggctgtgggaacattcggtctcaaagcagaggaatattttaacactgacatactttcaaattgctacccatggtaacagttaaaagcaacttcactgtatttggttttgttattattattataaacttccacttcctacaaagcatgcactccatctttgcacctgaaaggagttgttttcactgctgccctctaccttggttcatgactgggagaaaagagctgaaattctacaggattcattttgagagagagaattcaaagcactatagcgttatagctgcaaatatccaagcgatatttggggataagtgtgtgacactgaggagaaatagagtttgaagataatagtttaaatctttgtttagtagtaaacactttcattagtggcctaaacaccttgtttagtagtaaacactttcactagttgcctaaatgaaactctcaacagcataactttctagctgcataatttcggcaagtcccttaatctcactggacctcagtcttctcatatgttacataaagacgataacagtataaattctgtagagttgtataaaagttaaatgaatgaatagatgacaacagcttagaacatggctttagcagattgtaaatactatgtaaatattggatattttattttcagtatatgtatatattctttctacagagcaagctctttatgcattaatagtaatcttgctaaaaatccaaatctattcagaatgagtactacagaatttttcttatagaaatattaccaacattaactcctctcttagataaatgtgattcacatttcatctctttatgcaatttccttattgttttatcattttcctattgctctattctataaataatgaatacagcattttaatgattcttgtaaatagagaccacattttttaaccattgagcatacggacaaattttattcataatattttatttctttcattgtacttgagattaatagcacaatttctcatccacaaagtttattataggttgtaaaaatgaacatgatctctcttctgattggctcagaaaagaagtttaatcttatgtaattatctttcgaatcacacatgcatcagtacaatcaagctctctatctattagatcactgaaccgtttcacatgagtttacagattaatattcatataaaactatatatctttcagcatatctcctcttggtaggttttcttaaagaaaaacaaaaaagagtagcaaattggaaccttggatatggaagaactgcttaaaaaatattcaatgaattgccatcgggtcactttttccccttataaataaaaagttggggtataaaagcagaaatatcattataaaagaactggaatgtcagaaaacactaagaacattctgtttcagtggtatacaaacttgtttgtccttttaagccatgaaactttttctttaaacaaaatttcttcaaaggtctaattcttaaaatagataaactactgtgaagggcagatgctacgaggacaccccatgacccaactcccaaagcctttctttgtaatctctctgctccaggtagtggtttgaataaggacggcctaatccaaacattgccttttagagagaccttgagaagcagtgatgtagcctaggttacaaggtaatccagtaaaatgtatccatgagttccatgcgctgacagagaatgcattgttacattaattttttttttatatcatcccaactatggaaacttcagttgccaaatgctactgctacataatgtattcatcttttggtagtaaacttctctgctccagtttatttttcagcctatgaagttttttgttttttttttcttattaaaaaaatctcaatttagaaataaaaatgagacaagcacagtcaaaatttaaattagcttggtttcagttcctattattaaagagatttttaaaatatcctacttttgaacatctttgctgccatccttcatttctctcacaagggaaatataattcagcagagtcaatcgtgactgttttgaatatggtttactaaattcacaaacaaaaagtgtctctgatagtcaacacaaatatataaacaagcattgagtaaacggcaagaaggataaaaggcatttttccaaatgaagacttccattgaaaagaagaaattcaatgaaccttccttaaaacatatgaaacattctattgaattttgatctaataaaaaattgtattaaatttgctgtattagaactgttacacacttgagatcaaaaaagaaaacaaaaaatgccctaactataggtagggacattgtaggactaatggaagtgagtatataagtccacttggcaccagagatttttttctaatgtggaagtgtcaaaagaattctgctccacttcaaagcagtgcctggcaggaacaggaaagcataaatgtcactgaacaaacttagagacaagcacttccttcactgaagagaaacctgatatctttctagaaattctagtatgctgatacaaaatgctagacactatctaatttcattcctccatattaatcagcaccttaatgtatgttgcagtttatagacagtaaatatactttaatattttctttctttgcatgggtaaagaataaagaatgcaagtcaatagaaaagaaaaattttaaaataattgtagtaattggctataactggtgagtatagcttggctttggagtgatgtagccctatctttgaatgctggctccactatttgttatctatagaaatagacaggtcatagaaagcatttcccatctggcaatgtacttgtgaagattaattaaaagttaatctattggccgggcacggtggctcatgcctgtaatcccaacactttgggaggccgaggcaggtggaccgcttgagtcaggagtttgagaccagcctggccagcatggtgaaaccctgtctctactaacaatacaaaaaatagccaaccatggtggcaggtgcctgtaatcccagctatttgggaggctgaggcatgagaattgcttgaactcaggaggcagaggttgcagtgagctgagatcgtgccactgcactccaacctgggcaacagagcgagactttgtctcaaaataaataaataaataaataaataaaaagttaatatatttaatatagcttgaagaacctagaataatacctggaaccttataagcattcattaattggcagctagtgagtcctttaagctctatgattgcaggaaatatacattcactaggattacctcaagtaatggggaaatgtttttggaaaatagatatggatcaagtaagttaggagttctgaccctgcaacatggaaatagggcacacccaggtcccagttcagaaacaaggtaaagctatagtggtactcttggccacatctccttagtaagacgcaggagtgaacctgttttccttcagtattgtgactagctctactctacttctgcatcaatcagtcctgttcgcagcaactagtcacctcctcctttgtttaatgttcatcatctttaaacatcgacctgcttatagtatccacttactcccatgtctgctgacttatagaaaagcaaggtacaggtatgtgaatgtagaatgagcataaaatataattaaattaaagcgtaatcagcagaaactctgtgcttttgcatagtaatcctaccagtgaatgattctttctttgtatcctattttgacccatcaagacaaattttattggtctaattaataactaagatcccttctgagcaaagctcttctgtgagactacatacagaccagtctataattgctctgatgaagtgcatccgggaatagggtgaggattggtttctcgtggcacctatcgcagccatttatcctggaagaattccctggaaaggaactgcacatgtggcacacacttttagacttagcatttctatacttctcttgtccatttgtgcagaaaggtggagagataattcagaaagagagctagtttaaagctagaataaaccatgcaaacacattttttttctaatttttgcaaattttctccaatatcctgaaggttaaacagaggttattctgttctgttttctatacccatgctaaggttcaagaaactataaaagaggctggctgactatctctcaaaaggcttcctaggagaggttttccatggccctgggtctggacttcacctagaaggatttaaatctgagttgattaacaagatgatatccttcatggaaaaactcacaggggcaaagctcaaaataagcttgttatgtatataaaaaagacaatttatcaatttagaaaagatgccctgaatgcctgtatgtgtatgtgtgtttgtgtaattttatatattaaataatatataattttaattgacagataaattgcatgtatttatcagcctatatttttcatgacatagtttttcctctggaaaaggtaagtagaaatctaaattaaaagctgtatattgctcaatgaatttgaaattgagaaatgtgtgtagttcaaatattttgtctagctacctatagggatatgcttggcctaaaaaaatctttgagccagagattctcctcatttggagtgagactaggtatcctccatattagcctataagaatctattgtttttttggtttctgctgtggaacacttctcctgttgggacattctgcattatttatattagtacatcaaatcaaggtatagacttgtttgaaaactattctatctctctaataaccctatacacttattcattcattcattcaaaaacttacttactctgcacttattatgtgcctgacaccttaggcacataataagtgacaaaaacaatgtcaaagacattgacatttgacgttgacaaaaacaatgtcaaagacattgacatttgacgttgacaaaaacaatgtcaaagacattgggggatacaagagtgaatatggaaagcaatgtctttttcttacttggcccttaggctccagttaaggtagagagacaaaaacccatttaattattccatctctcactctattgcataatctcaatctattggaatgtaatccgtttagggattatatgttatagaacataatctacatgttagagtatacaatcccaattgatcctgcaaacatttctagaaaaaatcctatcaaatgagtaataaagtgttctaagcactaactagaaatgtattcaggtgaaaaagaaaaatccaaaaaaaagtgtttttttttattatggtttacttgagaatagaacttaagataggaacatttatcacagatttgactcttccataaaggattgatcaaagagcttaattctcagaaggtaacttaattcaccttgcgatgaggtcaacatgactatttacctcataagcaacttgaattttcatagtataattagccagtggtttttcaagtctaaagaacagcctttgccatgctaaaacatgatgaagcagtgactcactacagaagacaagccttttcagaatatactctgtgactcttttttttttattattatactttaagttttagggtacatgtgcacaatgtgcacgttagttacatatgtatacatgtgccatgctagtgtgctgcacccattaactcgtcatttagcattaggtatatctcctaaagctatccctcccccttccccccacaccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaagcacaggaactcatcattttttatggctgcatagtattccatggtgtatatgtgccacattttcttcatccagtctatcattgttggacatttgggttggttccaagtctttgctattgtgaatagtgctgcaataaacatacgtgtgcatgtgtctttatagcagcatgatttatagtcctttgggaatatacccagtaatgggatggctgggtcaaatggtatttctagttctagatccctgaggaatcgccacactgacttccacaagggttgaactagtttacagtcccaccaacagtgtaaaagtgttcctatttctccacatcttctccagcacctgttgtttcctgactttttaatgattgccattctaactggtgtgagatggtatctcattgtggttttgatttgcatttctctgatggccagtgatggtgagcattttctcatgtgttttttggctgcataaatatcttcttttgagaagtatctgttcatgtccttcgcccactttttgatggggttgtttttttcttgtaaatttgtttgagttcattgtatattctggatattagccctttgtcagatgagtaggttgcaaaaattttctcccattgtgtaggttgcctgttcactctgatggtagtttgttttgctgtgcagaagctttttagtttaattagatcccatttgtcaattttggcttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattatctttgaactgaaaattcacatcttaatttgcacagagtattctgaaatatcaaatgtatacctatattggaaactttaccaggtagcactgccacattcagtttttacataagaaactgagcattttagcatatgagttgggaagtcaattgtcctgcttgatttcctatttggcatgtctgtgataatattgaaattgcttaatgattttatttattccttggagaggtggatccgtacacaataagcatttgcaaacacctgggacaaagtatggacctctgtcagcatagtctgtttataggcctaggaaagtatgaacagagagttgagaaggaagaggcaaaggcatgttattttactgagacacaatgaaatggctgtacatagaaaatacatcttaagatatcagagataaaagctataaaaggggcaggaagaacaaaatgtaaaaattagatagtttcacttatttttcctttctacatccttttttttttttaattgggaatcttagattggtgggttttgggggagggtggagttccttttctgaggtcctttattttctgcttgagtgcctgaaaatagatgcaagacagagaatgtctccactgactctcacggtggctgtttattcagagtgcagccttcatttggctctcctggaagctggctgtgagacaaggaatccaggccaagttctttatttggcagggaagtggagatgtagatagaaaagaaaaggcaactaataacacattatcaagtcagttaccagtacaggtagctgtagcttaatcccactgggaaactgagaacccttagaaaagtttgccatcagcatcatcttctctggggcataagggatctggggttcttataccccttttccccaagtggtcatgatctctcttgtacttccagcctgtggtgttttcaggtgcacaggccgtggctgcgtgagaaaactctcagcccgttggaagtcaggagtgcaccacagtgaaaagggctatgggggcagagatggatagagcatgacagttctgctgtaagtggcccaagttgaagggagctgttctcccgtctgcctttttgccttcttataaaaaccaaattagcaaagacattgatacatagacttgtcttataaccaattatggacttatattaattacccatcaatattctctgatccatagtacatatggaaatgtgtgtgtgtgtgtgtgtgtgtgtgtgcgcgcgtatttgtaaaatgccattatccctggtattctatattagcctaagcttaaaattcagtccttgtactgttactttttactgtacatctgtgacaaaattaatactgccatatgatgggtgcctaacaccacccactgcttttaaattatattctcattttttgttattcaatgatggttcaactatttcaccaagaattaaatagaagtaagagtcaaaatgaccaggatattttctctaataccgctgtgtactattaaaaaaataattaagatttctttattcatatcaattatgagttgatgcactgaatgatgtaatatttattcatgttaacagtggaaaatgtgagtgggaacagctttcatatggaatgcttttcttgtactttagaagtaaataaataattaaataaataagagttctaatttatgggaaaattgtcttatatgagttgattttctaagcctttgttttaccagcctgaaagaggaatgctacacagtcatattttaatggctttgtttattcttttagaaaaagtatcaacatgacatcatctgaggctaggttgtgctgcatactaataaaaacctgagaaatgtatgtttgacttctgatgtaaaggttttctttttaatatagacttaataacaatttcatacttaaccgatgagagcagcaaattaatcaaacaaatcgaacattttcttctccagggaactggggaagcttctgatcccttgatatgattatatctatatatcaaattccatactaatgacccccaagagagatggctttatcaataagattgtaagttattaattaattaattagtctcctggaaattctactgtgtgattttctgtttttacctcacaggagggagttctgagttaccttgcttcttcagagggttagatttttcatgtttcagggttgaacaatgaggtgtaggcaagagctcaagatagcatttgaggggcttcgtttctgtattttagactattaagctaacttctataaagggaaagtactaacgttgatatttagagaaaaacacggggggagctaaaacaagacagagaaagacaatttgatgcccttaggatggggtgatgacaacaggtttgttccaacatagcagccatccacatagctgtaccagaagcaggaccttggcagggaagttctgtggccttgtgtgactttaaccctgggaacccggcaaagatttctgtaggcagagttgatacaaaagggaatgttctcaaagtagccaccactttaaatgaataaatagcacctcagtagaagaccactggccagtgttctgtccaaattcacacatggaggcaaaggtagccatacaaagtgatgaatactgagtttcttgctaatttcattgaatgggtagcttgaaacaattactttgatttagaaaaaataatgagatctgacatactttgcattgcgtcttcagtttttctgatcaatccgtaagttacatgatcttcacatacaaactaagaccattcacataaaagagagaaaaggagtaattatttttgctttcttagcaagtgcctagaatagcattttccggtgcatgcactggggacaatcagggccataaatttctgatatgaaatacatttaagaaataccaatatgagggcaatggaaatttccggtgcaagcactggggacaatcagggccataaatttctgatatgaaatacatttaagaaataccaatatgagggcaatggaaatttctttggtaatttgcaaaacatattaacatattaaaggttctgaagtaacccttgttactagtttaactttctttaacccagaattgcccaaacttacttgagcataaaagtgttttaacacttctgagaaatatcctttcagataccagatggctagataaaaataaatagttgttctacattgtaatagcatctattacagtttcaaatctaaatatctgtctttgttccaaaagcaagcttatgtatatgattgtttttattttctatgtagactcacaaaaggagagacatagaaaatttaactctacactatcattcccccagattcaactctggcatgataaagatcctagagtgtattacaaagaggtcacccttataatatggtaaatgcatatcttctgctataaatattttcataaagctcttctcttagtcaaggattgagagtacaactggccgtctttaggaaataggaatcaggaacgaatggttgttgctcaaaagcataacatttaagtgggttaacagagcacttatatgaatgagcaagaagataattgtgctattacacacagttttacgaccattaaaatacctgttctaatttggcatcagatacgtgagcacaatgtgaagagcctgaggttggaatgagagcaggaaaaatgtccgaagtttggacagggagcaaagaaattgagaaaattatagaattgaagagaaaaccatggtgaggcacaaaaaagctgtataattatatgaatgatattaggtggttggcaataagcaattattaatattttcttttatgagtgaggaaaaaaaaagtatggtcataacagagggaatgcaattcgagcataagaagaaacacgagagtattatgctgtagtagtccagtctcactctgctatgaagaaatacctatgactgggtaattcatacaggaaagaggcaaaactgactcacagttgagcatggctggggaggcctcaggaaacttgcaatcatggcggaaggcaaaggggaggcaaggcaccttcttcacaaggcggcaggaagaagtgaatgcaggaggaactaccaaacacaaaaccatcagatcttgtgagaactcactcactatcacaagaacagcatgggggaaaccacgcccatgattcaattacctccacctggtctctcccttgacaggtgaggattgtggggattacaattcaagatgagattttgggtggggacacagccaaactatatcacatgctaaagcagccaataatatctctaggaaaatgttgtagtttagggtagatatgtgtttggaacaatttagattcaaaactcacagaattgtgagtagcaacaatgattactcttaaattagtaatgctggaatataggtaattttaattgtgtgttctattctgtggtgccagtggcattttcccccctgatgttatttttctgcagctccggctttgtacataaatggataatagtgctccttggtgatctattttcaagtcaaaattctttcttattttctgctgaggtttagcattccgtggataaaaagcaaagtttttcattccacagcaaaatataatggttaaaataccaacagctttacaggaaagaggaccagcctaataaccctgaaatagtcgcagttagtgaacccttaggcacagttttctcagtaaaaaaataatgtgatagttgataggataacctggagaatcccactaagtgctgatgtatagacactgtttcaatcttctcacattcatctgacttccctccagcctacctcagtgctgtgttatcctgtgtatggacagattgcatgtcagattcctaattttcaaatcaattttcaaattaataatttaataataatgtcttatacttatgtatatttcaaatcaaccctggtaaatctgatacttgtgttttatagtcaaagttgagcattttatgaatgcaccttgtaaatatcacatatcaggcaagcactagaaaaccaaatcacaaactgaaccaggttatcttccaacatttgccaaaatgagatgcaacacatctgagggaaatatgtattaatctttcttgtaagttatctgaattggtttaatggaaataaaattttaaaaactaaaatatattataaattctcatggatctgtctacattggtttataatttattttttcattagatttataaaggggcaatgtaaaaattaacatcagaatatcttatataacccattttatccattgtaataaagtttattgaacacctgctatgtataacttttgttttatttccttttaaataatagaaactgtattaactattgggtttcacattttcctttggcttccatgaagctcctgcctaaattttttgctcaggcacagaaatgaatttatctaggttaactggataacagtgcatcgacctctattttacttatagtagaattttatctacatattatttcctgttctgttttatatacctttagcagtgtaagctaccttaagcctttgcagaaatcaaatgaactataagtcatatatgaataaataaatgctaggtctaatatagaaaaattaataccttgaaataaaggtttattgagtcttttttcagagaagaagcattcctctaatgaaaaatattaatcagaaccatatttgctaattaataatttaatgataatgtcttatgcttatgtacattaaatatatttatatataaatgataataataatgcctcacacttatgtacattaaatgcatataatatataattatatatctatattatcacttctcacagtgaccttaggaggtagacattttttctcaaattaagtgtgaaaaattagaattcacaaattccaggatttgaactaaagacaactaattctacataaagtggttcatctgtaaaatttagtgtttagaactaatgtttgctatttgcatagggctgcagtatgaaagagtgttgggaaatgtcattagcccgttcttgctttgctataaatatctgagactgtgtaatttataaagaaaataggtttaattggctcatggctctgcacgctgtacaagtacggtgctggcatctgctcagcttctggggaggcctcagggagcttttactcatggcagaaggcaaagcaggagcttgaacatcacatggaaagagtaagagtaagggagaatgtggtgggggagtgccacacttttaaacaaccagatctcatgagagttcactcagtattgccaagatagcaccaagcgggtaatgctaaacattcatgagaaaactacccacatgatccactcagctcccatcaggccccacctccaatactggggatgacaattcaacatgagatttaggcagtgacacatatccaaactacatcaggaggtaaggcatttagatatatgtgtagacttcaaacctccttgctgtctcttcagtcctctaaaatgaggtgtgtctaaagaaacaaaagctttcatacagacctgtaccctagtggagatactgagtcatgttgacaaggattaaactagtctatataggccatcacataaaaataagctttatttagccagacaacagtaaccattgtgttcacaagaacacatacatacaagcatggctgtttgctcatagtaaaattttctttcctctagccatcaaattatcttgaaaatttgctgaactcttcactgtactaacttaaaaagaccatgcaagacttataataactcattgcatgaagatgcctaagtcattaatgtgacattttttttagaaagacagccttccacaaatctatttctaaatattagaggaaattgtgaaatatggttcagatatgatagagaatcatagcccatagttttttcctggtgtaataagacttgtaacattttcaagaaatcaagtttaaagtcaatccataactctaagaagaatcctacagcctccctaaaatttgaaattatatatatacctatacacacacacacacaaacacacacgcacacacacaaacatatatatatgaaaagactctattaagataaaaatactacctagaagcctaatggggaaaatatggttaagtttgctcacactgaattggaacaaaataggattgaaattttattccaccatttaaaaagcatatgacttgggaaaattacataacttcttcacatgtcaatttcttgagctataaaaagagttcaataatataatttatctcatgaggttgttgtgaggattaattgtgataaggcatgtgaaatgtttcactcattgtttttgtaagtattgagtaaaatcactgaactggtgataaaataccaggtataaaactgacaatctatccaaattgatttttgtcttaacacattcagggcagaagaaaatgagaaaaaataaaacaggccgggcgccgtggctcacacctgtaatcccagcactttgggaggctgaggcgggctgatcaagaggtcaggagttctagaccagcctggccaacatggtgaaaccccgtctctactaaaatacaaaaatattagccagacgtggtggcttgtgcctgtagtcccagctactcgggaggctaaggcaggggaatcgcttgaacccaggaggcagaggttgcagtgagccgagattgtgccactgcactccagcctggcaacagagtgagactctgtctcaaaaaaaaaaaaggagagaaaaagaaaaaacaaaaccaaaccctaaaaacatggatacccaaatagagtaaattaagaatctagagacattagttatctgaaaactattcagaaactctgcacaaacttttgatattggattgattaactttgataatgaccttatttttggagtaaagtgaacacaaatatcagtgtattagcccatcctaaaatattatttcataaaaaattaattcatcataaaataacactacatatcaccctgctttcattttcttaactacattatagaatgatagcacatttagaagatgatgtcatctttcaattaataaagatagttgtgcctcttagagaaaggtaataatttcaagaagctggatgagctgcaaatctacacaaatatttttaagaacatatatctatttaacaattttgtgctctctcaattttatttttgctgtttttagacatatggatgtttctatttttgaaattctttcttgtttttgtttgtgatttctgttttttagtcttcctccaccaaagctgtttagtaatctagtttttttccatttcattatttgattagttatatttgattattaatctatcaaaaattacttcttcagttgtgcaacgtggcgatcaaaattgattctcaagtaaatacctcaggttcctagtaccaattattgtctcatcttaatatttattccttagtttattatttctcctttatttatattaattatttatgtattgtacaatataactcctacatatataacaggttatatttttgcattgccatttctggttgattggtctgtctattcgtaggttaataccagaccattttattgattttattcttacatttccagatcttctcttttgggcaatactttctgatttgaaaggaagtagtgaaaaagttttacaaaacagagaggaggaacatgtgttgatcagtcacatggtttgtaaagcaaaatattggggtttgttgtatagtgtttacttattttaaatattaattttttctattcaaagaaaatatttaatggtgaaaatcatgaattttggatatagatgtgggttcgaatttgaactttgtaacttaatggttttttaatctctggtaaaatccattaaattctttcaagctccttcctctctgaatgggattattaatatgaatctcatcagtttagaatgagtcctaagtgagattacagaggaataaataaagcacagcttacttgtgattgtaagttcctgtcttcttatattaataagaaaaataaaacgaaatagtgctaaagtgttgggacagcgaaaatttttggagatggtatggagagataatgggcgatgtttctcagggctgcttcgagcgggattaggggcggtgtgggaacctagagtgggagagattaagctgaaggaagattttgtggtaaggggtgatattgtggggttgttagaaggaacatttgtaatttagaattattggtgatggcctggatacggttttgtatgaattgaaaaactaaatggaataagagaaggagaaaaacaggtataaaaggtctaagaattgggacgactcaggacatctgattagagagtgcctaaggaggttcagcatagtcctgccagcaaagattatttatttacttcaagagttaagagtggcagtttggggatagcaccaggaggtatcagctttgatgacttggagaaacagtgtaaaccggcagtgtaaacaagagcagggcatgcatgagtagttgagaacggtgaataggagtatgactagacacaagatagtaggaatgacaagttttttgggggcacagtctaagttgatctggtgtctggaatgagactggggcctaataaaaaggagcgtctatacaggagctcaaatggcctgtaccttgtagcattctgaggacaggtctgacttctgagaagggtaagtggtaaaagtattgtccagtcctttttaagttggtggctgagcttggtgaggtgtgtttttaaaagacctttagtccattctacttttcctgaagacggaggaccataaaggatataaaggtttcactgaatactaagagcctgaaaaactgcttggctgatttgactaataaaggctggtctgttatcagactgtatagaggtgggaaggctaaactgaggagttatgtctgacagaagggaagaaatgactgcggtggccttctcagaccctgtaggaaaggactctacctatccagtgaaagtgtctacctaggctaagaggtattttagttatctgactcggggcatgttgagtaaagctaatttgccagtcctgggtgggggcaaatcctcgagcttgatgtgtagggaagggagggggcctgaataatccctgaggagtagtagaatagcagatggaacactgagaagttatttccttgaggatagatttccatgatggaaaggaaatgagagcttctaagaggcgggctagtggcttgtactatagcatagcctgcctttgcttgtgtgtggcgattaggcctggtggaactgccatcaataaatcaagcgtgatcagggtgaggaacaggaaagaaggaaatatggggaaatggggtgaatgtcaggtggatcagagagatacagtcatgggggtcaggtgtggtatcaggaataatgtgggaggccagattgaagtccgggccaggaacaatggtaattgtgggacttaacaaagagtgagtacagctgaaggagccagggagcagaaagtatatgcgtcagctatgaggaagaaaatagattttggaagttatgagaaatgtagagagtaagttgagcatagtttgtgattttgagggcctctaaaagtattagggcggcagcagccgctgcacgcagacatgacggctaggctaaaacagtaagatccagttgtttgcgcagaaaggctacagggtgcagtcctggctcttgtgtaagaattctgaccacactaaccatgcctaggaaggaaaggagttgttgttttgtaagggattgaggtttgggagattaatcggatacgatcagcaaggaaagcacgtgtgtttttatgagaattatgccgagataggtaacagatgaggatgaagtttgggcttgactgaagtaatgggggctgtctgtgaagccttgcggcagtacagcccaggtaatttgctgagcctaatgggtatcagggtcagtccaagtgaaagcgaagagaggctgggatgacgggtgcaaaggaatagtaaagaaagcatgtttgagatccagaacagaataatggattgtggagggaggtattgaggataggagagaggatagggtttggcaccatgaggtggataggcaaaacaatttggttgataaggcatagatcctgaactaacttgtaaggcttgtctggttttaggacaggtaaaatgggggaattgtaaggagagtttataggctttaaaaggccatgctgtagcaggcaagtgatagcaggctttaatcctttcaaagcatgctatgggatgtgatattggcattgagtggggtaagggtgattaggttttaatgagatggtaaggggtgcatgatcggtcgccaaggagggagtagaagtatcttatacttgtgggttaaggtggggtaatacaagaggaggacgcaaaggaggctttggattgggaagaagggcagcaatgagatgtagctgtaatccaggaatagtcagggaagcagacaatttagttaaagtgtctcggcctaataagggaactgggcaggtggggataactaaaaggagtgcttaaaagagtattgtctaagttggcatgagagtgggggttttaagaggtttagaagcctggccgtcaatacccacaacagttatggaggcaagggaaacaggcccttgaaaagaaggtaatgtggagtgggtagcctcagtattgattaagaaggggacagacttaccctccactgtgagagttacccgaagctcggcgtccctgatggtctagggggcttccgaggcgatccgacagcatcagtcttcagccgctaagccaagaagatctgggaaggagtcagagagccttcggccagagttccaggggctctgggagtggctgccaggtgagttggacagtccgatttctagtggtgtcctgcacagatgggactcggcttaggaggaatcctgggctgcaggcattccttggcctggtggccagatttctggcacttgtagcaagctcctgggggaggaggttctggaggaacgcctggtcgctgcgtttcagatgtttggaagttcttgtgtgctggagatgtggctggggtttgtctcacagtggaggcaaggaattgcaacttttttctattattgtacacgttgaaggcgaggttaattaaatcctgttgtggggtttgagggccagaatttaatttttggagttgtatttaatgtcgggagcagactgggtaataaaatgtattttgagaataagacggccttttgacctttcagggtctagggctgtaaagtgtctcagggttgctgccaaacgagccatgaactgggctggatttttcatatttgatgaaagagcctaaacgcacactgatttgggagaggtctgataaggaaaaaggagcattaaccttgactatgcctttagcttcagccacctttttaagagtaaattgctgagcaggtgccggagggctagaggtggaacgaaactgtaagccggaccgggtgtgaggaggggaggtgataaaaggattatagggtggaggagtggaggctgaggaagaattgggacctagctcagcctggccaggaggggagaggtagaaaaggaagattagaaagactcagcgaagcttggggttgggactgaggggacaggtgggagggaaagaaggaagatttgggatgagttacattgggaacagagactagagatgcactgacatgtaaaagagtgcctggacatcaggcacctcagaccatttgcccattttacgacaataattatttagatcttgcaggatggaaaaattgaaagtgccattttctggctatttggaactactgtcgagtttgtattggggtcaagtggcattgcagaagaaaataagacgcttagattttaggtcaggtgagaggtgaagaggttttaagttcttaataacacaggctaaaggagaagaaggaggaatggagggtggatggttgcccatagtgaaggaggctagcccagagaaaagagtagagacacggagaagggttgggggttcttgccctccagaaaagcagagaaggggttggggcacagagatacgaggtcagggcacggaaataagggatcggggtgcagagatataagaggttggggcacggaaataagggatcggggcacagagatataagaggctggggcacggaaataagggatcggggcacagagatataagaggctggggcatggaaataaggggtcggggcacagagatataagaggctggggcacggaaataagggatcagggcgcagagatataagaggtccgggtgcggaaataagggatcgaggcgcagagatatgaggttggagtatttgcccctcctctagaaaagcaggacttgccgctcagggtgaaggagaaggggttgggggtttcttgccccccagaaaggcggagaagacacggagagaaggggttggggtacttgccctttccccagaaaagtgggacttgccgctaagggtgaaggaccaaggcaggcatccctgcgtggtctgacacctctgaaacctgggtgaataatcagggacgcatccctggaatgattaaacaccaggggaaggctgccttccctagtccatgaccagcgccggagttttgggtccagggataaaacgtgtctcctttgtctctaccagaaaatgaaaggaattgaaattaaaagaagggagagattgacgtgtggcgccaagattgaaaggagaaagaggttgagggatggtgagggaggttggagaagagagtaaaaaggggctgcttaccggattttaaattggtgagatgtttactgggctggtcggtctgaggacctgaggtcgtacgtggatctttctcacgagcaaagaacaggaggacaggggattgatctcccaagggaagtcccctgatccgagtcacggcaccaaatttcatgcgcctccgtgtgaagagaccaccaaacaggctttgtgtgagcaataaaagcttttaatcacctgggtgcaggcaggctgagtccgaaaagagagtcagtgaagggagaaaggggtggggccgttttacaggatttgggtaggtaaaggaaaattacagtcaaagggagggttgttccctggcggtcagagtgggggtcacaaggtactcagtgggggagcttttgagccaggatgagccaggagaaggaatttcacaaaacaatgtcatcagttaaggcaggaacaggccattttcacttcttttgtggtggaatgtcatcagttaaggcaggaaccggccatctggatgtgtacgtgcaggtcacaggggatatgatggcttagcttgggctcagaggcctgacagtaagtgttcagtaaatgtaattagtataattattaaaatattcatgattattattcctttaaaatattctagaaatcttcatgttatctaatctggaaaagaatttttctagctccattgctaaaaaaattcttcaaattcaaatttatttctgtatctcttaatagaaatgaggaaacgtatttcctcttcctgtaatagtagtctcagaacacgtgactgtcacttgtgtgtctctgtgagtgactgtgtggaaagaacttatctgactcactcacttctctgtgccttggctttgggtatatggctgcaagtctctgctaattactcctatgccactttcagcacaaatatcacttattatgtgctgcttgaatattattttctttatttctaagtttggtccattcagtcctctcatggcatgagttgcttttcttatttccacataagtatttgaaaacttgtcagaatgctattttcattagacacttttcattattacgctgtcatcactgaacaagtttatttcaaagccttttgagaaaaatgacagaaaacatagcattttatttccttggccgttcattagattagaaatgtcaagaaagacttagattatacttatttttattaaaaggaatgagagacttttcttgaaaaaaagaaaaaaagaaatttaaattttgaatgctacgtcttagggctctatgcagtgaaacattttctcttcattgtttagaaagacttacattttattttaaaattcctgcccgtctttttctcttgaagagataagatactctaatcattctagaacaccagctattaatctgaaattaaatctattacgtgccagaaacaaattaccccaaagttaacctaaaatatcatcagggtaacaccttcagttacaaattatagtaacatcttagataataaatttcagcagctattaaaagagagatgataatagtacctttgtctgaggcttcttatgataattgactttaaatatgtagagcatctaatactgcatgtgaggctgaattctatgaaattactaatactgaagcatttttggcctacagaaggaacggtttcatgtggttcaaccgaagtgttgctcgttaattttgagtttcccattcaccactgcactgacctttagccaggacagtacttactaattataatttaaaggtcgcatggatagagagcaaggcagacttgttacgacaaacctgtgtcttgtctatcttggtatggtggtgcctcagttagcacagggctttcactctcttactatggccagcttcacagtctctgtgacccttcaacctgtcccatgacttctgcttacccgtggccatggtgtctactgatggcatcactatgctcactgccttcacccatatgattctcatatgtgtaatttactagccagtatccagcaaggcctgctgtgtatgggagctggtgccatagaaagtgtggatgaggttatgtgtaggtatctctgctggtggtgggttgatgataaccatatttgacgcccttaaatttctaaaattaggagtcattgtattcattctagattgaggaggatagcatttaaatggggcttaagtatgccttgtaagtatgtaaaaagatataaaattaccatgcatactgtctttcaataacataacaagactgtagtttagtgagctcaaggtgacaaaatagccattattttcttactgtgagagtcattttgtttattgtttgcatgagtgacaatttttccaatgaaactttcttggttaatagaccctttcttatacataaatatgaaataagagggtgatagaaatcagatattatatctagtttttatgactagcagattacacagaataaaaacatcacaatgacacaaaacataatcttacacattagacaaaggcatacaactttaaaaaatattgcaatcaaaaagatgtaattaaattaccctgattcattgaaactttagcttttaaaaggttcatttttgtgggtataaataaattttgttatcttaattttatacaagttacaattatattattgttaatgacagataccaaatttaataatgtcaccttgttttatgttttataaaatttgcttcatttttccacctaagcagatatgctgtcaaaatgtggtgttacctgaaattttaaaatgcatctcttttccttgtgtaattttataataaaatagttaagaatgaagaattataaaaaagttaagaattttattttgaagactgatattctaagttgcatatagcaaagaagttacgaacttttatagtcaaggacctcataacacatgatagatgctaattttaattaaatttattatttcaactttgaaaaatggggtaggaggagagtatgaatcagaggatgaagtaactcacaatttaggctataggggccacatttttctaacttaatattccatgattatttccaaaggttacttaaatccaatatatgactcagagcttcagacttaacgtcatacattttcacataggttttaatttgtggagaaaggacatattctgatattattatagaaaagccattggattctatggtgtgataataagagatttcaggtctgggtcttctttatcagtcagcttttgtattgcaataacctacaatctcaattctcaaaggcttagagcaagatcatttgctttttgttcatctgaggactgccgggtgagtttgggttggctgggctcagtttcactgggcttttgattccaggagcccagagtgaagcagcagccactatcctgcagttttcaacgcagaggacataccaggggagacagaggctgagccaaatcaaataatcacattgaaaccttttgcttaatcataccaatgtcatggctgctcatattcattagccaaagcagccacatgacttggcagaagttcatagggttctgatgcttattcctcccatagaatgaacaggaattctcatataactataattgactatatcaaatcccattgctggaagtgggtgaatagctgggaatagtaatccactgtattacatatgccaccaaatgattcagcaactttccagtttcctactggacagagagaggcctgtctctctggaaagtcgctcctcctttatatgaccgccctgacagaccttgcacttgcaacttgactccctgctgaaaaccacttctactctgttttcggaaatacctgtagtgtcagtagacaaagtagaacaaaatgagaaaatagagagaggatgggatctgaaaactagtataagtcagggcaggaaaaaaggaagagtctgaaagcaagcttggagagctgactcttagaccagaatagaaaacattttcttcaaaatattcgccccttttcaaatgcagaattaggccagttatgttttaggatacccattgccttatattcttaaaaagaaaagaaaaagaaggaaaagaaagagataacacttaatagtccataacaaagtgtcaacgggatagacacatgcttattcaaaccacagatatgatccagttaatttccttcttaaaatgtgcccatagtgtcttattgcctcatcgtaatgataataatgagagcaacaattataatggcaaaagcaaggactcctgccatttactgtttgtgtattaaatgctccactctacactaaaagctttatgtacagtcttattcctcaaaataaatatgagaaaaacaactttaccaaactcacatagttaataaaagtatttttatgagccaccacaatactcaaaaatggtgcaatactgtgttttcatgaatttcacccaatctagctttcctgactcatctcttgccttcccctctgtgattgctaagtacagacacacagaagtgctgccatttcctcactatactctactatttcacgcctctgtgagtctgtatccatgaatttctccacttggaatggcttttctagccacactactcctttgccaacctaacaaattctgtttctcttctaatgactcttctagacgcagtcctctgccacctgctctaggaaggtatgccataggtagataagttgtctcctgcatttgcttgcagtctccacacactgcagcgatcacatacacctgcacataaaatgtctttgctatacatgcccattcctgggcccacacaagtcttccacccttcctcaggtgtgaataccttaagggtcttctttattcctattttattttatattccagtgtatgttctaacaagtaatcaagtgacttgaatggaaatctcaatagccaaactgagttgttgctgtacatttttaatatttaacagagagatggatctattggaggcagtcatctgagatgatcagatataatggccaatagcaactatgctaatcataaaatttaaaatgtaaaaaattgcttcgtcaaactgttttaaaagatgtatctaaaacatagtaggctgagcatggtgactcatgcctttaatcctagcacattgggaggccaaggtagcaggattgcttgaacctaggagtttgagatgagcctgagaaacatagtgcaaccctgtcactacaaaaaaaaaaaattaaaaattagctccatgtggtggcatgcacctgtagtcccagctatttgggaggctgacatgggaggatttcttgagcccaggaagtcgaggctgcagtgagctgtgatcatgccactgaactccagcctgggtgacagaacaagacactgactcataacaaaacagaacaaaacaaaaagcaaagtcaagatttggatgttcagtgtattcattgctacttgcacacacacacacacacacacacacacacacacaagcaaacacacacaatatagttttatcagaatacacatattctgatagcagaattgaaagcttacataactgtgcaagctttggattctgctattctctggtttactcatccccagttttccaatccatcaataaggatagcctcaattatctaataagcatttcatgtgtatttcaataaaataatgcattttaatgaaaaattcttagaatagttcttggcacatgccatatttaaatgtcgccactgcctcattcatacagatcgtacccaagtaaaagtgtatatatggagaataaaaatgaaaacaggaagtaagacagtaaatggaggaagtcatttagatttgatagcatggtttccaaaggcagtgtcctattagaagtgttcaggtaaataaaacgttattggcagagacagatggtaaagccattttagaaataaaaattaaccaggtaagcacatgccaattttgggaaaacaatttattgtacctttttttctggagcttatttcaatgtaaaagtactttaaaaacttagaaaatagggtacatattaggtaaaagagagtcttgcaaaaatggatccagcaaatattagtgaagagaaaaagatgatcagaactctgagtttcagtgatttgtcttgtaccatattcaagctgtaatcactgaaggtaggaaacaaaccagcaaaacatttgtaaggtgatggtatcatttaaaaaaaatagagaaacattacagacaacttaaattggaaacaaattggaaacaatttttaaagttatataaacaccacatttcaaaaggattgcatgatatcagaatgggaatttctagtagaaagttgaaaaaaaaaatgagactcaagggagactgttagtgtggtggtaagattgggtagaataattcagatctcaaccatgggaataacctgttgaataatcatgtgaatactaacaggtcacaataatcccgtgaatgaacatgttgaatttcggcatagagagacagcattgttattgccaaaagagctgagtagaaaggaattttgtgatgagtgatttcaagctacatttctctgagtatcaatgtgcccatctggaaaatgcaacaataaacagccctcacataattgtgaatattaaaagattatttgaagtgtctaccactttgctgatagggattcaacaaaattaaatttttcataccgaagagtagaattttccgtcagtacctcatggggcatcaacaatgatgataagcagtagaggctgacttgatattagataacattaggtgaccagtgagccaagacattcacttctttggctttccttcagtaaagtaagttacctaaaatctgaattagagtaagcagatgttgacagggataaatgaataggaaaagcatgcagagagttaagaaagaaggcatctaggatatttgtcaagaaggattaaaggcaggttttatgtatgcaaacctggatggtgaaaatggatagtttactgtgctgacttcgttcagaggtggtataattagacagagagacaaagccgcaaatgtgacttaacttgggcacagactatgagatagttggcatttgtagctggaaagtgtaagggccggttccagaggtttgcactgtagcagtccattgtgatgacaagatcctggaattcatcatgagacagagtgaattatgtggagaaggaaagtgaaaacaagaaggatgaacccagtctggtggaatttatgtcttcctcccttctaaattttgactgtgaataaatcttgttgcaaaagaaaaggtcattattaatagcatcagtcatggatgaaaacaaattagaaaacttgtttgttttattgaacatgattcagcagcagaggtgatttgaaatatcctatagggaaggaattcatgcatgcataaagtgtgttggggcaaaccctactggaagcttctttgggtcataggtcttcctggccttttcatttgtgcagcctcttggcaggtcatcactactttctaattctaagtcctgaaaattgcctatgaggtaagtttctatttcattaaatgttctattaagacaagttttctattgtcagttttgttatgaccaaattcataaatggaacatataataaaatgttaggaaatttggacattttatttcatgattattgatttctaaatttatgtaaggtccattctgtgaaattcctagagaaatttaaagagttttctttagaatattttatttgcagttattgatacatgtaacaaaaatatgggtagtatttttgctttctatgacaaaatatttatagttaagatattaaaaatataacgaatattaattatacaaaaataatacattttagaatgataattcaaatacagaacccatcaaaatcaataactatatgttagtatcaataaaatgccaattaaaaatataagaaaatatgagaaaatactaagaaaatataagaaaataatttaagaaaacctcttaagagatagcttaagaaactttcttttacccataaaatcccatgccttaccacaacacggcaatgcagatatttccttcaattactggtgggaaaaaaaaacatgagatttgaaatatcaaataaaatgtgtaaaatcaaaaaaataaacagtaagctaaaacttggaggtttttattttttccctactacatctctaaggcgttgtgagattcatttaagctagaacaagtagaatgtgttctagaaatggcatccataggatagtttaataaccggaaaacaattatccacaatgtttcaaagcatacatttggtttgtttgtttttagcattttaatttgtaggttcattcaagttaccacatccaccaattaattgcaaaagacctagccacaggcaatagttgactacttttgctttcctttatttgaacaactgttattatgcagatttcttgttagaattattctgctgtaagagagtgaagtctacctaatttcatgaatataaagggggagatgaattatgagaaatatacaggagtactccatgaaacccagcaacaaaaagtacaactggaaattacaaccagagccagaagcaagagtggtataggaagaaagatggctacttcttacatctctgcctctttttcttatctttctatatatctgctctgtttccctttctgtgtcagtaaggcaataccttctgctgtttacaaggccccaaaatgactgttttacttatacctaggtgtacttgactttccattttcaaaaactatcacgtacttccagatgtaaaaggattatgtctcttggattaaattctagaggaataaaatgggattggcccaggtgttctaatggacagtatttctttctgtgagaatgaagggaagagacagcagaatatgaacatggaagccctggcccaatactttagcctaagccagtggttttcaaacttgagtccccatcagaatcactgggaggctgtgttaagacacagattgccagcaagttttcaggtgataataaggtcactggaccagagaacatactttgaaaatcactagttatgctgtgggattgtaacagttctcaacaagaggaaatggacaaatattccaacgatgtgctatctgtacctttttgtgcaattgagccgctttgattatccagcaatttttttttttttggagacgtggtcttgctctgtcacccagactggagtgcagtggtgtgatctcggcctcagctcactgcagcctccacctcctgggttcaagcgattctcctgtctcagcttcccaagtagctgggattataggtgtgcaccaccattgcctgactaatttttgtattttcagtagagacagggtttcactatgttggccatgctgatctcgaactcctgacctcaagtgatccacctgcctcgcccttccagagtgctgagattacaggcgtgggccaccatacctggtctatccagctatttgtcttcattcatttattaaagaattattgagaagttactatataagaaaatagacatttatattcctatatatacaaaaattaattccttaataaatatagttcatgtatgtgcctggatactaagcctcacagcacatattattatacattttttaatatgtaataccattttactattttattatctaagtacagaacaatcaaattttcagaaaatgcaatcatttatattttatgctttatttattttcccaaatatttatgcataccatatgtgttatattgtaaataaaaacaaaacaagtgaaatagcttgttgatgttggaggttctcttatttacaataatttttcttcatgaagaaagatgtgtacccatatagtgatggatcaaatataaagtttacttgttaccatatattaagggtcaaaatatcctgagaggaataaactctctaaactgtttcttctgaaacctggttccacagtaacatagtctcctgatttacgaatataaagccaatcaatcctcagagatgagccattcttttcgtcactgctactctcttttgaagtgacattttcctagctgcataatctgagataatgtttggttgtataaaatatgctactattatcacatgtatgtgctgaaaaattacaaataagccatgtttcttaattatgttatcatactgagtgatatggtttggctctgtgtccctacccaagtctcatgtcaagttgtaatcgcgaagtgttgagggagagacctggtgggaggttattggatcttggaggtggtttcccccatgctgctctcatgatagtgagggagttctcatgaaatctgatggtttaaaagtggaagtttcccctgcacgctgtctctctcctgccaccttgtaagaatgtgcttgcttatccttcaccttttactgtgattgtaagtttcctgaggcctccccaatcatgcataactgtgagtcaattagacctctttcctttataaatttaccactctcaggtagtatctttatagcagtgtgagaattgattaatacagagaattggtaccgagagtggggtactgctttaaagataacctgaaaatgtggaagtaactttggaactgggtaacaggcagagattggaacagtttggagggctctgaagaaggcaggaagatgtggggaaggtcagaatttcctagaggtatgttgaatggtgttgaccaaaatgctatagtgatatggacaattaagtccaggccttggtagtcacagatgcagatgaggaacttcgtgagaactggagtaaaggtcacttatgctgtgctttagcaaaaagcctggcagcattttgcccctgccctagagctctgtggaacttcaaacttaggagagatgatttagggtatctggtggaagaaatttctaagcaacaaagcattgaagacgtgacctggctgagtctgaaagcattcagtcatatgcattcacaaagagattacctaaaactgatacttatattttaaaggaaagcagagcataaaagtttggaaaatttgcagcgtgaccatgtagaaaagaaaaacctattttcttgggagaaattcaagccagctgctgaaatttatgttaagtaatgaggagctgaatgttaatagccaagagaatgaggaaaatgtctccaggccacatcagagatcttgacagcagcccctcccatcacagacctgtagtcctaggagggaaaaatagtttcctgggccaagcccagggcgatgctgttctgtgtaacctcgggacttggtgccctgtgtcccagccactctagcttttgctgtggctaaaaggaggccaaggagcagcttgagccattgcttcagagggtgcaagccccaagccttggcagcttccacatgtgttgggcctgagggtgcatagaagacaagagttgagttttaggagcctccacctagatttcagaggacataaggaaacatctggatgtccaggcagaaatttacttcatgggcagagccctcatggagaacctcaattagggcaatgcagaggggaaatgtggggttggagcctgaacacagagtccccacctggggcactgcctagtggagctgtgagaaaaaggccactgtcctccagaccctgaaacagtagatccacagacagcttggattttgtgcttggaaaagttgcaggcactcaatgccagcccatgaaagtagccatgggggctgtatcctgcagagccacagaggtagagctgttcaaggccttgggagcctcccctccttgcatcagcatgctctggatgtgagacatggagtcaaaagagattattttgaagctataagatttaatggccagcctgctggaattggacttgaatggggcctgtagcccctttgttttcatctatttctccgttttggaatgagagcatttgtcccgtgcctgcacccccactctatcttggaattagctaacttgttttttattttaaaggcttatagaaggaagggacttaccttgtctaagatgagactttggactttaacttttgggttaatcctggaattagttaatactttaggggactgttgagaaggcatgactggtttcgaagtgtgaaaaggacatgacatttggaaggtggcagaggtggaataatatggttgggctctgtgttcccacccaaatctcatctcaaattgtaatccccacgttttgagggagagacttggtgagaggtgattggttcatggcagtggtttctcccaggctgttcttgagatagtgaaggagttctcacaggatataattgtttaaaagggctagtttcctctgcacactctttctcctgccaccatgtcagacgtgccttgcttcccctttgccttctgccatgattgtaagtttcctgaggcctccccagccacatggaactgtgagtcaattaaacctcttttgtttgtaaattacccagtgtcaggtagtatctttatagcagtgtgagaatggaataatacacttagttactgagattaatattcaaaaaattaataacattttattgataagaatcacaatgttatgtgaaaagttcccacaatttttctatgtgtaactcaattagaactagccccttctgcttgcctgctctcatttaagtcatctctcaactcccaactatatcccaaatacacatgcaattataataaataatatagaatttatagttttatgaagagataaaaatgagagggagggcacaccaaaaaatcacacaattatgcttcttaaatttccctattacctatatgcagtaattattaaaatttcctttcccaaactagctactacatcactctactcaaatcttctaaaaatttctagggtatcggtttctttttctcctcaacagaaagtctcaaaattctgataactcatatattgtagtctgcaaaggttgtagctgaacagttttagaaattcagtctttagctcagaactattctgctgagggagactaaatttattttcttccaaataaaataaatattatgtctctatttgaaaatgtatcctgtaatacctagacatgttttttcatagaaggttttgaatattttatgtttgaaaggcattgaaaccaatgattctatggataggaagaaatgaaattaaactgactaatgaacaagcacctctgaaaaatttcaagaataatttttaaatattcgactgcattgattgttagaaacatgctcagtgtgtgtgttgctgtttcttttattgttctgcttggaaagcgtgaaggacccagaagggtgataattttccacactggtcctctcctgtccctgccactcagccatttcatttcaacccctttagcacatgaccttagccactaacttctttttcaccagtcatgataaactcaaactagtggatctaattagctattagcacagctaataatcgtgagaacaaactttgtctcttccatgcattttaaaccataattcctaaaatgatcagaacttcagctgacccccttggtaaccatcactaaaatccttgcccccctcaattgcacgttagacaactcctttggtctttacttatctgacattttttcaaaatggcctatagtatcagtgctctggataatttccttcccctagatggttccaggaaatccagttgagcaaagtcatacttttgtatgccttttaagatacagaaagaaatatttcttctcttccaatgcatataacatttttccaatatgtacaaatcaaaatttctattggtaataaaaaacaagcaaccaactaccaagcaagaaaatattacatcagcaattgtttttatgataaattttgccaaataacaaatagatttcttgatggcagctactactgaaaaagcttcatatttaatcaaagtttagtaacagtgtgaaaatgaggggaagttggggttaaggatgatgtcattgttttagtcgctgtgataaaaaataatagacatctaattttggcattgtttaaaaaatatgattttacatttagaaatacttagttttaggtaggaacaaggcatgtgcttacaaatatgcagaaagtaattgggaatatatataagaatcaccttaactatctgatccttaaaaccttaataacaattgtgccaggcaaggtgtgagagccctggcatcacaaagtggtgggcttgtgggtagtggggtagtaagaagaacttaccaacaacattatagttttgaaagggaaagttttggccaggcgtggtggctcatgcatgtaatcccagcactttgggaggatgaggcggacaaatcatgaggtcaggagttcaaggccagcctggccaatatggtgaaaccctgtctctaccaaagatacaaaaaaattagccgggcttggtgacgtgcgcctgtgatcccagctaattgagaggctgaggcaagagaatcccttgaaggaaaggagggagggagtgagcgagggagggagggaggaaggaaggaaggaaggaaggacggaaggaaggaaataaaaagcctcatgtttaaaatgattcttcgctctcttctgacttgtaaatctccctttctcccttactcttaagcgtagttccatttcattgtcttctcttcttcaattctaacctctctggagaaatatgaaagaaaatcgtagaaaaatataatcttgggtttttttatcagagtaattcagctttttctaacctcatgggcagattaggccttacattttcaagtaaaactttgaaatgataatttgtaaaggcctgtccgattaactatttagataaaaatttacctcttgtagcttcctagaggttgtagacagagcagggtatggttggcttcatttttctcacttacaagtagagaacggaaaatctggaatgagatcagggataccatatgggattggaaatcacctgtgaaataatatttgtaaagccaattaaagagagtcaaagacagacctctaagtgcaagtataaagggaaaatagaaacatctcaatgttcacccatttaagggacagggaaatacattaaatccagataaattacctgagaggtaatcataatagttgtgtgagttagtgcaattatcttaatttacttatagagaaagtgagatacagaaatgaacggagctaaatgaagaagtcattatcaaatgtctttgacttaaagactgtgtcctttttaggacagtaggacctccctaatgaatttattctccttcgcagggtcagaattgagaataagtaagttagaaagtgatttcactttggtagattccaatgctgtcagtcaacaagagaagaataaaaacattgccctgtagaaaagcaatctatccaggccaggaggggtggctcatgcctgtaatcccagcactttgggaggccgaggtgggcagatcacctgaggtcaggagtttgaaaccagtctggccaacgtgatgaaaccccatctctactaaaaaatacaaaaactaaaaattagctgggcgtggtggcgggcgcctgtaatcccagctcctcagaggctgagacaggagagtcgcttgaaccaaggaggcagaggttgcagtgagccgagatcatgccactgcactccagcctgggcaatacagtgagactccatctgaaaaataaaaaaaaaagaaagaaagaaagaaagaaaagaaaagtaatctatccagtaaattgagtaacttaatatgtttttattattctttccattagtctaataaatagttggcaagaatgatggtgggagcaatccaaacgttgacaatgaaaacagagacatgaggaaacagaaatagcacgtggggttatctgatggtagggaagaaagcctgaaataatagggtaaagtgcaagtgaagcgaggaagcgagaaaaaacgaagcagaaggagttgaaatgccagaggtgtcagttactaacaacacatttaatgtgagagaggcagatcgttgtggaagctagaggtgatagccattcaaagcagatagggggatcgcagcctatgatgctccaaatgctactgccaaatgacagccactggaaatgccactctggtcattgtatcataagatgttaaaggtttgccattcattagtttcaaaggaatctgaatgagtaaccacattcattatagagacaaacaacagattatgaatgtgtactttaatactttaggggctgaaaggagaaaaaaacaaagacaataaaattctaatggctgtatttaaaagtgaacattgtgtgagtctaagaaagctaacagttcacagttcagtttgtcttaaaaaatatgtgtgtctgtgtataacgctcgtattacatatatctcatattaccatgttatataactatcatacataataccattatgacataataccattatgtatgtatgtactatagattattaccattatgtatggttatttacattatacattatatgccatttaataacatttaaagtgttataaagatgcaattttaaattacaagtggatttgtgacaagataattgaatccacaatttatgtcaacagagttggaaattgttgaggcatgtttctaaacttttaaaataggtcttcatttgagtagattttctttttttttctttctttcttttttttttttttccttgagacagggtttcactcccgtcatccagactggagtgcagtggtgtgatctcagctcgctacaacttctgcctcctgggctcaagtgattctcatgcctcagcctcctgagtagctgggattacaggcatgcaccacagtgcccagctaatttttgtatttttttatagagacggggttttgccatgttggccaggctgatctcaaactcttgagcttaagtgattcacctaccttggcctcccaaaatgctatgattataggcatgagccactgcgcctgtgctgagtatattttcaaatgtagaatactgaattcagtgcaatttgatcatattttgaaaatttctgcattattatgttgttgtattggaacatttgggttttcgtagttgttttgttttgtgtccctaaggggagatgaaccttctttgtttgcttgaagaatacataacatatgggtcttggtggttgagaagaccatggaagcctaaaagaacaaatttgccctctcccagcctcgcttgcaattagctattaaagttctatgggtgatacacatattatcaaagtttactgttagggaaagccagagcataagccataatcacatgacttcagctgagccaattgtaagcaccagactgagaacaaataatgcaaggagagaagattagcaaaggctccctttgggacctggcagttcacagtgatacttagagacaaaggcaatgtaagctgaagcagctagtactgagaaaaagtagcattattgtcttcactagacagtgaagtgtggagtggtttttgactttgatcctgagtgtctagccttccattgttgcttctggttttctgagccagtgtttgaaagcatcccacagttctatatgctaacacaattaactcttaaaaaattctgtttttctttaaatcccccagagttagcttctgttgccttcaactaaaaaccttgacaagtacagtagataaggcatggtttgggatcacaacttgattttttttattttgggaatacaaatttaacttgtggagagactgatgttctctatctcaccaaaaattgtttttgttataagctgtattcataagtgagctgtaatgttaaagagaaaaaagaaaaggattttaaattgctttctgcagcagaatgggaggcagtaaaaaggacaaactgctaaacagagaaaacaagacaatagaaaggaaagactgttctaaggaggagctgacagggctgctatgaaagaaatgtagagtctggctttaaattgcacatgtgacaagaaagatgtgatggaaaaaaaaatgtttgtttactcacactccgtccacatcctcactgcaacacacccacagcacactcttctaaggaaggttcacattgctgaattttttttttttttttttttagttgggtgtatagctgccttcaataaaatatttagtcacatacttgaacacagtgtgaagtcataggtatttgtgtatcacgacaacagcagataggtatttcaatatcaaaacaaaattggagaaacctgtgtagttgtaaaaaacactgcataaaataaagggagattgaggatgggtggtagagaggaggcaaatatcaggaaagaagggaagatgtccatgtctgatacggattttctcagctgtaaatgctgaggactgtttagtaaccctctttttatgtgctcatcaaatggacattaaaatatctatttgtcatagtggtttgtgagatatattcatatagcaattaatactgtgaagcgctgaaacttgctctaagttatacaaagagtggagacagagatagccaattggaagccggttacatctaggccatgtgttatttctgtatttacgtagtcttctctgtgtaattagaactgctataggtgctaattgaaggagaactttagatcctagatattataaaaaataaatagaaaataccattgctatggactgaatgtttgtgtccccaacatttatatcttgaaatttaaaccccaaggtgatgataataggaggtggagctattgggaggtgattagttcatggagttagtgcccttgttaaagaagccccagggaactgcgttggccttttcaccacgtgaggacacagggtgaaagcgccagctaatgatgaatcagaaagacttcatcagacactgaatctgtggatgccttgaacttggactttccagtctccagaactgtgagatgcacattcccgtggtttgcaaggcactgagtctacagtattttgttatagtagcactaatggactaagattactatgggggcataaatcctctaaaccagattttctatagatataaaaattaaaaagagctatgatacaaagagtccccatttgctctatatcccatgatttattcatttgatcaataaacatatgtgcagggatctaggtataacaacatgagaaagcaacaatcctcgtggaaatggtggaagcaagagaaattagaatttataaatgtgtagtggtcatacatggacttcataataatctagtgaaaaacaccacatgatttgttcttaatcatgttaatattataacttcttcagagctctcgctaaacacagcagcaagaaaatcagcctcaatcaactttgggagaacttttaactttgcctagtgtcagtcgaatgaatatccaggaagctcatgttatactcagaaaacaggaaagctctgaccattagtctgtggtgtttatcgtagttacctttgctctttctactataaggtggtgctgaatcttgtcctctgccctctattgaaaccctgaccctccacgcagaaatctttagaaccacagtttaatggctatcttttatggtcatcctatagtcagttaactaaccaattggaggtgccacaagtggaccaaataaatcttcatgttgcaaaggaattaaaaaacaaaacagtacctggacccagccctaagtaggagaggcatgactccatctcccctctggctgaataaccatccatcttataactccctgcctttcagagttcttttgtttacttctatctggatctgcttttccatctccaccaccaaaacagctcctgagtagagtggtctgtttttcaaacttgcaacctaaagacacccaaatgaaaagaggaaaatgaaagaataattcatttagttttttcttggaatagaattaagggaaaaatagctcacattctttcaagagggaacaaaaggtaaattaatattttaccatgttatccagtagcatatccattatttacgtggtcttattttattgattggtcaaaagattcacaagaagaagatagttcaacatacacctgtgttttgagggtgaaactcagctgaaatacactggaaacaatagctgtgaaagtctacaaggcaatgggagtgaaaagcataatttaaaaccatcatctttacctaatgatcaaagcctttggcctctaacagagattcttcatagcagttcacaaaagagtgccatactggggacataagagggtgggccaggtggggtggctcacgcctgtaatcccagaactttgggaggctgaggtgggcaggtcacgaggtcaggagatcgagacaatcctggccaacatggtcaaaccccgtctctactaaaatacaaaaaattggccaggcacggtggcacgcgcctgtggtcccaggcacttgggaggctgaggcaggggaatcgcttgaacctgggaggtggaggttgcagtgagctgagatggcgccactgcattccagcctggtgacagagcgagactccatctcaaatcaatcaatcaatcaatcaatcaatcaattagggtgtaatgggagagttaggaagggatcctatcctacagatggggtaaaggaaatgttatgtaaggtggcattggtaccacctattgattatgctaactgatgcattccaagttaccaaattagatctcttataaacttgaaattttatgattaagtattgctagttttggtttggaaaaatgatccaaaatttatgttgcataacttatagttaaaggaaaatgtagtacaatgatactgtattttactgttgaagtctttgtgttgggattaagtattaagaagaaaattactgttcaacataacaaccgaaagggtaaacatatttaaataattacttaaacaaatgtaaacattattaattccaactaactctgtatacactttccagcggttgcactgccttgttcagatagctgttgcttcatgtgtggcatggccaattggcttcatattatgaaggatgagaggcaacctgaactggccaaccatgacagcagacctttcttagggaagtcaagtccatcattgcctttttcactcttcagtttcaaatattgtaagatcttttatatgctgctgtctttgttaaacatgggaggctcaaacatgtcatcactcaggacttcatacctgattcctctttcagtgtttatggctactgtcttaccccaggctttcattttactcttattgggaccatttcaagggtcttctaactggactttctcccattactcactccatcctccacattttcacgatggttatttttaaattaggagtctaatcatgttgttcgtctgccccactgcctacagcgtaaactatagtttatgtatagaattttgtatagaattcttttgtatagaattcaagaccctccatattcaaccattaatgattcttgtccgtaagcacttagcacagtgctcaacgtatggcagacactgagtagataaatgtgtgctaggtaaaatgaattaagggcaattgagtggcccttccaccagatgatgtcctggtgtctagaaatagatgaattttgattgtttttggcaattatcttaaagatttcatatccagaaacttcaatttcataatttttctgattagcccattccattttattcagttgctttgatgataatcaataatagtaatattgttgacttcatacagaagaaaagaagataacttttaaacaattttaatatttccaaaagatgttttatgatcattttttacataaatattatattctttgaatagattatctgaaatagaattccaggaccaaagattatctaccactttaagccttagattgtaaaatggtctcttaaaaaagcacatcagctcagacccagatttataatgttctgactaaattataacattttatttaattgtcgataaaaagcacactgtttcacacataacacaaatttaactttttaaatttaaataccttaaagggtcaattattgcaaaagacagattgagacattcaacaaacatttcttgaatacctaatatgtacaagaccccatcccagaaaactatatagagttatagaaattaaattaagtgaaaaaatgagtatgtaaacatcaaaataaaaaagttagtttggagtcaaatgtaagcatttgttcttaaaaatattatggtttcctccaggattattctttagtagtacttgccaattttttctcagaatgtgttgtcctatggtttgctttttttaatttcacaaatgtcagaggtacaaaagagtcttacaccttttcttgcaggatttctaaaaatcgtatttagtcatcaagaccaaatttatcatcaaaccttaacccctgaaaccaagaaatttatgtatacattttatttatattttcatttatatttacatctcagcagtggcaaatgatacttatatggttttatgtattttgtacagaatcaccataggattattgttttgatgtatctaatattagactgtctagttagcaagataattggaagaattttacaaatttctgtaatattttaattcttatctaattgaattaactccttagcttcaaagtccctaataaaaagtataaaataatcaaaagtatttttaaaaagcttttaatttttaaagtaaataatatacggtttattcactcatacattaagaacttgtgaaaacagaaacatacttcataatgttaagttaaaattgttctattttagttttcaaatatttttaattttcttcaaggagaaatgttaaatgaaattataaccattagtttttataattttgaaaaattttctctattactctgatactttagagagccacaattttcacaaatctttgacattttaagttgtttcttgatattttcttaaattaaaaaccatgtttattcagatttatgcacatctttatttcagataaactattgctacaacttggttaaaacaaaaataaatattttacaatttttaaaatgctggcttatattaaagttggtttacattagaaaaaggctcaaagaacttgtattggaattcttctaccaataaattccatcttctaccaataaattcatgaaaacatttaaaactttataagtaatcaaataaaactaaaataatctaacactgtgtattagtccatttttacactgctaataaggccatacccaagactgggtaatttacaaaggaaagagttttaattgactcacagttcagaatggctggggaggcctcaggatcctcacaatcattgtggaaggggaagcaaacacgtccttcttcacatggcagcagcaaagagaaatgctgagcaaaagggggaaaatctccctataaaactatcagagctgagaactcagtcactatcatgagaacaggagcatggaggtaatcactctaatgattctattactttccaccctgtctctccaatggcacgtggggattatgggaactacaactcaagatgagatctgggtggagacacagagctaacccatattacattgcaacactgttattctcctttctccaattggctacattttaataaatgataatatgccactttcagcaatgaccttggagtgaagtactctggctccccgctggtagaagtccaagcacggctttttgaaaaggttaagatgtgacctatcctttaactcggcaattccactattgtgaattaatcataaagaagtaatgagcatttacaaaaatgtgtatgtgtttgtatatcagtgtgtgtgtgtgtatgtgcacacacacatccacatacaaatatgtgccctcatgtgtgtgtgtggacaagaagtcagaggcaatagattgaggagtaaatggtgacaaaggcattgattgtaaacaagtcttcctaggaaattacttatgaaagatagaagaacaaagtagctggagcaagaggtaagacctgaggaatctttttatgttagggaagatttgaacctgcgtaaacattaatgagaaagaacaaataggctaaaatagatgagaccaaaggagaagtgaaggaggagttcaccaagaagcgagaggtatagaattggcagcacaggtggaggaagcacctattacattgggctgggagggagtgaggtacagattggcacatgtgtgggatggtgagggtggaagggtgagagaaagagaaagagagagagagagagagagagagagatcagaaaggagacatggggagatatggaaaatttaaccagaggcaaagccacaaatttctgctttgggaaatgtatttttagtattaaatgcgtcacgtgcaaaaaaaaaaaacaacaaaaatcagaactcattccatctgtattataaggactgatattttcctaagactgcctaataataataaaaaagattattcacaactataactaggccaagtgtaatataaaaatgtaagataatttcttatgattttgaacaggagttgatgatctttatctgtgaagtgccagctagtaagtatttcggctctgtaagccacacaatatatgtctcaaatactcaatcctgtgattgtggctgtaacacaaaatcagccatggattatacctaaagaaatgggggtgggtgtgtttcaataaaattttatttacaaaaatagatgacgggccagatgtgctaacttctggtctgaaataaaatcagtgaagaacttgacactggtaagctaaatttttgttctctcagggtattttaagctcatgcctgattatcattatatatttctgtggatcaaagagattttcttctatttatagcagaacaagggaaagaacacctattctgcggtctgtggtcctagattttaaggacgacccttttacttgtactggccggttacttaaaacctctgagccctagtttccttcttcgtaaaacaaggcgatgaccctgtatttaatcctcacagatcagaatgagaataaaatgtaaatactataaaaatggtatattattcatacataaggaaatggtcatttgcaaccaaatcagaaaatgttagttcgatctccttatgtgtaagaccttgacattatatatacatatatatgtgtatatatacacatacatatgtaatagttgtaactattaagtgaaataataatatatgcaaagtgcttggctgcagtgcctaatataccttatatgctcagtaaatgccagataatgttcttaatttctaaaggcccattaaaattctccagtgcttgtgacacatagcgcctgaaggggcaaaatcaagttattccaagtcaagcacaatgctggcaatgccagccatgggcagggcagtcacagcaacataccttttaagtaagcctcccagggctgctttgcaaatggcgtaagaaatgggtattgacaattgtcatggagcccagtgactcggaagctgagttttgcgttctgagttgaatatcaggagagagttttcattcttctatgatttggaagttacagccccagactaaaaggaaggcatctgtttgattctatagtaacacaaacataaagagaccagatgagacggcatagctaccccggggcagttttaaaataaactgcaaatgtactcatcagccctttggaggaacatttgcccctatttgttcagtatgtgcagtttgttcaccagaccagggaatgcttagttattatgtgattccaccccattaaagttcttcaagccacccaggagaggcagggtaagcagcaatcggttttccatggatgaagaaggattcaatgagggagaaatgggcagtgcaggagcaattctaactcatttctgagtaaatatatagaaaactttgtgtcaggtgtgattcaacagaaggaaaagcattctctataacagttaacctacatttcgagcaaagagtgggcttttgttccttgtcttttaaacatttttatttttagtttttatctcagtgaaatcagtgggaatctacactgatgccaggttatgcggtgttattcaaacatgaaccttcacctgggacacctgttatctgcaacagagatgatttggcttttggcacttaataagctatttgccctctatagttttaaatcccaggctttcatatagacttgtttttgacatggtgcatttttagatcctgaatatgaagataatacgcactatgcatttggttcaaacatcggatacaagtgtccattgaaagtcaattctccctctcattttctgtatcaaatagataagatttttcacatggatcttttgtcatgttcatattcatcatctcaaaaattcatgacacttattgtttataatatttatttgtaatcattcaattgtagaactttttaaaaatgttaaaaaatagtaacttaacaagactatagtgaccatgaatagaggaaggattcaaacccagatcttctgactccgaataagtttttaaaatagtatttcttattcagaatgatcaactttaacataaataaaaacacttaaaatagaagggtattgatataaagaatgatatgatataaagaacacagaaaatatattgtataagaagtttgcttcagtctgtatttctgtaaatgattatttccaaagctgaagatcaaagtaaacccacatgtgtgtggggtgtgttcacaaattatattaaacttgtgtctcccttctggcaaattggctatagataagaaatgtaaatcacataagatgctacacgttggtttacatgagcctctatatcttcctaagcacacatatccactggcaaccacaagaatgcgatgtaggcacaatactagtcgatttaatgtgattctatgattctcgtttatagaactggaggtttcgcatttcccattcctacctaattcaataactcagattgcttgatttacttttagagcaatgattccctcctgggagcaattttgcttcctagcaaaatttggcaatgcctggagacatttttgtttgtcacaagagggggttgtgtgctactggcatcttgtgggtcaaggccgtggatactaccaaatatcctataatgtacaagacagtcacccacaactaagaaatatcctgcaaaatgtcagtggcaccagaggagatgaatgcaaacatgctaaccacattcctagagactagtacgtgaaccagaatgccatttattaatttgcaatgatagctagaactgtcaaggggaccaagacaatcatatttactgatgaatatatttactccctctggaaaacctatacaaaaagccaaattagaaccagacatttatttgctaaacataaagtcaattctaagaagatagatactcctcatagaacttatcacaatgaaaactgatcatttgtgtgattatatatgtattcctcctctttaagtctaaaaactctattgggatatggaacctatctcaatatgcatcatcttaaccaaggcatctaactgtactgcctgtcatgtagtaggtactaacaaatgtttattgaatccatgaatgaatgaatctttaatgtttcagtttaaaaatacatattaaacgtataacatatacaaagcacaatttgaagcactgggattacaaaatataataagataatccctacttgtgtggaagttcctgaattctgatggactagatggacacttccagttatgtcaggctgctgaagccatagcctgccctgccaacaggcaccatgaaagagctgagcctcagcagccatgttaggtatcatgtgactctgtgccttgaccacatttgaatggactgaggtgaaagagtatgaaagcaggaactggcggcatcctatcatctgagctttagcaagaagatgtggaccctgacaaatcagattcctgtgcttgggtatttaaataaaaatactaaatgactgaattagaagtgtaaagagaagttgcaaagatactgtagtggtttgaatggtggccccccaaaagacatccacccagtacctgtgaatgtgacctaatttgaaaaatgtctttgtactggtaattaagtgaaagatttaaagatgagatcatcctgaattaagtgggtggtcataaatccaatgagcgtgtctttatgcaatagacagaaaggtagaggacacacaggagaggttcatgtgaatgaaggcacagacagacagtgcacatatgtagccacaaaccaacggaggcctggagcaaccagaggctggaagaaggaaggaaggatcctcccctggagacttcagagggagtgtggtcctgccgacaccttgatttttgaacttctggctttcagaactgtcagagaatatgtttctgtttctttcaggccccacactttgttacggagccttaggaaactaatataaatacctagaaagaagaaatatataggagtaaaagtcatgaacggcagcttgcaaccactgatgttacattgaacaaggaactgaataaacaaaaagctttgcagtagggaaataacacagtctggaggaaaatactgagccagtcagtggtaaaagacacatagaattggatcatagagagcagccacgtcacttctctggttaagttctggtgtaaagatacacagattcctgctcttgataatcctgctgctttggaagaagcttttatttcctgcttatccattaagaagtcaggcatgtttggggtttatatttgtttaatcttacaggaaacttcccatcatttcctaaggctgaaacattttgtaaagaattgtaaatagaaaattgcaatataaaacagaaagtagtaaacaagtccagcatgccaatgaactaatggactccaaacaggaacacttggtctggctagaaatttcatgaaaagcttcctggatgaattcattaaattatccctggcatatcttgaaagtggagtgggtacttttcaactgactaataagagatgaaaggacaagaaagaaaaattttcaaaaaagaaaataaaaagaaaactgaaagcagagatgcataaaatcatttgggttatcatcttactatgtaacgggatcgagctatgggcacgtgagggagacacagaagcaaaagatactgaaatgttattgtcagcagattagcatgccctgcctcccacagactttttttggttctatgataagcaacctcttgagacaactgatgtgcctatagttttagatgggctaatacaattccattcctatgagattgcttcaaagttactaactcaagatatatttgagatttttccattttgccccttctgcagatagctgatgtaatttcctgcatttcttcttcccaatcttttgacaaagtaaacatttgaaattctgagtgtcttgaaatatagggaaacaaaggtctctgttctttttttctggaatttgaattaatgccttttatgtaacatcagtgtgaagatgatgaataaagaatactccatagatgagaaatcaaaggagaagaaaagtttaaaaaatatatgtgaaaataatctataaaatagtaatgttctatcagactcccactcactaaaaaaatgaaaaaagtgtggtttctatttagtccctttggttgtaagtaaatgatgtgtctagtctgtgccaaacactgtgctagcttcttagtataaaaaggtaactaaaagcacagcttcactcaaacataaattatgatttagtatgtcttgaaggtatcattttgcctgacagtataagcaaaaagcagaaaatagtgattgattaaccttattttgtagtgatgcaggaatctaataaacccaaattaaggattgaaatgaagataacaaaattgaagtaaccaatatttctggttggagcccacttttattacagcgctaaaaatagtcattgacataagaaaggatagatgaatgccatcttgttattttccagcactgagataggtttagatgagtatgtcggagataggaacattaagaagttggtagccctcgcacatatgatgaataaagatagatcattataaatggcttcaaaactcttttcttcgaaggttcttactgggcttattataaaaggaacaaagattgttagaagatatgctgtcttcactgtctcaaaaacaatactttttgaaaccttctcaagaatatagtgaaatggataaagaacctctctgagaaactcctgttgtcattggattttgaaagttgtcataaaccacctctgtacctaacctaaataatgaatgttgttgtctttgttgtgtttaaaatataagtattgctaccaagtatattacaatattatgctgtatcactaatgtaaaattgtgttttgttaaaacaaagttatgcatttttattgaaaataaatatggaataatataaatgtttagaagctggttagaagaaattattcatctttttcatagaagttcttgttacttcattaaaaaattcatttccttaaacacacacacacacacacacacacacacacacacttccacacactaatcagtttctgtgaacaggtaactttgtagtatcctatttgtatccacatttatatccatgttattagaaattctaataatcttatttaaaggtagaaatttccaagttaaaaattaatattcaagttaatgaaaaaataatttgtttagaatttccacatgaataagacataaaaataataagtataatttataaaagagggaataaaattgcaaagtacagaaaaaatataactgtagtagtcatcaaagaaatgctaatttaaacatggacacaatttttcattcagcaaaattattttgcaaccttttaaaaaataatatgcataataatttttaaaacatgcttaaggaatcaatcaataattataaatatataaataggatattagacatctaaaacaaacttaaaaaaatatataatgtagaaaaaagtactatatactaataagtgaaaggaactgtagaattataaattactatacgtatcatattatgaatatactataattatgttataaatgttaaaagtttaaactagattgaagtaactataccaacatgttcaattagcagtgtttaagttaacggtaggatttttactgtgtgtgcgtgtcgatgtgtgtgtgaatgtttgtgtggaagtcacgtctatcttttttagtaaaagcagttgcttttatcagaacaattcttgtccgaccaaatcaggaaactccaaaattcagctaaaatatgacatatgcaaaaaacaataggtgagaaaatactttccaaaaatactttatgtaagtggaagtgataattgttgtctttgcaatgatcaagaatgagccttaagtgaagtagttgatacgaacttttattttctttcctactttctttttttctatatttcttcctccctgtcaacaggtgtctgcccttttttcacgtctcaaggaattaattcctatctcactcttcttctgtcatcaatacttgccttttgatattaaggccaggtgaattgctgatcactccctgcacttggccgctcctatcttgtcttgcagccacatgaattaggtactagtaatgaaccctcattggagagtctgagcctcagtgattctgaattctgtctccacattatgtatcatttgggcagattttcataagtagggtcatcggctgcccacttcatgcatgctttcacacctccacccctagaatctgatccttacttttctggaatatggttcaggcatagacattttcaaagctcctggggttgtttggaggcccagccagctttactaactcctggcctaatcctaccaatagaatctcattctctttgctacagtgcttgctgcaagcttgggaagctctaagccattcagtgaccagccacagggactggctcaggaaccttctgagccaaagagacaccatgcaagattacctgaggaacttctcagggtgaggatgggagcagaaacttccttttcctttcctgaacatttcagaagtgaccgtcaattcctggaaaccttggccatcttgctccctctgtgaggatgagggttgacctacaagaattacagagagaaggaggcagaattctacatgggccaaggcgggtcacagctctatgtttaattttttagatcatctgaaccaaaatatatgcatttttctggtgttagttcaagtttgatttttctgttaaaacgagtacattccaatgaacacagtttttcttcacacagaggtgtaaaaaattgatatgacataatatgatcctataaccagaggtattttcattttaataaaggttgagtaacttcctactaaataataaaccttttatggtagaattttaagcatcggcaagctgatgaggtaaagagggtactttcctggcatttctgaaatcaattttaactaattgaacacttaacaaaaatatattgaaattgaaggactctgattcgtacctcagtcttagcttttcacttacctcgtgtatgacttcagttaaattacttaatttcagctgggcgcagtggctcacgcctgtaatcctaacactttgggaggctgaggcgggtggatcacaaggtcaggagtttgagaccagcctgatcaacatggtgaaaccctgtctctattaaaaatacaaaaattagccaggtgtggtggcgcattcctgttatcccagcaactcgggagactgaggcaggagagtcacttgcacccgggaggtggaggttgcagtgagccaagatctcaccgttgcactccagcctggcaaccaagtgagattccatctaaaaaaaaaaaaaaattacttaatttctttaggtttccttacttgtaaaagtgtaactatatcataggattctagtgaggataaaatatgaaataatgtgcataaaatttattagtgtgcagtggctggtgaattaataaagatgggacattctattttattataaattgtaccttaccatatgcctatatgctttgttcctcttagtaacatagtagagacctaaaagccctaaaatcaaaaagtaaaggaagaggagaaagaaaaagtttatgttagcattgctgtttgagtctccacagatgtatgttcatcagtgcttgcctattgaccagtcttttatttgatagctggtagacatgtgaacacacgccaattgtgtatagactcatgacaatgctacacctaaatggtctcgcttatccgtgatctttcacctctgaccggacgtttgtatcttttgcccccaacgtggcagctaaaaaggcaaaggagaaatgttttaaagctccaaagcaaagcttggttctctgatgcttgcagacactgtctacatacctagctccatcgactgcatctgtgaccttgtctgtctctcctcctggtatgaaatgattatatgtaggcagagactttccaaacctgccaacactttggataattgttaaaacaggtttaatgtgtaggtgaaatccaaaccaaaagttaggacacagaaaagtgattcagggaggtgcatttatactatttcatttgatattaatgaagttttaaaaactgagattatgtcctagagtaacatatgtttgctctcagaaaaatcactagataagataagggactatttaggagtaagttcctgagacatctggaattttctatcagtgataccgttccctatcagttaaaggtaggctacagttttaaaatggacaaaattctgtgtatgagttttgagtaatagatactgtggctgtattcttaaaacacagaatgctccagtaataggtcagagtatttgaagttttgaaacatcctagtgaagtttgaactacacattgctgaagttaggactgctgtcttctacgtggcacagctgaatttggtagatgattccaatgattaattttaatattaaagttttacattttaaataaaacatgatcctgaaactagaatatcacatcttcaaatatttataaaacgctgtgtcctaagtcctagcaattattgtaagacacataacattgcctgaaattatttagatggacacagtgaatgtttacgtaaccttttaataggaaactcgagttttgtgttctcttcaatacaagctaagacacatttctaactaagttgatatttaaaatacataccacctaagtgaacactttgtaagttcaaatttggtattattgtgaaaacttaaaaacatcaaatatacctttgaaagtttcaagtgaatattgactcctaaatgagtatgaaacagatcagacaattccaaatctctatttaattcaacatttatttatactactaacatcatgggagaaaaatgagtggttctgtttttcgttttgttttgtttttttaacaaggtcttgctctgtggctcaggctggagtgcagttgtgggatcacaggtgagtgtagtctcaacctcccaggctcaaatcatcttcccacctcagcctcccgagtagcagggaccacaggtgtgagccactgtgcctggctggttccagatcattttaaagaaattaagatgtatttatttgttttattggcaattcttagttttatttaggaattgattctcaaagtaaaggtgctagcaggatatggaaaatgaaatatgggaagaaaaacttaaacctatttttaaaatttttatctacaaatagaaataaattaggaaataattcggctttgttcatatttaatatatggatagacactggtgtttccacttccatatgtcacatgatcatattttatgtgtggtgccaaggtttcccagggagaagatgggttgactacacacctattgtatttgtcttctacgtcttctaaaatgaaaggtggctaaagaagattcttaaaaaaagtctcagaaccagtcttacaataaaaatgcaaacaaaatcaacaagaaaatgacagggttgttatttatactcccaatacaaactctttctttgtcacatcatgaggtaaaaatcaatgatgatttacaagagattgatcagagataaaaaaattacctagaaagcaatttgaaatgtgaattcatccactattgttattaaatctgactttgtatgtgtattattgatgattagctagtgttcgttttagaatggaaacaatgtgtagaaatagaagcattatttttcaaaacacacattttgggagaatgtaaactcaaaattgtatcgttagcattgcacaatctaaaatattcggagatgagtaatgtagcgccaaagtatattaaaatgatttcacctggtggctaaaataacaccaaaaacaatttatagacattttataatttatcaatttctttttaaatatattatatattaaattacataaaagctttacaaggttgatgctgttttccccactatataaatgcaataatcaagattttgaaagattacaacttgtccatgggcgtaattaataaatagaacagcataatctgattgctgatcttttgattttaaattctatatttttctagcttccagttttagttgcacacaatctacttagctaaaactgaatttggttaattgtcaaccaagactccaaaacatctttgttatctgatgttcttcatttttactttttaaaaataattgaaatgtcactattatattgacagtaaattcaccagttgttcgatgagattaaccttcttaaaggatgatcaaagcatgcagtgaagggaacctgacggggtttgactgctcagtttatcactgaacagggcacaggtaggctgagtgataacaccactcgtctctgatcagggactcatttgtgccatctggattagcaaagatttcccttccatttctctgctccctgcctcccacaggctatgactatgcttcttgtggtttcatcgcttgctgctgagcggtgttaataactacttgacatttggtttcccaatgatgttcacccaatttttctctaatatacagattctctgcaacacttctcacagtaattccagtgctgtagatatttcttggacatttatacaaaacatttaacttgtttccctgtaatagatagtgtaagttaaggttcacaaagaggaacataatttgcaaattttaaaattgtcctccctttactttaagtaggtaaaaataaagatgcaattgaccctgtcgatattgacttcatagagacatggatattaatatgtaaaacaataatctaaaatgagttttgaaaagaggtataatataaatccttaactaattaaccttgactatcataagtgcattcacatttcacttgcttatagtccatgacatggaaaactactcaatcaatagttattatacagaaacatctgaatcaggcataaagaatttggctaacatcaatcctttatgttagtgaaaactgtaaaaaatttgtataccaccgagaaaacatttaaggttttattaagaaggttttattaagaagtgaactatttttaggtaaactgtgaatccttgggaagaaaatgttatctttctcttttggagtggaggtgtcaaaatttacaaattagggtcaatagtagactagagtttgcttcacagtgaccaagctgaagttttctttatttttccctccctcccctcctcttccctcatctcccttcccctcccctcccctcccctcccctcccctcccttcccctcccctcgcctcctctccgctcctttcccctcccccctcccttcccctcccccctcccctcccctcccctcccctcccttcccctcccctcgcctcctctccgctcccttcccctcccccctcccttcccctcccccctcccttcccctcccccttcccttcccctcccctcccctcccttcccctcccctcccctcccttcccctcccctcccccttttccttccttccttccttccttccttctctgtgtgtgtgtgtgtgtgtgtgtgtgtgtgtgtgtgtgtgtgtgtctctgcctgtctttctgtctttttttcaaggagttgaagtttcccaggcagttggtttataggggggactctctggttcatgggcaatcgaatttcttacaacatagtctatgtgctgaggtggggaaagcatgggagatttggaatcagacagagcaaatgagctcattttaatccctaactaactttgtcacttgggagaattatctgctttatctgagtcttagttccttcctctctaaaatgagaacaatgataacttctctctctctctctttttaacttttgatgtttcattgattgtacataaaacctccataataagagctgagttcagtccaattgttggtgaccgtgcaaagctagacagtggtaaattcatcagggtacatgccacttagtcacactaagtctttgcaatagaaacttctgcagagaccagtctacctttttttgttgtctttagagcaatttaccaaatcattaagaactttgcttttcttaacacttgccatcttcatactcagccagaatgttcttttcaaacaaaaatgtgattttgccactccctgttaaaaacccctgaatgacttcctgtcattcctgagacaacagcccaaatcctgaatacaacttctagggccttccttgtctgacctcatccgacccctacagaaacagagccatgatccataaacgttctactgttcacctccctgactgtggaaagtgattgtccttcagtcttgacttgacccagtgcatttctttaaatctatatgtaataatcagaatataggagctgagcacagtggctcaggcctgtaataccaggactttgtgaggctgaggtggaaggatcacctgaggccaatagtttgagaccagcctggcaacctagggagaccctgcctctacaaaaacaaaacaaaggaacaaacacaaattccccccaaaacaggtgatgagaacgtccctctggagcaaacagaacaacctcaataagaagagcaagtattgctaagagtcacctaaaagcaactgcaaaatgaatgtgaacttaaagtaaaagcaaataaggtagacagggacatttctgttgttaccacctttttctaaagaataaaaatgtttttaaattattctttctgcctttttacaaactaacaaaatttgatcttcctggggagtgggaaggagggatgactcatactgctgaaactcacgtgagatcaatttgtgtgctctaagatcaatttaataatttacactggaaatatctcttcaaagtaggtgtccccactgggacattaaattagcattggaaggcttgcttggcgaatattgaggctgacttaggcaggtgctgagaggcagataagccttctgaacgtaacaggttgcctgtaggggcaacttctccttagtgttttgaagacatattatgatttttctcctccccacaatccttgtttgcaaagatatgagcttattttccaactcattcttacctccatgttgacctcaggaaaaaactgaatgcttcagggagagagctttcaacagacgctcatcttttcttaaggcttgtgacttctaatcacaagcctccaactaagcaaaatatgcttacatacacagatactgcctaaatggggagattatatttagatatatttgagcgcatagagttgatatgacaagattctcaaactaagtaattttcaagtttactagaattttgctgcttaaagttcctgttaatacaagaaaggaccagaagatatctcatttgagccttggaattctaactttgtgttaaaaattattgttatcttacctggagaaagacatctctaaatgctttgtaaatgttacatctgcttaagtagaagtataaaaatagttgtctccaaaaatttaaatttgtattaaattttctcttatgtcttaaaattagaaaatcgattcctatgcacttaaacaagtgataaagaatttgtgttttgggccaggagcagtggcccacacccataattccaggattttgggaggcctaggtggaggattgcttaagaccagcctgggcaacatagggaccccgtctctactaaaaattaaaaaattagccagtcctggtggtgtttgcctgtgttcccagctactctagaggctgaggtgggaggattgcttggacctgggaggccgaggctacagtgagctgtgactgagccactgcactccagcctgggtgacagaatgagatcctgcctcaaaaaaaaaaaaaaaaaaaaatttgtgttttcttggtttgacctttggagtgtacaagaaggcttggaagttatagaaaagttaattgtttttggtgatttcagaatatgtacagcaggtcttcaagtctttgataggttcttagaaactgtgactttaagtgaaaggctgtatagcaggccctcagataatgttgtttgattagacgttgttttattataacgttgatgagaaaaaaaagtgttttattttatgccattttacttaagtcccagtttccaaaaaccttaaggacttactctatttgaaaaatgaaatgaatattattaatattaatatttgttgactgaataaagctgtgtaatagcccaataggctaaatgtttaaaatcaggaaattacaattactactgtattttacagaactgtaggtcacttaattacttttgtaatctgcctataagtgtaaaggcaaagggtagagtaaaattagtaatttttttttttttttttttttttttttttgagacagaatctagctttgttgcccaggctggagtgtagtggtgcactctcggctcactgcaacctctgcctcccaggttcaagcgattctcctgcctcagcctctggagtagctgggattattggtgcgcaccaccaccctggctaatttttgtatttttagtagagatggggttttatcatgttggccaggctcgtctggaactcctgacctcaagtggtctgcccgccttggcttcccaaagtgctgggatgacaggcatgagccaccgcgccctggcagatgaatacatcttatgccatatgcctgaccactccctcagacaaatgagaaccaatgtaatggctgaagaaatggctgcttttttccattgaccttggtgcatagtttctctcctctccttacacaaaaagtaaatttaaatgaacaaagttaagaaggcatattttatgtttataaagctttgattcatggtacaaaatacaagttttcttggagaaacagaagctatttaaaatgtagaatgcagagagttgcattgagccacattccttcttttatctatctcatgggaattaacagacaatgaaaatattgactgtgtttatgcttaattttccctcacccttaatacatttttctgttatgattaattactttcctgtaaaattttgaatgaaattatttaaagagtgctatagataagtgtgtttttactaattttcattattcaccattgtggtataaaatcaacaggtacaagtcaaattaagccctgctgtctgcatgggtactcattattaaatatgagcgatttgggccttcagcaaacgaccatttatattccaaatcgtatttaaaattaatttactcttttatcagaacaaagaaaatttcacacacacaatctcttttactaaaaaataaattttatcataggaaattatctcattttatattccagagcagaaacatacaaaggtgagatgaatctttgtacaatatgtctttctgtcaaacattctaaaacattgtcaatttcattttttctagtattttcaatatttattttgtgtttggcaataaacggagctaatacgaccacttttctcttatgcttggttattattattttaagaaatgaaaacttataaatcatatagcttggaagattgctggcagaataagaaaaaataattttatcttttgtatacatgaaaagtttaaaatatcaaactataataattagtaattacatatgtaacctaggttacatgtatgtatgaggtatggctcacacccatcatcccaggattttgggaggccaaagttggaagattgcttgagaccaggagtccaagaccagcctgaacaatgtagggcaacacatccccaggcctgggtaattttttatggctccatttaaagaagcagcatgacaatgaaccttagatgtcatccagttgagttctcctacttgagcatgaatcccgtcttaaccctcagtttagcaaaccctatcagttatggagagcagataaatctcagcctacttaaacatgaagacagaactcagaaacagttcttcaaggcgctgccccttgttaagctggttctttaagaagcttatccgccaattcacaattctgaagcacagcaaagctgtttctgtattggtgttaattatttattaatgcagtgaaaacactttaaattcctattaaattgtcactaattacttgtgaactaaaacgtaagatgtttagttttttgcttccttctgagaaaatatatttgtatcgccatctttgaagtcagttctactgtaaagagcgtgtatttgggaatcagaaaaaactagatcgaaactgtttgtgttttattgggcaagctacttaaacactttgaacatcatcaggtttttaatttatgatgtaagaagttcagacgaatgaactgagtttatttgcctgcttaaattaaaacatatagaatccctatgtttcccccagtctactcaaatgttttcattgcagtatcaatgccaagaatattgtcactgcatagcaaagcattggagtgaagtagctgatatgtattggatgacttagtttcaaaagctgtttttcctataataccgtaattccttcctcaaacggaggcaacagaaattgcagtagagttcccttgccaactacaaaatgttccatttcattctgcttttctccatttcctagaatcagttacatcaatttgaatctaactagactaagataaaacatgatgaatatgtttgtgaaataaaaacttgacaataaatccttaagatttttctaagaaagaagtttatgaaacttcagagaataggagaatatttcctaataaaaaatagaaagcatgtaagaatatcttctgtcttttaatacaacaaaccaggggcctgcaaactgtatctcatgggccaaattcagctaggtgcttttttgcgtagcccttgagctaaaaatgatttttaaatttataaatgattgaaagaataaaaggataataatatttcatggtgcatgactatatgaagttcacgtctcagtgcctataaactttattggaacacagccatccccatttgtttatgtgttgtctatgttactttgagagaggtgagtggcagccacagaaaccatatgtgtccaataaagcctaaaatatttgctacttagaccttcacagaaacaatttgctgccccatgttcaataaacagctgaaggcagggatggtatcaaatctcaacacctgcttaagtacttgacacatagatctgcacagaatgagtaacagcagaaagaatagatttaaaaaattaaaattattttctcattataaaaaggaccaaatatctataatttttaaaaagccaatagacttacacataagatctgtaatgtaaaactactagaaaaaacacaggtgaatatctatgaggtataagtctgggcaatgattattttggatttgaccccaaaagcataaacaataacagcaaagatagacaaatgagattacatcaaaataaaaatgtcgtgcacataaaaggaaacaatggaatgaagagacagccctatggattgggaaagaatatatttgcaagccacatgtctgataaggggttgatatcccaaatatataagaaactcaaacaaatatatagaaagaatacaaataatttgattagaaaatgggcaaaggagctgagtagacatttttcaaaagaagacacaaaatgaccaaaaggtatatgaaaaaatgctgagcatcattaattatcagagaatgaaaatcaaaaccacagtggataccacctcactcttgttaaaatgactgttgttcccctccctttgtgcatgtgttctcactgttcatcttccacttataagtgagaacatgagatgtttgattccctgttcctgcattagtttgttgaggataatggcttccagctccgtccatgtccctgcaaaggacatgatcttgttccttttgataggtgcagcaaactaccatggcgtatttacctatgtaacaaaactgcccattagcacagaacttagaataaaaattttaaaaaatgagtgttatcaaaaagaaacaagagaacaagtgttggtgagaatgtggagaaaaggaactcttaacacactgttgatgggaatgtaaattagtacaagcgtaatagcaaacaatatggaggttcctcagatattaaaaatagaactgccatatgattgagcaatcccattactgggtatactgggaactgaaatcaacatgttggagagatgtctgcactcccatggttagtgcagcactattcagctttacaaaagaaatgttgtcatttgtgacaacagtgaaattggaaaacgttttgctaagtaatataaattaggaacagaaagtcaaatacgttatactctcacgtatatgtggaatctaaaacagtcaaattgaaagaagcagagagtagaatagtggttatccgagacgctgggagagaggggaatgaggagttaatggtcaagggtacaaagctttaattacacaagagaaatacattattctttgggatatattgtaaagcatggtgaatataggaaataacatattgttatttcaaatgttctcaccacaaaatatggtatttaagatgatgaacatattaattagcttgatttaattattcaatattgtattcacgaactataacaccagtttgtgtcacataaatatatacagctataatttatcaatttacaattaaaaaataaatgaaataaaattggatttaaatgaaacagtgaaaagtcttcatatagatgacaagcacaataacttcattttaaaatttataataccatgaacataggaattcccaggagaaaatttaggtttatgagactatatccattgaaaactctgttggacattttttctgaagttgttcagttttagacctgaaacaattatcttttatcatttaataaaaatggattagaaaatcgctctgtataattaatagtttgacctagtcttctatgatggtttattgattgtttcaactccagagctggctagcaacatgaaactctcatggaaaacctgtttataatgaaggatgcttctgaaacaatatacactattatatcttgattgatagttaacatttagtaactaagtacactagtacatttgacttacaggccatcattttcccttaggagacagtaactttgagtctatcccattcatctcctctagaactttgtcaaacagaggtatatatggcttttgatgctctcctttcatttcacgttgttctttcatgtttgatttgcttaatgctcattgggtttctttttaattcctctaaattatctaatttgaaaaaataactattattaatatactctcaaaaactgtagaaaaaataatttctaaataatttaaaaggtaaaaaatatcaacatggagaccttccataatgtaaaagtggttctttttttaataaagccttttctctactcatttaaaaaagtggagttggaggggctgcctttcaaaatttccacataaaagcaaccaaaaatttgttctaggaggagcactgatggcagtttctgaaaagatttccgtgacaccttagataagagtgaaaaaatcaaccccataaggaatttgtcttcattcactccatactttctggactgggctttcccttctggctagtgattagagctgacagacaattcgacagaatcacaaagtggagaagttctttttaaatacaagttaatggttttgtaaatttagtgccttaagcaaaattgaattaaacattcagtcattcatcttaagcatccttaaaaattgaaagcttcacaatatgcccagaacccagaaattcaagtaacttttacccagagcctacccagccggactgcgcaaaggactgatgagacgaaaggatatttggacgctgccctctaggaaaggtagcctagaagaggagaggacactaacagactaacgactccttcagaggggaggaccacataatcagccaatgtcagctggcccagatccaaacagctttctgcttatgcaaaccttgtgtggtcgttgtgttaactaatgcaaagatatatgattaatgtacttgtcagtgtcctgtgtttagttttctcacaaaacatttcttatataattgagataattactttcacttacaatgccattggtttaagttttaattgataatgatgactttacttttcagtttaccactatagacttttatttttagagtaccattcagagtcagagcctgaaccttagagaattaaactcacttaagattgaagtagtagtcatttcatactttgtgtatttatccatgttttgagctaattccagaatgttgtcagtcatattgggatgcgatatagtaatttggtttttaagtatgattttggaactctaagttactaaaatagtagcttaatttttgttcaccaaaagaatttataactgaaacttccattagagattatatgctttttatttactacttttagccattaaccaattaattataaaatatagagattttatgttttcatctacatatacaaaattaccattaagatgaaagtaattgaattgattgcatattcagttatagaattccaaatttaagtagacacagaaagtcataagtttacatctaaaaattcacgaggtagtcagtcatagtcactacattttagccaactatggaacgtgtactatcatgtactatgagtcagtccctgtactgaagatatcaaaatgaatttgacaatctggtataaaatccaggactattatttgtactgccagcctcagggagagatgaataaaatggatttgtaagttagaggctgcaaaaactgttttttttggtttgttttgctttttgtttgtttgttttcctgcaaaagcatgtattcagggtacaggtggtggttctacccttccagttttctaggctggctgatctttataacttgttgttcataaagatgtatgtaaataagcaccatgtctcaaatttagattgagaattgttctcccagagtattcaaatttttaagagataaaacaattaaaatctaaaatatgtgataatctaaatacatattatacccccattcacccattaaaatattttttcttgctaataaaagaaaaaatcgtttttatggattttcctatccctcaaaaataaggacaataacattttgcctatttttaaaagatattggttagatgaatcttgtagatctagctcaattgttcccattctagaaagcttagaattattatcctgaaagcagaaataattgttaaaaatgaaaacatgaaaactttacataaatgacttcattttcacctcgtaaactttattgcacagcaccgcactccagcctgggcgacagagtgagactccatctcaaaaaaaaaaaaacaaagaaaagaaaaaaagaaaaattttattgatttagaatgcttgacagagcaaagtgaagctgtcctcacagggttagtaagtattctggacagaaacatagttataattaagcattagtcaggctgtattttgacctacttccttacaaccaaagtcacatagcactagatactgaccatttgcatcccattgcttgtatagataggattctgatgtaggatagataggatctctgatgttggaatcacaaggctttttaggaattgcttaagcagatcctaaattccagcagaacagcggaccccagccagtttgaagacactcacagaggaactgagtcacctgagaatagtttctttatctccccattccatgacctcaccctgcactcttcaaccaattcatgatctccacactttgggctacttcagagcctgtgaaaaccctagtcccagactccccaaggtgatgtgtgtgaggttttctcctgtctcctcctttggctgccctgcaatgaaacccctttctttgctgcaaactggtgtctccatgtattgacttgttgagcatcaggcaacagacatatggttacaaaagcagaattttctcttgagtatttagagagctcctaggctgttctgattccaggcagcagacttcaggaggtagcatttctaattttctatcatgatgttaagggaaatatgctgcctgataagtgtttggatattggatattgcatggttgtcccatgtcccagtaaaacacacatttttgctttgtcctggtaattaacaatacaaacaatataaattaatttggccacgtattttagtataaataacacagttacaaataatggtctgtttgtcatcctgtcacctaaatctaaaataccgagatccagatgaaatgaaagagtgcacattttaagttgcataaattatatatatgtatgaagacttaaagttcagattttcagaaaactaaaaagttcttaatcatttttagaaagtagatcagcaaagtactgagttattttgtataaagattaaagcaggtattatctgtgtgtgtgtgtgtgtgtgtttctgtgtgtgtgtttgtgttgttctaatattaatagaaacaatagaaacaatatttctttaatattacttttcaagaagatagtaaaagccaagaagtaaaagtgttttaattcttgagctgttaattcaatttttttcttgaatgattgaatattatttccatcatttgttcattgtaacatttcccaatacttatagatgatatatagaaaaacaatttaaattgaaaatcattaatttcccagtgcatttcctaatatatctatattcagatctgtatgttttcttgttccataaagaaaaagataccttcgtttttttcaaattaatatcaagagcattaagttttattgaactaataatcttcagtgttgtctatggatttaaattccattttattgccattttgggagactaaagacagaaagagaaaaggaagaaatatagatgggtgatcaaagtaggtaaaaccataaagatgtgtgaaataaaagtgaaatagaagaaagagatagccaaatgaggaaaacaaatcacagaagagaataaaggcatgtaaagcatacaaaactagaaaaagtgcaggaaagagaaagaaataggtagataatatagaaaaagttttgaaagtttcagtaaatatgataaggattccatgtaggtaataactatcagagagttataaatttatatgtacttctttgaaatgtatagtaattggcattaatagcttttaggttattccaatgtttatttgtagtgctatactcataagcataccttctataaataagcacattctttatgctagaaagataatgaaagctctatctggtaacttgttttccatgttgaatgctacaaacacactctctaaacgtgttaatgtgaatgtgtgtacccttgcatacacagacacacacgtaaataaaaaaaactttattatatgaactgctagcacaaatatgtgtattttgtttgaagaaatactctggtaagtttcttgacacttactataaaacgtgagatgctgtgagcatgaaagaaagtggtcattaacatacccaaaggaagagatgatccttctatgctataaggaaaggaaactattggttttcttacagaaaacaggaggtagaatcaaagaataaggcaagggaggacaagagaaaaagacagtctgggactttgtgaagagccactatttgcaagttgaatgtggttttttgctttgttttgttttgtttttcttgctattattgagttattgttctgtgtttcttcacgagtcttcaaaaagtctatactgttcacagtgcttggagtgacagggttttcctgcagaaggctacacattcaagcataaaaaaagaatgtacagcagcttagctcaagaaacagaagatattactagtaaatacatcacccccacagctttaataactgcccaccccctgcaaaaccttaggaaaagtttggaaaggatttgacatctataatctgtaaagttgcagtaacagcagagtctcaaggcaattttgcctaaatttctgagaagctgagggtcatgaggttgcaaagccttctgtccagatgtggggctatcaggggatttggagtttagctttgtttggttgttccctatctcatcaatttacttttcacaaaatctgcctctgaacgttcgatccactgtgaatatgtttgaagcatgtttttgaatgcatgttcaacactggagaaagtagattacagttctgctcttggacagctctggtccagcactgcaggtggtgaatgtaagagtgatagtgatgtgatctcttagagaagaatgatgtgttaattaatttgaggaatggaagagcatgcccttgacagtcactgtgacttgagtttgcgtgctagcacctccatttgagctcagatttatttaccttgtaattcctgtagaatatagatgatatgctgtacttcaaaatttcattgtgaatattaaaagaaataatacggccaggtgtggtggatcacgcctgttatcccagcactttgggacacccaggtgggatcacttgaagtcaggagctcgagaccagcctggccaagatggtgaaaccccatctctactaaaaatacaaaattagccaggtgtggtggcatgtgcctgtaatcccagctacttgggagggtgagccaggagaattgcttgaacccaggaggtggaggttgcagtgagccgagatcatgccactgcactccagcctgggcaacacgagcaaaactccatctaaaaaaataaaaataaaataagatagaaataatacacacagtgttcttagcaaattccttggtgcacaattatatggtagttattattatcaaaattataaagcagaaaaaagtctcaaagccaatgattatttatttatttattttagagttggagtcacggagtgcagtgtcacgatcatagctcacagcagcctagaacccctgggctcaagtaatcctcccatttcagcctctgaatacctaggactaaaggcatgggccaccatgcagctaattttttagttattttattttattttattttattttgtagatacagggtctcactttgttgtccaggatggtcaccaacactggcctcaagcagtcctcctgcctcagttttccaaaatgcagggataacaagcatgagccactgcaccaggcctgggaacttacagcctagtatattccgcaattatggagggggtacgacttatgtgaaaccttcaggaatgcatacccttttagagagaaataagtcttaagttagagatgagaaaaagcatgggaggctaccttctgaatattgaaggtaggtgtaagattataatggtagagaataagttcagatatgaagaataggcctaggttatggcagaccttgaacttcagagaaattttagctaaatatgaaggttagaaagagccattatacatttcagaccatggaagtaatataagctggtcgtttagaaaatttcatcaattgcgttatgcaagagtaactgaagttcaaagagatggtttttgagaaggtgactggaaggatttgcagttatcaagaaatgaggtgaagaggacttggagtaattttggctgagaaaaataaacctttacatacagctctaagtctataagaacaaagaatatataacaatccacatgtagagtataaaataataagaatgctatcagtaaaacaatagtgaaaaagaagcatcacatttagtccataaattaaatcgtgtccttaacttagtataaaaagatctaaggattatggtataaatattgcacactttttatgtggtggacatgaaagcaatttctgtgagtttaaccaatggaaaattggtactcttggataaatgattggccctatacttgaaccattaaaagagagaacattaaactaagtagacataattttgagagttccactacattaaaattgaagaacagcttactaaaaacagccagacttaagggtaccatattgtataaaaatgttatattttccatattataaatggtttggctgatagatacttaagaggaaaaatatagccagagtcttttaggttggccatatagtttcaagttttcaagttatcgaaaatcaacccatttatttatttaaaactcatactcacctgcttggagacataatttggaaatttataagttgtatatacaacttcataaaatctgaagaaataaatcaaaataggcattattgaaaagcagcaacataaatgtatgtcattgggattctacaatgggtttgctgtaattatatcgtacattgatgttaactctcagtttcctgacagctaaaacaaagagaaaaaaatattataggtattaaaatgtttatacaaatcatttaaatctgcagagacatgcatgcttgtatttaagtgctgagggtggactgttcaacataacagatgattagctttcacctgaattttacaaacatgctatttaaggcaacaaatacattaattctatatagaagttaagagaccatacttcagtggagggatttccttaagagaccagcagacccaacattccaggtcaacagaatcaaagcaaatgctgtttataataatacaatttagggatagttgtggtaaattttaatgacatttccaaaaccaattggagcctatgcaccttaatttgaaacattgtgaaatggactcaggattaatttgagaatagaagaaaagaagactattccataatttcttttacagaaaattatttatcttctttccatttaagaagacatacatggtgaccgggcacagtgactcacgcctgtaatcccagcactttggaaggctgagacgggcagatcacaaggtcaggagatcgagaccatcatggctaacatggtgaaaccccatctctactaaaaatacaaaaaaaattagccaagtgtgacggcagatacctgcagtcccagctgctagggagggtgaggcaggagaatggtgtgaacccgggaggcggagcttgtagtgagcccaaattgtgccactgcactccagcctgggtgacagagtgagactctgtctcaacaataacaacaacaacaacaacaacaacaaaaagatatacatggtatcatttcaagaccactgcctacctataatgtccaaagttgcatgaatgatctccaaataaatgcacatgtacattcacagtggtgcaaggaattttctggaaggagcaaacataaacacgggagggacagcctgtgtgctgggtgtggaagtaaccaaagaaattgttgtggtattgtgaaggaggttgatggtaaacctcttgtcaactaatgaaagaggaatgattatggctaagttgtaagttccacctccctcctcatttccaaaaatttcctgttcaagctacctcgtaggacttggaaaaggtacaactcttcttccactctttctgaaaaattaatgggagtctgttttccacaaggatagaagaatattatcctgagtagtttgtcagtggttgtagtggataatttttagtgtacagcaaaaatataatgacatagtgataggacaaatattttctgcaaagcaaaaagaaagtaaggcatcatatacaatttgttgctacatgacaaaatgaaagatttaaaaatttaaaatttatgcaccccttttcagtcccatataatagaagtttgttttgttattatttacagatgatttaaaaatatttagacaatcgcaacttctgtatccatcaatttggtaaggtaatattaaatgacacaacttgtcaactaagttagtcaaaatggtttatatatgtgatctttcattcacttagtcaaaaatcttaagtgcctattgtatggcagaaatattaacagctgacacatatagtatctattctatttcagagatagtattaaatgcctgatgtatattaacacatttaatcctgacaaagattcttcaagatttatggaaggaaaaaactgaagcaaaaaagctaagtaatttgcacaatattgcgtatctaaaacgtgttggagttgagatatgaaaagacagttcaacgttagaggccgaactcttaaacagcacggcatatggcctcttgagtcccgagtgataagctcagaataaaatgtgggtcaaaccatacaattccagccataaaagtgatgaatgtagagctcttaccatcaccatcatcatcttattattactatgttattactttgctcttacagacatgtgctatacttctgttactagaaattcatctctggagacatatttgttattcaaacaggtgaaaaagttatccccataaaaatatgacctttgtaataaatgtattattcaacaagagttaccagttttctgtagtatagcagacacagcttttggctggtagaaacaggtaagtacatgattaaatctaaagtaataggtactaaagtaatggtattgagattcagagatgggagaaactaggtacacctttgtgtgcatgtgtgtgtgtgtgtgtgtgtgtgtgtgtgtgtgtgcgcatgcatacatgaacacgtgtcatgggagacatgggtagggattcacaaagggattgagaaaatcaaaagtgatggggaaacaagagaaaagaacactataggaaatgacacttaggcatagcttttaaatctgttttcaaacatgaacaaaaattgagagaatgacataataaacactcatgtacctctcatttgcctcaattataagcaatttgccagtctcaaatcatgtaccctcctcagtttttaaaccttattttaaagtaaatacaaaacagaagttttttttttaattattgtagtaagcatacaacatgaaatctacccttttaaaattttaagttcacaatacattgatgctagctataggtagaatgttgtacagcagttctgttgaacttattcctgttgcataactgaactttatactggagcaggtttttcagtttccatgtagttgagcagttttgagtgagtttcttaatcctgagttctagtttgattgcactgtggtctgagagacagtttgttataatttctgttcttttacatttgcttaggagtgctttacttccaactatgtggtcaattttggaataagtgtgttgtggtgctgagaagaatgtataatcttgatttggggtgaagagttctgtaaatgtctattaggtctgcttggtgcagagctgagttcaattcctggatatcctttttaactttctgtctcgttgatctgtctaatgttgacagtggggtgttaaagtctcccattattattgtgtgagagtctaagtctctttgtaggtctctaaggacttcctttatgaatctgggtgctcctatattgggtgcatatatatttaggatagttagctcttcttgttgaattgatccctttaccattatgtaatggtcttctttgtctctttcgatctttgttggtttaaagtctgttttatcagagactaggattgcaaaccctgctttttttttttttttccatttgcttggtagatcttcctctgtcccttttttttgagcctatgtgtgtctctgcatgtgagatgggtctcctgaatacaacacactgatgggtcttgactctttatccagttttccagtctgcatcttttaattggagcacttaggcaatttacagttaaggttaatattgttatgtgtgaatttgatcctgtcattgtgatgttagctggctcttttgctcgttagttgatgcaatttcttcctagcattgatggtctttacaatttggcatgtcattgcagtggctggtaccggttgttcctttccatgtttagtgcttccttcaggagctcttgtaaggcaggcctggtggtgacaaaatctctcagtgtttgtttgtctgtaaaggattttatttctccttcactcatgaagcttagttcggctggatatgaaattctgggttggaaactcttttctttaagaatgttgaatattggcccccactctctgctggcttgtagaatttctgtcaagagatctgctgttagtctcatgggcttccctttgtgggtaacctgacctttctctctggctgcccttaacatttttttccttcatttcaactttggtgaatctgacaattatgtgtcttggagttgctcttctcgaggagtatctttgtggaattctctgtatttcctaaatttgaatgttggcctgccttgctattttggggaagttcccctggataatatcctgcagtgttttccaacttggttccattctccccctcactttcaggtacaccaatcagatgtagatttggtcttttcacatacttccatatttcttggaggctttgttcatttctttttactctttttttctctaaacttctcttctcacttcatttcattcatttgatcttcaatcacagacaccttttcttccacttgatcaaataggctactgaagcttgtccatgcatcacgtcgttctcatgccatggtttttagctccatcaggtcatttaaggacttctctacactgtttattctaattagccatttgtctaatcctttttcaaggtttttagcttctttgcgatgggttcgtacatccttctttagctcagagaagtttgttgttgccagtcgtctgaagccttcttctctcaactcgtcaaagtctttctccgtccagttttgttccgttgctggcgaggaactgcatacctttggaggagaagaggcgctctgatttttagaattttcagcttttctgctctggtttctccccatctttgtggttttatctacctttggtctttgatgatggtgacatacagatggggttttggtgtggatgtcctttctgtttcttagctttccttctaacattcaggaccctcagctgcaggtctgttggagtttcctggaggtccactccataccctatttgcctgggtatcaccagtggagtctgcagaacggcaaatattgctgcctgatccttcctctggaagctttgtctcagaggggcaccctacgaggtccataacaaaatggaggcagaaataaagatgttctttgaagccaatgagaacaaagacacaacataccagaatctctgggacacatttaaagcagcgtgtagggggaaatttatagcactaaatgcccacaagagaaagcaggaaagatctaaaattgacatcctaacatcacaattaaaagaactagagaagcaagagcaaacacattcaaaagctagcagaaggcaagaaataactaagatcagagcagaactgaaggagatagagacacaaaatacccttcaaaaaatcaatgaatccaggagctggttttttgaaaaaataaacaaaattgatagaccgctagcaagacaaataaaggagaaaagagagaagaatcaaatagacgcaataaaaaattataaaggcgatatcaccaccaatcccacagaaatacaaactaccatcagagaatactataaacacctctatgcaaataacctagaaaatctaaaagaaatggataaattcctgcacacatacaccctcccaggactaaaccaggaaggagttgaatcactgaatagaccaataacaggttctgaaattgaggcaataattaatagcctaccaaccaaaaacgtccaggaccagatggactcagagctgaattctaccagagggacaaagaggagctggtaccattccttctgaaactattccaatcaatagaaaaagagggaatcctctctaattcattttttgaggccaacatcagcctgataacaaagcctggcagaaacacaacaaaaaaagagaattttagaccaatatccctgatgaacattgatgcaaaaatcctcaataaaatactggcaaactcaatccagcagcacatcaaaaagcttatccaccacgatcaagttggcttcatccctaggatgcaaggctggttcaacatacacaaatcaataaacgtaatccatcatataaatagaaccaaagacaagttggcttcatccctgggattcaaggctggttcaacatacacaaatcaataaatgtaatccagcatataaacagaaccaaagacaaaaaccacatgattatctcagtagatgctgaaaggcctttgacaaaatgcaacatcccttcatgctaaaagctctcaataaactaggtcttgatgtacatatctcaaaataataagagctatttatgacaaacccacagccaatatcatactgaatgggcaaaaactggaagcattccctttgaaaacgggcacaaggcagggatgccctctctcaccactcctattcaacatagtgttggaagttctggccagggcaatcaggcaagagaaagaaataaagggtattcatttaggaaaagaggaagtcaaattgtccctgtttgcagatgacatgattgtatatttagaaaaccccatcgtctcagcccaaaatctccttaagctgataagcaacttcagcagtctcaggatacaaaatcaatgtgcaaaaatcacaagtattcttacacaccaataacagacaaacagagagccaaatcatgagtgaactcccattcacaattgcttcaaaaagaataaaatacctaggaatgcaacttagaagggatgtgaaggacatcttcaaagagaactacaaaccactgctcaatgaaataaaagaggacgcaaacaaatggaagaacattccatgctcatggataggaagaatcaatattgtgaaaattgccatactgcccaaggtaatttatagattcaatgccatccccatcaagctaccagtgactttcttcacagaacttgaaaaaactactttaaagttcatatggaaccaaaaaagagtcagcattgccaagacaatcctaagccaaaagaacaaagctggaggcatcacactacctgacttcaaactatactacaaggctacagtaaccaaaacagcatggtactggtaccaaaacagagatacagaccaatggaacagaatagagccctcagaaatactaccacacatctacaaccatctgatctttgacaaacctgacaataacatgaaatgagtaaaggattccctatttaataaatggtgctgggaaaactcgctagccatatgtagaaagctgaaactggatcccttccttacaccttatacagaaattaattcaagatggattaaagacttaaatgttagacctaaaaccataaaaaccctagaaaacccaggcaataccattcaggccataggcatgggcaaggacttcatgactaaaacaccaaaagaaatgacaacaaaagtcaacattgacaaatgggatctaattaaactaaagagcttctgcacagcaaaagaaactaccatcagagtgaacaggcaacctacagaatgagagaaaatttttacaatctacccatctgacaaagggctaatatccagaatctacaaagaacttaacaaatttacaagaaaaaaatcaaacaaccccatcaaaaagtgggcaaaggatatgaacagacacttctcaaaagaagacatttatgcagccaacagacacatgaaaaaatgctcatcatcactggccatcagagaaatgcaaatcaaaaacacaatgagataccatctcacaccagttagaatggcaatcattaaaaagtcaggaaacaacaggtgctggagaggatgtggagaaatagaaatgcttttacaccattggtgggattgtaaactagttcaaccattgtggaagacagtgtggcgattcctcagggatctagaactagaaataccatttgacccagccatcccattactgcgcatatacccaaaagattataaatcatgctgctatgaagacacatgcacatgtatgtttattgcggcactattcacaatagcaaagacttggaaccaacccaaacgtccatcaatgatagactggattaagaaaatgtggcacatatacaccatggaatactattcagctgtaaaaaatgatgagttcatgtcctcttagggacatggatgaagctggaaaccagcattctgagcaaactattgcaaggacagaaaaccaaacaccacatgttctcactgataggtggtaattgaacaataaaaacacttggacacacggcggggaacatcacataccggggcctgttgtagggtggggagacgggggagggatagcattaggagatatacctaatgtaaatgacaagttagtgggtgcatcacaccaacatggcacatgtgtacatatgtaacaaacctgcatgttgtgcacatgtaccacagaacctaaattataataataataataaagaaagaaagaaactttgtacttactgaacagcaaacaacagactatcttttaaacccattttactctgcttagttttaaatattgagtgcaggtgggagaactagatatgagaagaaccacctttttattattggaaatgaccaagggcattgttttggttaaagtaattttaggatgtttccattgaccattgatatcttacatacatttcctgttttaacttcggagcgagtcattttgaaggattttgctggactttcagaacgtgtgatttgttttaacggtgctctcgggctgccatatgtgtttatgtaggctgtgtcctgaagaaggggtctctgttagggggtatgagtacgctgaaaatgaagcactctccaagcagcacagaggtgcattttctcatctgcagtaaggcatcttagcggccagtggtcctgacagcagcaagtagatctcaaagccatttcacgggccttctcatattcacactaattctaaatcagacttctgttaagaaaggagaaataggtggggcgcggtggctcatgcatgtaatcccagcattttgggaggctgaggcaggtggatcacctaaggtcaggagttcgagaccagcctggacaacatggtgaaaccctgtctttactgaaaatacaaaaattaatcgggcgtgttggcgggcgactgtaatcccagctactcggaggatgaggcaggagactcgcttgaaccctggaggcggaggttgcagtgagccaagatcagcccattgcactccagcctgggtgacccagtgagactctgtcaaagaaaacaaaaaaaagaaagaagaaaggaaaggaaggaaggaaggaaggaaggaaagaaagaaggaaggaagggaaagaggaaatagaatttaacaatttgaacaaaaaaagggggaatagaatttaacaatttgaactaaatacaaataaagtcctttgctgctatcaaaatgcaattgtgacatagagttagtgcaaatatgttattgtgtaatgactgtgcaaattgcttttctgtatgtttgtcttatataatattgacagtactacatagtgtgtcaaaaaactaaacttggtatttttaatgctaaaatgagtaaacactaatcagaatgccagcaggtacaatatctttgaatgaaaataacacattcaaactgctgtttctgttctctttggtacacggtctgcatagttagtatgataaatgcgaatagaattttcatgctgacatttaattaaaatgaaattacctatcattgttacccactacacagaagctattatttatgttgatattattctaatattgtattaagctgatattgaatttgtatcagtgttttttatgaactgaattatttctgattcctcagttgtttttaaaagccaaggagtagatactattgcattgtgcgtggatagagcatattttcctcttatttgaaaagttagaggtggaaatcatgtagttcagtgtaactataattgtactattttcctgtttttttttcttttgtcttctttggctattttgatgccttttaatgcatccccctgttgatgtacagtttaatatctgatataacactaagattaattttttaattgttaatatatctttgactagtctttccctatattattaccattgtgattacttttacttactacgatcaaagtagcaacttgtagtcagatagcagtgatattcacggtctatcaatttatccattcatccatttatccatcctacttttcttcccttcccccatccatccattatgtactgtggatttgcactgaagtcaattggaattaagtattataaaactctattttactaatagccatataaaacccttaagaggcaattcagacattcacaatacttggaattttaacagttacctctattgactattacaatatagcataatctgtaaaatcactctggcaaaaatgtgtatctatgttttagttctaaggaagcaccactcagtacaatgaaacaggaagaaatgctagtgatttacattgttcttgaggaagttaaaaaaaatcaattcattgtgattctgaagctttctctttaggtcagatattgttatattgataacaaagcaatgacaccacacagtttttgtgctccaataaatgtgatttcaaattttacaaataaacatttttcccttttaaaaagtatatacgtctatctgtttagttggacaaatgaagacaaagcaaatttctgtgacccaaatccaagtctgagtactcaagtttgggtttgtacagtttagtttaacttaaaaacaagtgacttgttcatttctacgccacaaatacctaaaacaacaaatattacacatcatttttggttgagaggaatgactaaatcattgtttctagtgattgcttcttatgacaaatcaacattgtttattaaaaatatgagattttatagaggtcaggcatggtggctcagacctgtaattctagcccttgggaagcggaggctggagaatccctcgaagcctggagtttgagaccagcctgggcaacaaagcaagaccttgtctttacaaaaaaaaaaaaaaaaaaaaagaaagaaagacagaaattaggaaagaaagcaaagaaagaaaggaaagagaaagaaaagaagaaaagaaagaaataaagaaagaaaaagattggctgatctgagtgcagtggtgtttacaactaattcatcacaaccagttacagagatttatttgtcccatctctacacctaactccttcatttaactagaaaaatatatatatatattagattttataagaaggaaagtagaacatacaaataatattaagtacttatctattacttgagatataccaactagggaagacagaggaaggacaatcaatataaatcatatttaaacaactactctagtaaattgatcaaagtctggttagtattatctgctttaagtttttctaaggattttcaatgagagaagaccgtatcatttccccacaacccaacctatccagcgtttttctggaagaggctattagcaacacataagctgccagcaatgtaaaatccccttatttgctgccttaacatttgggataaaaagtgttgacaccattattttttaacctcgatctcattgaggaacttcctgaattttctaacatcaatttactgctaaagatctatataataaggagattttgaatgttaggaacctgtgattatgggtgagagttagttgatgagagggtgagagttagttgatgagaggattcgaagctctaacatctcggaataactggtaacacatatctttgcaacatagcttcatttcactgttaggctttggtgtgttggcgattttttatgtgtgtaattaacatattttattgacaatatttatgtatatctgtaattacatatatctgtacaatgtgacatttaatctatgtaggcattatagaaagtttcagtcaagtgaattaacatgcccttcacctcaccaatttatcacttttctgtggtgagaacattaaaactttttaaaaacaaatctgaaatatacattattattatctgtggtcaacatacaatgcattacatcactaaagttcattccttcagtctaactaattctttgtacctctgattaacatcttctcttccctccactcctagtttctggtatccacatttctattccttgtttctgaaatagaccactttagagtccatatataagtgagatcataccgtatttgtctttctgtgtttagcttatttcatttagcatattgttctacagtttcatccatgttattgcaaatgataaaatttccttcttttttaagggtatatagtattccatagtgtatatatactgcattttctgtatgcattcatctgttcctggatacttatattgctttcatatcttggctattgtgaataatctaaaagaaatctgggaatgccgatatctccttgacatacagatttcactacctttggaatatatccagaagtgggattgctgaatcacatagtaattctatttttagatttacgagttactcccatgctattttccaaaataggtgtactaatatactttcccatcaacaatgtacaagggttaccttttctccacatccttgccaatacttgttggcatcagtcgttttgataatagccattctaatgggcatgtggtgatatcccactgtggctttaatttgcatttctctgatgattggagatgtggagcagtttttcatatatctattggccattcatatctcttcttttgagaaatgtctgttcagattctttgcacattttataattgggttgttttcttgtcatgagttaaattcctcatatgacgtggatataaacccctcatcaggtgtatagtttgcgaatattttctttaaatctggtttctctcttcatcgagttgtttcctttgctatgcagaagctgtttagtttgaggcaattccgtttgtctatttttgcttttgctgcctgtgcctttggagttccatctaaaaaataattacccagaccaaagctgtggagatcttcccctgttttcttatagtatctttgtagttttaggtcttatatttaagtcctttatcaattttaaattgatatttgggcctggcacggtggctcacagctgtaatcccagcattgtgggaggcagaggcgggcagatcacctgaggtcaggactttgagaccagcctggccaacatgctgaaactccgtctctactaagaacacaaaaattagccaggtgtggtagcacatacctgtagtcccagttactcaggaggctgaggcaggggaatctcttgaacccgtgaagcggaggttgcagtgaactaagatggcaccactgcactccggtctgtatgaaagaaagagactccatctcaaaaaattatatatgtatatatatataaattgatatttgtatttctagtgatatggggtctgatttcgttcttctgaatatgaatattcggttttcccatcagcatttgttgaataaaatccgtcatttcctattatgtattcttgtcacctttgaaagaaatcaattgatcataaatacttgagcttattttctgggctttctaacctgttccattcgtcagtgttcctccttaatcagcccagtcagagattctaagtgcctctaagttttgtgtttgtccagcctgctgtctttgttcttagtggccccaatacatgggagagtatcaagttgtgctatcgccttgagagacatttgatagaagccagtccctaggaatgtggctggagaggtcggggtgttagatgcgtgttccagttctttctgtctctcttttcagagaagctgagagccagagtttctttctcatccattctgccttactccaaggaatgaagctgagatagatgcctgtacccttgatcatactgctcactttgaacctggggagatacttgttgaatgtttgcaagtttaaaagtcaccttttgttccctgtggtctaggagattcaggagcgtggagttctgtcaactcccagagccaggtgatttaggagccagtcccaagcaaagactgtaaaagttgaagtatttgatgcatgtagaaactgcctccagggagggtcttcagatctatatttactgctgggtcaagctggggaagaaggtgcagagagtgcccacagtcctgcttgagcattcagaagacgccctccctcatagcaggggagacttctggtctggagtgcccactttcctttaagacatgaagaggtctctctgcttccttccaataagagattgcggagtttatctctagagcaagctgagggagaaggcacaggagtgctgtccctcccagtcttgctgggagaagacttcaactcttcacagagagactgcagggctgggattagcactggagaaagccagggaaggccctcgtaggtgctgtgcttcctgtttaggctcaagttggctttttctttattgctttgtaggctcccagagactgacctgttaaaggccaaaaccacagggaactgctgtgaagccaaaccctctccaggggaagggtggaagctggacagatctaggggctaccgctgctgagagtgccctcagaggcagttcaaattcttctttgtttttgtgcttgagggaaatctcccaatgtgctgtctctgacattctgcaagtggggtgatctaagagcccctcccccttgcagtgatggtaaaagttgggcattataggtgtggtgcaagcctgttacccctcaggaagaagctgggagttgaggtttctttccaaatgtaaggcactgtgctcagggtggggttatgcctgagtgtatctccactttttctactcatttgggtgtattttcatagttgtcaggtgtgtaggagtctttgagctggattctggctttctctgggacagaactgatccactcatggctatttacttggtgtgtctgtgggaggagggagcatcaagagtctcctctctgccaccttgctgacttcctgtgttgaatatttttgacttgtgtttatttacattttgtttatacatttgtattttttcaattagtgatactacaattcatgaattctgctttatgctatcaattatgagtagccttaggttaattgctatatttaatttcctgttacagctatagcttcttgtggcttagaattgccttagaatgtaataattctagcaacaaaagaaaatagattgaaatgggccagacagacattcatctgttctctcttttcataaaaaggaaaactaaaaagtgcttataatttgagatattgctgcccatttgaaattataaaaagtctctaaattaagacataactgcttatttctttcagttttttgaaacaaatcaagtaaactatacacagaagatacatgatcatttctctcatgatttaattttagacaatgccttttaatctttttatttcattttaagttaaaaaggccatttgccttctgtattaattattttgtttatcaagtcatctgtaattgtttgtagataatgataatgtattttgaaagcagctttttttttgttcctatataccccaaatgttacttcataacatttttattttatttttctttcttgatcttcaagtgaaagagataaagcctggtgcttccctttcttgtcagttttagaaattaaaggagagagaaaagaggctgaacaacagatgcaaggtcagattaaatgtctcattagagccttttatgcaaatgctgaaccctgcagtcttgaaccgacagacatttcactgtttgggatcctgatgagtcaagtagagacaaggtaagagtcatattggttatttagataaaagacttaaaccaaaacatagggctgagaattaggaccccgggggtgataaaaaattacatattaaaaaaaattatgtcataagtccacccgtggtgggagataactttcatgaagctgtgtttggtcatgagaagttgctagactccatggtggaacatacttaacatacgtccataagatacgtttacgcaaaggataagcaggatgttttctatttataactgtgtcctgtatgacagaagttttaaatgtgttcaggttttttaattttttttttttttaataaaaactactactccaatcactgtgtggcttctccaagcacacctactctttccaagagctatcactctatcagaggggcactgctgctcttctcacccacctacgggaggtcgtcagaggagggacactgaatccagaagcataggggccttgttcaatggggattcattcattcattcattcaatacatatttacaaatcactcaaactaaacactttcaattgaaaattgtgttatgtaccgcataccatgatggataataccacaacttggtacgtcatagagttatgaagattgataaacatttgtattttcttagtccctttttatttattcatatacattttaatatctgattatcatgtttgaatttcctttgattataatgttctttataaatgcaatacattaaaattagaagttagcagttgactttataagaatcattacaaaatttataattattcaaacaacacaagcaaataggtaatcatctatactaagctctaatataagttccaagacaggctaaatccagtatactgccttgtatttttttgtcccatctttctgagaatctttgtataatttgacaataatgtcaagtggaaagagaaataaatccctctttttcttttcctgcatgttgtacctgagagtgttttttccttttctgacactccttttgtatagttctttcagcagtagcaatttattctaataaataggcactcatcacatgatctggaaactactgatttcgtctcagtctgccacaaatacaattaagctgttctgtttccatggttagccatcctgttttctaaaataggaggtttctaaacctctccattttctacaagttaaaaactggagctattcttttttaattggttcttctgtattggatcaaagcatgctatgcaattactgatgctgtcatattggcagaaagaatacgcagaagttcaagctaacattacacatgtcatctttccttgaagaagtacacacagttaactcaatcaaagcaatgtaaagcttgttttttgaggcattgtttccaataaaaagatgaaattggccgggcatggcggctcacgcctgtaatcctagcactttgggaggcgaaggagggcggatcacgaggtcaggagatcgagacaatcctggctaacacggtgaaacctcatctctactaaaaatacaaaaaattagccaggtgtggtggcacgcacttgtagtcccagctactgtggaggctgaggcaggagaatcgcttgaacccggtaggtggatgttgcagtgagccaagatcgcaccactgcactccagcttgagcaacagagcaagactccatctcaaaaaaaaaaaaaagatgaaattaacatttttatcatactattattggatgtaaactagtgattataatgattatgaaatatatagcaaaatggatcagagttttacacatttagttctgttttgattgtttttcatatttaaaataataaagtgttgagaattctactaaagctataaaataaaaagctttcatcttaaaacaatcttatcattgtagatgatctgattttcataccgataaacatgccatgttacttcattgtcaatatattatacaggcaaaataagacaaaatatacgtcacttaaaaatttaaaaaatgtcttataggcttctgaaaatgattaggcacatactatcactttttcctgtgaaataaaaagagatagtctttaatatttagaatgattgttcaacttaatgccttctctccctatttacaaacactctgtgtttggaaaacacacaccttaagcaaaatgcaggtatatgtaaaagaaacagatcttgtttcaagagagaagatacgaagaaagcatttaaaacagtgaatgtcttcaccattactcctcaaatggagtaatggtgaagccggtgtggagggagtgtataaaatttttgtaacacagttggcaatacctgaatacttaaatatgtaaattgttaggataccttagaattcagtatagaaatgttatatataataatcttacataataaagtaatgcaatacataatatgtatgtataatcttaactcttatgaatgctttgtaaatataaccgattgacagccaaaacagtccttggagacagatatctcttctattatcccattttgcagttgagaaaactgaggcacaaaaggtagagtaatacgcccactgtcacagatccaacatgtcttaggggtgggatttgagctccggcaacctggctctagaggtgttggtctcgaatgcctcaatctttttgttctccatgataagatgtggcatcacagaaccctccttatcctctaggtcagataacttttactgtgcttaggattttaatgtctttctaagacttaaatgataatttttccttctcagcatgcatttaattttgaatacatcatgctattgtactctaagtcatgtatatagatccacagcaataaaaatactttaaaaaacttgtcataattacacattgataaagggatttcactgtcatatcatcattttcagaggctatcatattagtataatttaaaatatagtagtaaaagcttgaatctatgtgtctggataagactttctcaacaagagagattttagtagaccggggtacaaattggacaaacaaatgttagaaaataatgctgaagacaaaatatactcaactcacttcttatagcaaatgtgttaaaagtgtacagctcataaatttgaactcacattgttttgatttcttatactctttgaagccaggcttgacgtatggatgcatatttaagatgtgatcggcttcaaacatgaattgattattctgtttgatgttcattaacattaaataatttgagtggggcactgaatctgattgtgtttattttagtgtgtgttagtgaaaacagatttctgtgtagctgatctaatgtaggtggacagcaagtgtctgggctgtgtctgcattcccatcgttcgggcatggctgtgttgtcagctgctgactaatatgtcccttgagtgacaccacagttctgctacatgaagggaggaaaaggcgagttcattcttttgattttacacagtaaacatgccaatttcctcttaatgtatttcataggtaagcaaaataatgtaactgtcgccccccccaccccagttttagtacaaaaataattaaaactccattaatggttttatttggaaacagacatctgaattaatattttttctccattactgcagcaaaaaaagactctgagtataaattgtttaaaatgttgatgaggattatatcattaaaaaattgacatcatgttttgaaattgtcatttttgtaataataaatcatcatatatttaattttgaatttttttctagctataacctgaactttgcagatattatacctctgtagtttgaggttttgtttctgttttgtgtggtgtcctagagtggctgttgtagttatactccaaaaaagatgttaatgcaaaaatataatgcttataggataaggggtataaatagttcactttctttcccttcaggaacaagttacgtaaattcattattatactgaggcagaatgttatacataagaagaagaaaatggcaccagactaaatagtacctcttgaaatgtttcatttattttcatgttacggttacaatgtgaattgatcttccttcccttcttcccctaggaatctgactctatgatcagaactaatttttttcttccctttaagcatactgagggtttggagatagctcctatggttttcaaagtggtggattgatttaattgaccaaaacatagcagggagtagtcatctgattatacaagtataaaataatacagaaagggattttttatttccactgatacaattcaatcaagtttctttgagttgctgagttcaaacattaaagttaaaaaaattcttgatttataaagaaaataaaagttattttctaaatggtttgatttccaaggaacagggaaaaaatgaaatattgttaagattttctgaacaatgaaataaatattgagtattaaataaaagatataatatcttttaaagaacagatatcagttaagggctattaaaattacttttgttctagagttcttatcagaagctctaccaagtttttcagtgtttacaaacagactaacagaccaatttcataataattttcaaaaaaatattgtaaagtaaagtataaggtaacatgatgtgatttttaaggtcaataatatttttaccttaaagatgatgatgcgcttattaggaaaacagtggggtaaaatagggtagccgaaatgaaaccaaagattaaaaaacaaaataaaacaaaccccaagttatcaagtacttaaatggggcattatttcctttgagtatttttattgtcatagaatcagatataaattatgaaagaattaaaacgagaagtttttaaatttgttttactttttagggatggaaagattagtgccattctatctggttttcactttaaaatcgagaacatccctctgagcctttggagtggagagaactcactgtgtggatctcagatccctcttgtttaatttgcctgagtgcttcactgagcttgcaccttcctccacactgagaacaaaagcaggctactgaattaccttttgaagcactacctcctaacagaccccttggattgagaatatggcaaataacagtggctgcagccgccttaaaaacagaagagaatggagtgtggaatgcagacttaacctcagtgtgattttgctccagaataaagcgacatagctctaagtcaggacataccatggggcaagggagtgatggacaaagctaggaaaagagatgttctacacacacacaaagaggttcttctgagtgtggatgcttaaaatctcaagaaggaaaatgtttttcatctgtggtcacaaaggcacaagtaatctagtttaaaatatctagaatggaaagcagcctctgtatgggattagtggctccattatttctttttttcacagcaattttacatgagatctgaaattctttcctttgtaatctaaaccttttcagtttttagatatatcatttaaatatgaaaaaaaattcagggaaaagtaattttattgttttagtacaggtcatggaccttggagtcttcataatggccaggccacatggaaataaattcatagggaaaaccatgctgtaaggacaaagggatctggagtgggttgaggggaaggaaggtattaggtaaccttcactttttattctgcctaaggccaatactagtggtttcaatctagtgacatgcatgttagggcacattttagagcatgtcactgatagctgcctgaaacagccagtatttgcactgtcagataaaagatattgcctgcttcacagtaaagaattcccctttccaggttttaacaggacaagggacggctaactcagatgtatgagctttggtagtacctcagctggtccattaaaaatgtgcatgatgtttagaggcattttatgatttttacaagcataatgttttcactggaaacgtagcagttatctaaatgttcagggaaggttttcttccaggtattgttgcttgtatcctagaatgatttcattcataggtgcagtctcagaatgaaacatacaaatttaaatttgggaaatctattggatcctcttttatttttagggactttttttctcctgtgaataagaggagactgttgtgttcattctcttttttttttttttttttgctggctatgacggtaactgacactcagtaggtcttccctcaatatttgttgagtgaatagatgaaagtacagtggggaaaggaagcagggcataaacacaaaaacggataataatagaggtggtgttaatgacattgaggccaaaatagaaaatttgattctagtggatggtttatcgcatgatacatataatgggttatgaactggaaatcagagggtgtgaatttgcttttattatagtaggagagaggagctgatgagcattagaaaataatgaaaatgagtcattttcttacaaaatattatctttcagataatatagcatcatcagagtctttggatttagagccaaaagagccttatatgccatctaattaaatgtcttatttctaatgtgtatggggagattttctggaaaattacctatatgtgacctaaagtttttggaaatgccgtgtaagaagtttttcttttcatgggaactggaagggataaaaatctgattgcttttcttcagcaaagcataccagcgtccccattaggcaagtgattatgcagtgttgaaaggtattttcttgagaatgttatttttttccttttcattaattatgctttgtctaaaggttctttgtcaaagctctggctagtacttgaaattgtaattgatagggaataaaagaaagtaaaatctttgatctctctctcggtgttatgcaatatctttattcttgagatcaaaagactccgagtataatgctgaccaaacagaggctacagtactgattttgacagagaccaaggacaacagctatgaaagttaacggctatataggcatgaaatgacaaaatcaaaacaaacaaaactgtgagagtgcctctatgctaaacatccttgcatccttacataacataaacagacacattaaaataataaattcataaaataggtacacaatattatccataatatggatctatgataggtccataaataatattgttcaggagaagaggtattgctcttctaggagaaactataggacaagcatatttccaggaaggcatcaaaataaacatttattacagaaaatcctgaaggaatagcttgtacctattcttacagttgaaggcttctagggaaaactggtatctagaacacatagagttccttatttcataataaatgcatcatttattaacattgctccattccctgtatcacttgaccctaagagcaattatgaagttaataaagtttatctttgatgtaatggacatccctttctattctccccagattctttttgtctcaagtatttatttctcgtcatatggcctaaagacatttctcttataaggactgtgcattggtaaactaactctcagaagacttaaagtgacatcatgctttgccactctgggaattatttgaatttaaaatacccttaaaaagataacaaggcttgggcatgatggtgggtgcctgtaatcccaggtacttgggaggctgaggtgggagatttgcttgaacccaggagggggaggttgcagtgagctgagatggaacgattacacttcagcctggatgacagagagactctgtctcaaaagcaaagcaaaacaaaacaaaacaaaagaaaaagagtaaggcttaacctaagaggtctgaaacctaagtagggagagttatcatggggtattgtaaccaatggtgctctcattcagttaagaccatgaaggtacataaatagacacatcatcggtggtagttttgctgtgtgattcctagccactctcacaaaagcttcccctgtgtctcctgtttaaattgaaattagcagtatctggtacttttctctagacgtagtagaaatacttagatggcagaggatttctacttcctttcagtattacattgattcctgacatctttcagtcagggttctttgattaaagttgaatcatctatcattttattctatttttaattgctttgctttttctaataaatatatattcccctcttttaatgatatcatgaactttgaaaatgtttcttcctttgtccttccaaaaattaacttatttcagtagggaaggctacaaaaatattggaagagtaattatatatatatatatgtgctgatataaaactattttatcaaaaccaaaacgaaaacgaacttgaaaatcaattatataggaatatgcaattttagtataagaaaataggaagtcaaaaatcatggatcattacttaataaaacaaaatagtaaaaatgacaatatagtttttttggatacagattcccactctgttgcacaggctggattgcagtggcacagcaatggctcactgcatcctctacgttctgtaatcaagcgatcctcccgcctgagcctcctgagtagctgcaaccacaggtgcacactactaccaattttttgttttttttctttagagaggaagcctcactctgttgcccaggctggtcttgaactcctaggctcaagaaatcctcctgcctcaacctcccaaagtgctgggattacagacaatatacttctaatttatatttgcaaaacatcaaatgtaagacaattagaaagtagaaaaatcttgatgagttttaaaaaattataacataagtttcttaaaatgtacaatatatgtacaatattaagaagtagtaaaaaagtcatatttctgactttgtgaatcaaagccaatgtattcaacttgcattcttccccattttgcatataggtatttctccggccaatgaaaacctacaatattcagatctacatggcttactgaatattgtctttccttttgtcctgttttacatatgtttttatagccccttgtataatttctatttagaatctcagttgaaaaactgaaggggaaaaagacagacagatggacacgcccccctatacacacacacacatgcacacacacacagggagagagagagagattaaatatgaatatggaggtgaacataggcaggactggcacatgacaggtatttaatgcatcatttccttacttccatatttctttccatcttccttcattcctactttccctgcttaagacattttcaataaaaaaaaactttaacatttaaattgggtcaacaagacacatcatgtgcacatagtttgggtaataataattaacttcacggttaaatatgacatgatatgatgacatcagacatgtttattaagatgttgtctagctatccatctggccacaaactgagcttactttaccagtcttcaaaagaattgctcaggctagaaaaatgttaatttccctgtttatgttgcttaaaccctgaaaagttatattctaactaacagtattaagatctaagttaatgattctatctacaattataggtaattattaagtgcttaatgcaatgctcagacatggtagatctaacaaatattctcactgttcaatttctcaaaatcctattttactaaagatcacacacacgcatacacatacacatgcactctcacacacacatgcctgataatgcagaggaaaaaacatatttgtagtgatgccagtggaaggactgttgcattaatttttcactcatttatatacacgattcagaaaatcaataaactattcttgtttgttttctcaaagtcttcaaaacgaattaatgcatttcaaagttttggagctagccttgcatatctcttttcctgaatgctcctgaatctttattccatgtcagagctttgatgaatcagttacatgacagtgaatgccatttgctgatagcaaatgaattcaaatagccctcaatccatgtaggacaagactgtcgtatacttcttggtactattccttgtgttataaaattgaggtaattgagcatttaatatcccatttacaattttgtgtatgttgatgacacaccacagccgcaggaagctattaaagtgcatagacaggtacatacaccaatcaaacttttgccacagaaaagcatctccgtggatgaaaagagtggcgactttttattttaaattatgacagctctgggcagcactactggcagccaactcacagaactaatttactatcacctttgtgatagaaacagcttgatctaaaatttgttaactatgtaaccagttggttaacatgctgtaaattggatgttcagttcttatggaaggaaattcacatttcatttattatatttttatgtcaattatgtcgaagaaaatatttctcttcctatgcaaataagtaatctgatatatttttattcccccagagaaaagtataaaaatggaactattgccctgtagaatattcaagaccatggtgccacttattttatactgcaagtagtaaaatctgacatggtaataatatagatagtaaaatctcactgggatggagggatcaagggagaaatttcactaattccctaaacttaattattcaagggtatttgaagaaaaaaaagaagatatttaatatttataggactccatggttccatttcattcagtggagcttacacaaaattttgatttaagagcaatctgaactagtcaaatagtagactgtactgtaaacaatatgctatataactgtttgtatacaatgaagtggtaatattggttaaacattaaatttacaagaaaattagcatcaggcagatggcagaaggcaactcttaagtaataaacacaattgtatatctggttgcacagaaagaatgaaactttgataaacacaaattctcttctgttcattctgcaaaatttcacaactgtaatagaatgtaactcctgaaatactacaaatgaaattaaaatttgaaaagccacatccatgacttacagttcatctagcaagcagtccatacattgtttcattgcttatcaacaaatgagaaagctataaatgcccaatgcattttgaaggtcaatttttatggtggcataattttaaactagctcatcctcagtggcttttgtaataaaaagggataaattaatggccccttaactaaagtgaacttttgatacggaaacaaaaagaatattaagcatgtcctattttaagtagaaggattaagagctttattccatgaaataaattgggcaggacctaagattcaagactttgaattggtttctaggacattaacataaggagaacaagagaatttgacattgctagaaagaggcacaaaaggatgtagtatctgttagaggaaagattttcacactagctgacagtaactacaggacgtatggtggactgaagtgtttttctcagtttaatctgtgtcttcaaaaggcggcctcaacccttgggccacagaccggtactggtccatggcctgttagggacgtggctgctcagccggaggtgagcagcaggcaagtgagcactgctgcctgagctcagcctcttgtcagatcaacgatggcatttagattctcataggagcacgaaccctatggtgaactgcacctgcgagggatctaggttgcgcactccttatgagaatctaactaattaatgcctgatgatctgaggtgaaacagtttcatcctaaaacatcccctcctgtccatggaaaaattgtcttctatgaaactggtccccggtgccaaaaagtttggggaccactgttctatcaaaatatcttctcctttgtttttccagctttattgaggtatgatcaataaagaaacaacgtatatatttaaggtataaaagtgatatattgataaatttgtacattgtgaaaagactacgacaagttaattaacacatccataattcacttagcgacctgtgtgtgtgtgtgtgtgtgtgtgtgtgtatggtgagaacacttggaatgcattctcacagcaaatttgaagtatacaatatatcattaactagtcactacattgtatataggtcctcagaacttgttcatcttataaatgaaagtttgtactctttgaccagtatctcctcttctctccagcccccagctcctcctaatcaccattctcctctctgttaccaagaatttaacttttgctttagactccacatctacgtgagatcacgcaatatttgtctttctgtgcctggcttatttcactcagcacaatgtttgtcagattgatccatgttgtcacaagtggtatgatttccttttttactaccgaataatattctaaagtttctataccacattttctttaccaatttatctgctgaaggacacgtaggttgtttatgtatttggctatcatgaataaatgttacagtgaacatgagagtgcaaatagctcttcaagacactgattttatttcttttgaccatatacccagaagtaggattgctagaccatatgggagttttatttttcatttttaagaaacttccataatgactttactaatttccattcccaccagcaggacaccagggttcccttttctctacatcgtggtcaacagccatcctaacaggtgtgaggttctatcacattgtcatttggatttgcgtttccctgatgattaataacaagacatattctccttgccaaaattacaaccagaccatttttaaaataactttaacctatcatgttccaaacaaaaaataccatcctctccataagtggctatggaaattatttcttcttttctgttctttccctttttatttgtgctcacatctgacatatatggaggctagctgcccatttgtatctttgcccagtattacttcaagcgtgagtgttcatcttactcattttttaaaaatatattttgggagtccagcagaagtcttgcatatagcatgtattaaataaatacttgctggctttaatttggtttaatgttgccaagtgtctttgccaatatattgccagtcactttcacttgaaaacctcagcttcgatttttattatgtcagtttctctactctcttgttatgtaccaaattctaatgatattttaagtcagttctattctcaccaaccagccttttcttttaacacatcggtattactgcaacactttctagctgacctccttgcccaacctaaggttcttctaacttgaaggcattctatgtacaactgtggtactgaatagccacattacttccctgctcaagcattatataacgagtcttcactacctactgcatcaaagtgtaaaattatttcccaaattttatacccccataatttagttttttatttttctccaactttatttttcattatgctgaaatattttcttcgttaaaaatctcatttattgattcaacaagtactttctttttttttttttttttttttttttttgagacagagtttcactcttgttgcccaggctggagtgcaatggcacaatcttggctcactgcaacctccgcctcccgggttcaagcaattctcctgcctcagcctcccaagtagctgggactacaggcatgcaccaccatgcccagctaattttgtatttttagtagagacagggtttctccatgttgatcaggctggtctcgaactcccgacctcaggtgatccacccacctcggcctcccaaagtgctgggattacaggcgtgagccactgcgcccggctcgacaagtactttcttatcaccagtaatatgacaagcactgttttagattctggaagcatcacaaagttcctgtatcttttttgaaggtggtgatatgggtggctataaaacaaacctgttctcacagagcacacaatcaattgtatgtataaaaattactaaaatatgtcaagtggtgataagtgctatgaagaaaagtaaagtatgatacaaggacagagaataatggggacatggagggttttattttatttaaagtgctcaagaaaagcctttctcatacttcaatgaagggagaaacaaaccatacatatatctggttattaaacttttcatcgaaagagaacagaaagaccaaaaaccctgaggctggtttatacttggctgttggaggaaaagcaagtggcgattttatggtggcttggattaggatagtagcgacaaaaatggggggaaatgttaaaggcagctacaatttttaaatttgcctattggcagtatgtgctagtaatatattacatgtccgggccagtacagggacctcatcctttcttttcaattagcccaattataattgtgatgaggatttctggagaaaagtaatactatgctttaatgattctaaggtctaaaatataaccaaattgcctgtaagatataagcaatgatcagaaggtgttgttcaataaccaactatcatggccgggcgcggtggctcacgcctgtaatcccagcactttgggaggccgagtcgggcggatcacgaggtcaggagatcgagaccatcctggctaacacggtgaaaccccgtctctactaaaaatacaaaaaattagccgggcgtggtagcgagcgcctgtagtcccagctactcgggaggctgaggcaggagaatggcgtgaacccgggaagcggagcttgcagtgagccgagatcgcgccactgcactccagcctgggcgacagagcgagactccgtctcaaaaaaaaaaaaaataaaaataaccaactatcatataaattattcggccctttattgagtatattccatttatccagcagtgtgatttctggctgtctcagttattcagtatataggctcagatcagagtaagcagaagaggactttgaacatcagagagcagtcagaactggagaatctacttgcagatgagggatttattacaggtctagtgactcattgctgtttggtatctcatcctccaggggtcctccaggtggtctgggtttgttgtgggatggtgggttctgggcatcatactttctccatggctgctgattggcctcagagccagtgttccaaggaaactcaaaaaaaaactgcagggtctctgccgacctcacctctgacattccacatcactcctgctgcattctgttggggaagcatgtttcataaatagaaattggactctacttgtcaatggaaggagtaacaaagaatgtgcagtcatctctaactggtcacacagataatgcagaatttaatgttaatgcagtagaatataattattacatacgtgaaggtgcttttaatgtttctgagaacaagttaaagcatgttcaaagaactgtttcactaaaggaagcaggctatcacatatttttaaaagattttcattgaaaaatttaaaagtaatctttaaattctcagttatttattaccacgtacatatatatgtatgtgtatttatgtaaaaatatatatacatatgtgtgcatgtctatgtagatacacacacaaatatatatggtatatttatgcaaagatcccactgataaatacatgtatctattttatttattaaatttattatataactaaatttaaatttctaaaaatgtagtaaaatttttattattgaaggcccaaagtaactcaaactgttaacttttataatcgaatgcatatttttatcttgggattgtttaattttaaaactatttattcaaaaataaacatataaaaataatagtaaaactcacacattcatactgtttgtttctgctgtaaaacaaaattggaaacaacaggaaattgattgcctaaaggaaaacttaaattaaatataatagcttaactattatgtgagcagtaataaagttgaaaatgcatgccctttgttgtaggactttgagccaactgttattttcattgaataatttctgatttatttatctagtcaatccgaaatcagcagttatccttagaaatatgtcacatattctattatctccaagcatgaattatcagatcttagagaaatttccaaatagaaagctatatctatgaaagtcaaagtgaatcgttaatacaggcttccattgtctataaacaatgatcacttgagaattaactgttcattaacatgcttcatttttgaagccaacagtaaatattatttaacatgaaaataatttttcagttttacttttttggatcctagattcttgtctgatttttacttgtgaaacatatccctaacccagaaagtatcattctatgcatgtccaaatttactatgaggggtaaatgaattaaagtgctcccagagggattagaacctgagggcaatttcttcttctttttcttcttctatttttttttttttttttttttttgacaggtctcactctgtaacccagattggaatgcagtggtgcgatctcggcttactgcaatctccgcctcccaggctcaagtgattctcctgcctcagcctctcgagtaggtaggattataggcgtgtgccactactgcctggctaatttttatatttttagtagagatggggtttcaccatgttggccagcctggtcttgaactcctgacctcaaataatccacccgcctcggcctcccaaagtgttgggattactagcatgagccacgatgcccggcccccatttcttcttgtagaagaatagattacatcaacctgaaactgctttaagagtcaaaatgatgcagctattcttgcaatgttgggtgatcagggtgatgattgtaatttacttttgaattttcaaatgttttgttgacctaaactataagtaaagatgcactgctcagagaagccagtgaatatcagagtagaaacacaagcctgttatctcatgcccggaaaaaaagtaagaattaagtatgttaacttcttagactataacacacatttaatttctcactgagtattagttttccatggtgcatgtttttatgtaaggagaggaaaaatccattttcaaatccaagtcacatttctctcttagtaatcatattattaatatcagttaaggagtattttatttaaggcaacaagtgttaaaaaataaattcctaaaggtgtcatggctcaaacatgatagaaaattatttcttgctcatttacaaaactggtactttcggttggtaactcttttcaaagcaataattcaaagactctagctcatttccccaatgtctatggaatcctcatcattggcttctaggatcaccatgcttatctgtactagactgaagaaatatggagaattgtgcctggaaagttttcaagggtcagtcctggaataaatgcatttatttaaaactcagtcacatgaccatacctatctgccaaggttccagaaaatataatcctgatccatgactaggaagaagataaaataagtttgatgaatagttacccagtctccaccatagcagaagaagcccattctatttgagattcagagatcggcaaaataaactcagtaggcaagaggcatagagaaggttggaagtcctatagcagcttaattaaagcgccctggccgggcgcggtggctcacgcctgtaatcccagcactttgggaggctgaggaaagcagattaggaggtcaggagatcgagaccatcctggctaacacggtgaaaccccgtctctactaaaaataccaaaaatgagctgggcgtggtggcaggcgcctgtagtcccagctactcgggaggctgaggcaggagaatggcgtgaacccggcaggtggaggttgcagtgagccaagatcgtgccactgcactccagcctgggcgacagagcaagactccgtctcaaaaaaaaaaaaaaaaagcatccaatcagtctccaacactcaagaattatttgtgagattcttatagaactaaaatctgtcactagctagttctcctgtcttctttcatggcacctgagagtttgaaaaataaaaggttatgaattgtatgcatgccattttttttttctgtattgtatgcatgaaaccatcaaagatggaattctttctacctgtagatatccatttctcctccaagagatctcaggtcccatgacaatgtcaccacttctgctcctcctctgcaagtgtaatgaagagggtatttcagtggaagcaatgtattactttccctctcttggattatgacttgaaagaataacattcacacatttgtgaacctgttcatgccccacttcagttatcagtattattcctcattgcttccctgcacatgtaggttaatatcctcactcaccttttctattcttgcaccccttccatgcaggcaaaatgttatacagttttcaaccctcattgatcacatcccaaactccctccactttgatcacttgtagtagagtcagtgtctctcacccataagactttgagttctcattaaactgtgaagtcagagcttattacatttttatctttgcatccctagtacctagcaaaatgtctgccagtggccaaatgctcagaaattactggtaaatgatttgaagatttccactgactatgctggtctaccctgttctgaacttcacatcaaaacctatatgttgagagttttcattatgacaaaaatatactgtggtcaacatcttgaatgtagtgttagttatgatgatatataccgtttctaaaatttctccatatgcacattgaaaatgaatacattttattacatgtaaattcttaagagatgtaattttaaaaaagagctactgaaatgctaaacaagacagaaaaatgtccctcgagattcttgctattgagctgacgaccaaattcaggcacttgcagagtagttgaccttctcttaagaaggagccctcctctgtgccctcactataagaaggagcctcccaacattagattttctcttgaagagccctttggactgttgttctgtctgagagctactggagaatctctttgatagctttgcttttgacggttttctctggagaaaggtctaatagaagcaaacagttaaaacccttttccatccttcacgttttttaaaaaaagtctcccttttaatatgattttctaactctgtagcttctttgtgtcattttgttcctacaagtgttcatatatacttttaggtcacatgcatttccacacacaatctgaatgtttcctacaccatagagaaggtgttagagactggatacttatacaatgttatttaggggtcggggaagagggagactctattccttaaaacaaggaacacaaaattaaaaatataaaacatgatataaaagtaaatattggccagggcgcggtgacccactcttgtaatcccagcactttgggaggctgaggtgggcagatcacctaaggctgggagtttgagaccagcctgaccaacatggagaaaccctgtctctactaaaaatacaaaattagccaggtgtggtggcacatgcctgtaatcccagctactcgggaggatgaggcaggagaattccttgaacctgggaggcggaggttgtggtgagccgagatcacaccattgcactccagcctgggcaacacgagtgaaactccgtctaaaaaaaaaaaaaaaagtaaaaacaatgtaaatatttatctatagtgagacaagtaatcaaaaccaaaatatggaggcttggagatataggtccctttcttccaggagctctcggtaatttactagaaatgcttccacagaaatacttttgatttaaagatagatttttctttcacccagaactttctctaagttctaccaaattatctcaatttgattgtaatttaaatggaaaacataaaactacaaacttttagaatataacatcgaggcacatttttgagccccagggcctgctgacatgttcttagacatgataccgaaagcataatccataaaggaaaaaaaaaacagaattaattggactttatcaaaactaaaaatatttcatctacgaaagtaaaaaatgtatgtatgcacaacaatctgtacatgattgttcacagcatttctatttttaacggccctaaactggaaaaactaaaatactcctcaataagtgaatagttaaacaggttgtggtacatctatatcatgaaatactgctcagcaaaaacaaaagaagacctaacaacaagaagaacaacaaaagtgttgttagatgcaccaacttggatggatctcaagggcagtatgctgagtgaaaaaagccaatctcataaggtcacaaccttcttgaaataaagacaatacagggattggaaacagattagtggtggtcatgggttaaccatggctgtagtgcagggagaggatgggtctgagatggaacagttttgcatttagattgtggtagtgcctataccttacacatgtgattaactgatataaactatatacatatattgtatcaatgtcaatttcctggtttaaatagtgtgctatagttacgttaaatgaattcatggcagaaacttgatgaaaagtacccaggacccccctgtctttgcaccttctagtgaattcataattatttcaaaataaaaaatttaaagcttaaatgttagcacttacacaagtggattactttattacttctgggatatgtacaaatttgggtcctcttagtgtctccatgattttacatgaggttgttctaacataaaaaaaaaaaaacaaactacgtaaagagtgtttttaaaagtgagaagaaactactgctagtttgagaaagggctagatcctaatcagtaaatagaaaatcagttaacattcaaatcatgtttaattattttatcttggaatgcacacgattactgttttattttttactttttagagacagcgtctagctctgtcacccaggctggagcacagtggcatgaacacagctcactgcaacctcctcatcccaggctcatgtgatactccaacctcagcctcctgagtggctgggaccactggaatatggcacatacctggcttttttgtttgtttgttttaatttttcttgtagagatgaggtctcattatgttgcccaggctggtctcaaactcctgggttcaagcggttctcctgctttccagcctcccaaagtgctgggattacaggtgttagccaccacacccagcctatgattatgattttattcattagtctatgtaccaatatttaaaagaagaatttgtatcttgcatgtgtgcacaattataccttacacataaatgagtttgaaatggtaaaacggcaaacctctagactatgacagccaaagacaggtatttgatccttgaaaatagaaaataatataggcaatgacttttgcaaaatagtgagatatttccaggtaacatttattctgaaggatttgctttcctatcactgcaaagatggccttttcaaccctctcaccatcatctcatttgctgagatgagagagaggagagaggggacaaatggatatacagatatatgggggctgggggagacagagagaaactgtgttttctggggcaggcataggtaacatttacagatacctgtccaaagtacacacatatatttctatagtcctagcattgcacacgtattactctaaaatgctggcattttctgtcaatctgcttggtagcaaatgctgaggaacaaaccaatcactggatctaggagccaagaactaacagagactctgtgctttatgtgtgagcatttaactactgtagatggagacctgcacgtatttaaattgaatatcagtcctgtgtaaagagtgattattctgatgcttctccgcatcagatataaagttatatggagtccaaagaccatcaatagaggattactcgtagcccatctaattttggaaaacaatagaggagttttctggtgtgaggtgaacagcctgctgttttctttgcctggaatgcattttcctcctcttccatgcttcacctccactccccttacctagttaatacccactcatggctcaacatttgctcagctggtgtttacctacgaagccttcttattccttagatgaaaataattaccccatgttccactgcccagtcagagttaaacagaacttctttttttttatttttctttttaagaatatagagtctttaatgtggtcagaattaagttgctatcagtttaaaatagcctgttacaagtgtattttatataagcctcatagtaaccacaagcaaaatctatattagatacagaaaagattttttttttaaaaaaggtttcaggccaggcactatggctcatgcctgtaatcccagcactttgggaggccgaggtgggtggatcacctgaggtcaggagttcaagaccagcgtggccaacatggtgaaaccccttctctaataaaaaaatacaaaaattagctgggcgtggtggcaggtgcctgtaatcccagctacttgggaggctgaggcaggagaatcccttgaacctgggaggtctctctgtctctctcagtcattatctctctcttcttcaaacctgtaacaaaactccataaggaaagaaatttcattgtgtttgtatttgtctccatagaatctagtataatgctatgtgtacatatgtacacatatgcgtgtacatacgtgcatgcacacacagacttacatacacagggcttgcagaggaataaattctgcttttaaattttctatttaaaaagatacttcaaaattcccttcaaatttgatgaaaccaaaagtttgatttacccagacgttgaggttttttcttttatgggatatacaattattccatagtgacatgtcctaagataattttcatattcatagaggaggctgaaggtaggattttgtgaatctttgataatagttacatgaatgttgaatgtttgtatattgaacttgcatattctattaataccatctctggaaatagggtcatttggttataccaagttttttgtatttacatatttcaagaatatctatttaaatatatgtaactagagctactggcagataacttaggtctatatggaaattatgaataaacaaaagtagatgtgaatgaagccaagaaactcctagtgatataacatgaagtctttactcaagctttgtttagaaccagtaacaggggattttactcttttcgtgcaatggtccatttgtcagtctaattaaaaaaaaccacaaaacaccctcctcggagtaatataatgttattaaatacataaaatgaaatacagcggggcatggtggctcacgcctctaatgccagcactttgggaggccgaggcgggcggatcacgaggtcaggagatcgaaaccatccggctaacacggtgaaaccccgtctctactagaaatacaaaaaattagccgggcatggtggtgggtgcctgtaatcccagctactcagcaggctgaggcaggagaatggcgtgaacccgggaggctgagcttgcagtgagcggagatcgcgccactgcactccagcctgggcgatagagcgagactccgcctcaaaaaaaaaaaaaaaaaaaaaaagaaatacatagggttgaagagagaaatgaatcatattgaaagccaattttaactcaggagacaggataacctttttttgtttgttgttgttgttgttttttttttttttttggttaagcaacttggctttcctaacatctaatacttttcaaagttttccatatttgtttgctgcttatgaaaaccaaattaatgatgttttttcctgaataatctcatcatgaccttattcttataatgaaagaaaacagaatgctaaagctagggttgacagataaaatatagaacatagcttaattgaattttagataaataatttaaaaatagtataaatatgtaccaagtattgcatgggtcttactaaaaatttgttatttatctcaaattcaaatttaaatggacatcctgtatttttatttgctaagcaggcaacccttcaaaaactggtctaggttaacaaatgttagcgataaaattgccatgatcatgccctaaggaagtagaatcggatctactaagattcttattttatctccgcctgaaaaatattagccttatgggttggtttcagacctgtccctacatcatattttatgagttttgggaaggcaaatatttgctaaaataagatttaattctgtgctttaatgttttattgatgataatataaaagtggtaataaaagaatacttcacttttgcaaaaggcaattgaatatactgactgatatttttccagaaagtctgtctagttgtagtgacaagaagaaaatatctcttcctagattatctattgaaattccttttatcagcaagaaagtgtaattcactacgttttctcttttgcctttctgcaaaaggctaagagttcagataataatgtttaatagttattaaagtgaacttatctatccttttgtttaaacattttgatacatgtccgcattttattttcattttaactatcttattttattcatgttatttttctaagcctgatcaatttttacagaatgatcagattataagtcctaaatgaaatgccactaatttgaatcatattcagaatgtaatttgttaagtaacaaattttacaagaaatgtgatagatcatgcaaaaattataggtcttaaatcctacatatctcgaatcaaattattttaatactaattttcattgcaattaaaggattcagtaaggattgtaagtactttccattatactgaagacttggaacaagttctgattattacatattttagcatagatgacaggatgcatgcaatgtatcagcatgtaaaatgaaggaaagatagaaaaacagttgcgacaattttgtgcagtagtactatcgtgctgctatacaagtaaaacaatttaatcacacataacatagtaataatgcttacttattgctagaaaaacaggattttaattattttaatgataaatctgctttataattaggcagaaaagcaagctgtgaaaaagcaactttagtatttaattctagtgttaatttcaaaaacaaaaacaaaaaaaacccctgaaaaacaaaagaacacaaagacaggttgaaatgttccttttagggtattacatgctgtacagtgctttgtagtttaaaaagttttatgcccatgcctgaatgcattttgattctcaaagcatcttttggggtaggtttggcaggcactattgttcattcctacaaatagtttaaaatttttaagaaaaacattttagtactttattgaaaatcctatatttgcagccttcattcttaatgtttgtagcacattgaattttattgattgtaagacaaatttatttcaactggattgttgaaataaactctaaataactctaaaaataaactctaaaaatcatggtcacggaggttgagtcagattatgcttgccatttacctgtgcatgtgcaaacctcaaatacctcagccttaaaacttggagaatgagtgttcctgtggaagattattcttcagagatgatagtggagtactcttgaaaaccctaggtaccaaattgctgcagaagtatttgaaggacctggtgaatctaatatgttttaccaacatactacaagttgaaatcaaaagttgactgctcgtacataattgcaaagtcagatgtcagatgccaacatcaaaagctcttcaaaaataccacataaccaatgctctttgtaacccaagggatgacactgtgtggaaaagcacaaacatcaagaactctaaacctaaaagtgatttagacaagttaaattccaaatgtgaagtaattatagactgttaatatatttgccttataaatttgtatgtatatgcatgataaaaatctatcactaattaagggtaaaaaacttgcaacaaaaataagctttctagatattaaaaagcatatcatttaattgaatagatgttttccttcttgttacacagaataaggtgtatctatgtaataaagacgtgtaggatttgagtaatgctgtgctaaatacttactatcttgagttctggtttggagctatattgtcccatttatctgtctgtcaattcttatgctagtaccacaacatttcaattattttatgcctgtaagacatgctaacattttagggtaagatattatttctctattattcttcatttgcaaaattcgcttggctattatttcatattagtttttcaaatgtaactgcagaattagaatgcagaattgcttctcaagcacaccacactgtgcagcaagtgaaactgcactggagtcatgagcaataggcattttccacacttgggatctagaaacacaagatgcctttccattttttctgtttttcaaacgttactgtgtttggtaaagaaggttgttttttttttgtttgttttttgttttctgctctgggctatatatctttcaatgttaactttattctctaatagattatttcttctgcttattgctgaaagatgaacaacaaattttatgaagatttgtgtaagaatagtggatgaaaattttggtagatgttagcatttgcttatttggaaacacacgcttagagaacattcccactctgaccagactagaaatctgaggtttgacaagagtgacttaatttcacaccttctctctctgtcttttttttttcgtgtaaagaaaacagtcatcagcataagatttaaaatcttaaatgtacaatatgtttgactcatctgatacgttccgcctttgctgcaatggccttcaatacagtaaaaataaccacactcatgcgttagaatcatctgtgcaaactaaagtatatggcaaaattttaaagaaatcaccaacttcaattaatttattttgaaagaaagaaaaggaatttgcagtaatacttgaaacatttaaaatgaggattttttaaaaatatgctattaaaaatatgaatttatttaagacaatctgagatgactgaattataaattgtgtaaaaggcaatttagaatttttaaattatcaatgtatgtaaaatataggatatttcatttgttgcattgttaaattattgcttattttttaatagcataaaataaagtaaaggctatgttttagaccaatgttagtttttactcttatctatatataattggtaaatggagaaaatgtcagtgagaaatctaaaatcaaaataagatatgatttttaaataaattgtacagtaatttttctgttgaaattatgaacaatataaatattttatcatagttttctgtagttttcaaaatatcatatttgtggatataacccctgtttaatcataaaaaattataaatgactaaagataaaagaggaaaggaaatagagaagaagctattgtaaaaagaattgaaaagcagtgttttcctgctatttaactttgaaacagaaaactttttttgttgcaatgattcttcactacaataccaaaattctgaagagaatgttttcaggttaccatatcaccaaatcagcatagccagagaccaaacagtgagctctaaactatctttactagatttgaaactccagcatattatatttaccaaggtaaattatccctcttatgacaagtttttgttatcctaactgataatttagaaaactaaaggtcatttagtgtaaaaaacatagttgaaatacaattactttctcatatgtatcttaaaatgatatttcaaacttccttatgcagtgttgctatctgttaattctcccatatatcttattgaactagctttttttttttttctttttctttttttgagacacagtctcactttgtagcccaggctggagttcaatggcatgatctcggctcacttcaacctctgcccccaagttcaagccattctcttgcctcagcctcccaaatagctgggactacaggcatgggccaccatgccctgctaattttcatatttttagtagagacggggtttcaccatgttgggcaggctggtctagaactcctgacctaagggatcagcccacctcggcctcccaaagtgctggattgctggcatgagccactgctcccggccaactagctttaactagaatattatcttcagcctggcagttaaacaatttagtccagtagttacataccttaagaacatttagagaaaacaccaaaaaattactaaaaattctggtaaaattaatacccatgactagagatatgaaagtctggcattaactaagttgagaaagagctgttggaacagtctggagaataatatgaaatgttagaatgcaaggtcaatgaacagatggttctgcatttttatagctaacactactaattggaatggatttaaaatttagcaaacagagttcttcaagtgcaaattgttaagaaagagaggcatacattctttctaagtggcttggtggttgtacttgattattatggactggatgtggactagataataagatataaaattgacaagagataccatggcctgataatggtactcattttttatgtgtatgcataatttaagctatgtttttcactcatatgttctaatcactttgcattttttctcctgtactgtgtgggatttgagagtcgaggtgaaaggaagaacccaaacaaagagattgttcttaaaggcatgttagggtcctttgggttaattatacaaggtttgctgacagcgcctgataagaccgttgaggtcattctgttgttgacgtctcttcaatctcaatacgccactcagcaaaggccaaggcagatagagcttttccactatctttatagcacaaaatgctacgctgaagagagaaaacacacactctctctctcattcttacacccacacaaaacctgagaagcccaaactgccacacactttgttgatgacaaggtcagcatgataccttagaaccattcatttctttccactccacttcactttcaatatgcaattttaaacatcataatttttaccaccagaatgttacaaaaaatgtctgctaattgctttgtgtccaaaaaagaaaccaaaagaaaatggtattttgctttagacactaacaaaatgtaaagggtaaatgaagctatgtcttagtagtatggcagaggcagaggagcagggcaagaaacggtatgtaagacacgaactagtcactagtctcacagttctactgaaaagtgagctttatctagttgatgacatcatgcagccccatgaataataaatgaatacatatttattgagtgcttattaagacctccgcaaagctctgcctctgtataaatgagtgagatgaaagcactgttctcacaggaaggttataaaggagctgggggaaacattaatgcaagacacagatcataagagagaaacttcatagtaaaaacgataaagaacacatgagttcttccagagcaggggtccccaacccctgggccgtggacctggtacctgtagtggcctgttaggaaccaggctgcacagcaggaggtgagcagcggtgagccaggaaagcttcatctgtatttacagccgctccccattgctcacattaccacctgagcttggcctcctgtcagatcgtctgtggcattagagtctcacaggagagtgaatcctattgtcaactgtgcatgcaaatgagctgggttgtgtattccttgtaagaatgtaactggctgggtgccatggctcatgcctataatcccagcactttgggaggctaaggtgggtggatcatttgaggtcaggagttcaaaatcagcctgaccagcatggtgaaaccctgtctctactaaaaatacacaaattagctgggagtgattgtgcatgcctgtaatcccagctactcaggaggctgaggcaggagaagtgcttgagcccgggaggcaaaggttgcagtgagcagagatcactgctctccagcctgggtgacagaagatcactgctctccagcctgggtgacagagcaagactcggtccaaaggaaaaaaaaagaaaaagagagacagagagaatctaactaatgcctgatgatctaacgtgggacagttccatcctgaaatatttaccctacacccaagtttcatgggaaacccatccctgctgccaaaaatggatgggggctgctgctccagaggaccgatagtgcatgaccattaatctgtgtcatgggagaataaggtttttttgtttgattgttttttattgttttttattttatttttttttggagcccccttctgggcaagaaagaaagggatcgatgaaaaatatgcctcctatacagaaccaagactaaaagggtcgaggtggaataaaatgttcctatagttcgtaagcagccgtagtttggagtgctttggcatgtatcaatggaaagccaggatagtgtggttaggaatccatactctgtaaaaaaaaaaaaaaaaaaaaaaaccctgcctgtgccatttggcatgcttagttcaattattttgaatgctataaaaatagagatggaggagaaaaaaagatttcaaagtaggaaatgaaataggaagaatgttcaggcagagattgaggcaagaagggagtagagcccaggcagatcttatcaatgtgaatcagtctcaccataagtcctaacttccctgttgggaaagcaacagctcaaccagagaccagaatcataggttactgaaattgaagggcccagagaagtcatcttgtcaagcttctgcatcttttttatctcatggatcctactgactggtcataccctccaaaattctgagatttaaaaaatgcttacaataagttatttttctctgttaaatttctcagtcagcattggctttttttatttgtttgtttgttttgagacagagacttgttttgtcacccagcctggagtgcagtggtgtgatctcagctcactgcaacctccacctccctgcttcaagcgattctcctgcctcagactcccaaatagttgggattacaggcacccaacaaaacaccttgctaatttttgtatttttagtagagatggagtttcaccatgttggccaggctggtattgaactcctgatctcaattgatccactctccttgtcctcccatagtgttgggattacaggtgtgagccacgcattttcttctcttgtttctttcaaagtgaaacattacatgcccaccacaggaaattctttaaatgtgaacttcggaaattctaagaagcctgcatctgaaacagttatcatcagttggagttttattaacggccctgcgagactaaacaaaaatctgtgggcctttacagctagttcagagaactgggaatgagatgagttgtggttgctaaaaacataaacttactaccactctatgatattatttttccacactggcttttaataaatacgaagccacaggctgggcgcagtggctcactcctgtaatcccagcactttaggaggcctagtgggcgagtcacctgaagtcaggagttcaagatcagcctggccaatatagcaaaaccctgtctctactaaaaatataaaaaaacaaattagctgggcatggtggcaggcaccagtaatcccagctatttgggagactgaggcaggagaatcgcttgaacctgggaagtgaaggttgcagtgagtggagatcgtgccactgcactccagcctgggcaataagagcaaaactctgcctcaaaataaataaataagaagccacagaaacatggattaaagcaaaatttccacacataaccttagtgaaagttaaaacaaactaggattctaaatagtccccaaagtgtatattaatttacaattaatttattcagaagttttacttgaaaacttttctctagcatttataactcttcttatttatgctgttaagtgtcatggtatatatttaaatcacacttgtttggaataacaagtttgttttcactaaacatttctgatgtattaatatcatctgctttttacctgctatcagtaggaatgttaacagatttcgatatcttgtctcgttaacaccaaacaatgggtgttaagatgttttttaaaaaaattccttgttctcatgattatatataatatatgttatatattatatataatatacttaatttataactattgtatatagtgcataattttcaaagacaaaaacaattgaataagagatagactttcttcttataagttcatcagtttcaaataatcttgcatgtattacccttcctttttattgtcgtgttaataaagcagttttaaatatagctgagcttaaaatcagaatgtgtgacttttctgttagttcatagtaagttaccacaaggcctgggcccttggttaaagggtttgcctgattaggtcaggcttattcaggatgatttccactttgattaattcagagtcagcttgtaagagttcctaattacatctaaaaaattctgccaaattctattcgccagaaataaatcacaagttctgtcaatattcatggtaggatgtgggtggggaacgaggtcatacataggtgtccggtactaaggtgtgacaatcacagatgccatcatagaattctcattactacctaagaacgaattcaacagcagtatttcacccggaacatagtagctctcatttctaacttctctcctgtctgagctacttatggcataatgaaaacaaaaacgaagagctaattgcaaacttatgcatctataaaaattttcatttaaagttaatattgttatgtgtgtatttggtcctgtcattaggatgttagctggttattttgctcgttagttgacgcagttttcttcctagccttgatggtctttacattttggcatgtttttgcagtggctggtactggttgttcctttctatgtttagtgcttccctaaggaggtcttttagggcaggcctggtggtgacaaaatctctcagcatttgtttgtctgtaaagtattttatttctccttcacttatgaagcttagtttggctggatatgaaattctgggttgaaaattattttctttaagaatgttgaatattggcccccactctcttctggcttgtagagtttctaccgagagatccgctgttagtctgatgggtttccctttgcaggtaacccgacctttctctctggctacccttaacattttttccttcatttcaactttggtgaatctgacaattatgtgtcttggagttgctcttctcgaggagtatctctgtggcgttctttgtatttcctgaatctgaatgttggcctgccttgctagattggggaagttcttctggataatatcctgcagagtgttttccaacttgattccattctccgtgtcactttcaggtacaccaatcagatgtagatttggtcttttcacatagtcccatatttcttggaggctttgttcatttctttttattcttttttctctaaacttcccttctcgcttcatttcattcatttcgtcttccatcactgataccctttcttccagttgatcgaaaatttttgcaacctactcatctgacaaagggctaatatctagaatctacaatgaactcaaacaaatttacaagaaaaaaacaaacaaccccatcaaaaagtgggcgaaggatatgaacagacacttctcaaaagaagacatttatgcagccaaaaaacacatgaaaaaatgctcatcatcactgtccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactaattcaaccattgtggaagtcagtgtggcaattcctcagggatctagaactataaataccatttgacccagccatcccattactggttatatacccaaaggattataaatcatgctgctataaagacacatgcacacgtatgtttattgcggcactattcacaatagcaaagacttggaaccaacccaaatgtccaacaacgatagactggattaagaaaatgtgacacatatacaccatagaatactatgcagccataaaaaatgaagagttcatgtcctttgtagggacatggatgaaactggaaaccatcattctcagcaaactatcgcaaggacaaaaaaccaaacaccgcatgttctcactcataggtggaaattgaacaatgagagcacatgaacacaggaaggggagcatcacactctggggcttgttgtggggtggggggagggtggagggatagcattaggagatacacctaatgctaaatgatgagttaatgggtgcagcacaccagcatggcacatatatacatatgtaacaaacctgcacattgtgcacatgtaccctaaaacttaaagtataataataataaaattaaaaaaaattttcatgtgaacagaagactgagggtcaaaagaattgagaaaataaaataagtttacttgaaaaaaaagttgcaatgaaatctgattgcagaagaattggctgatcaaataaaaacataatgtgtattttaaggaaacaatgcaaaattatcaaggttaccaagtgtacatcagtctaagaatttgtttgatgggtttttatgtttgcttattttaaagaaaaatcaatttgtaagaatttcaaaacagcaaaaatgcttcatgttgtatttatattaaattgacattgattaaatgatgcctacttattccttagaagtctatccatgtaacatgaatactcttattaatgtcttagaaagtttacctgtatcattaaacccctcaactaaacctctttgattcttcttaatttttttactttatgttcagacagttgaattaaccatattttgttatgatacaaaaactcagttcctgtttattgttttaactttgtgctttttctaagttaaatggctctcacattatattgccatcgtcattagcattatctaagttcttctaaactttattgctgtgacaaaaatgaggaagaaatactgctttctaaaatgacattatgacttctttgctgtgaggtctgtgttgtaaatcatcacctctattccccaactgtgaaaggtaaagtccagtctctattgctctcttgagttttaaaacaacataacgtatttggaggagttaaaagaccttgctaaatattggtctgtgttaggaagtgtcaaaacatagacattacatacagaggaaagaagacttcaagggttaagtacattttcaaggtcatgacactacaaaatggcagagttggggcacacatacagaatttcagagtccaaatttttaaccaattttactttttttatatcgcattaagaggaatttatttgtatttccatgtatttacatgttgtacactattcatcttgtaacagcgtcacagtttttcaagtgaaacattttattatatttaaaatttttgtataaatatagctggaattaaaataattacataaaacaatgtttttaatacttttaacatctttcttttagaatagtcttagatggatcttgcacacgtattccaacaatgatgtaattgattaaaaataattgaaactatttattgaatagtcatctttttaatttatcatatgccttttattatcttaagcatgtaagatttccattgtttgatattagatttgaatttttggaaataagcctaacagtcatagaaaacagacttggtagataaaatatacaaccagcctgaataatacatttctttgtttttcctcaaaatgatttcataatcattaatcggcccatggcttactcctttggtaccatggtgtgtaaaatctataacatttctatgaaatcatcctcatctttgggagatttattataaacaatgacaactgaggtaaaaaaaaatgaaatagatatagtcttctcttataatttcaattagcataattctgtttttttttttttttttttttcgagacagagtctctctctgtcgcccaggctggagttcagtggtgcgatctcggctcactgcaagctccgcctcccgggttcacgccattctcctgcctcagcctccctagtcgctaggactacaggcacccgccaccacgcccggctaattttttgtatttttagtagagacaggatttcaccctgttagccaggatggtctcgatctcctgacctcgtgatctgcccacctcggcctccccaagtgctgggattacaggcctgagccaccgcgcccggccaggggatgtcttatttctctgcaaactttacaacgaaactcttaaaaaagacatgttagtactatggttttaatttttcttgtctcatttttaataatttactctgattaggctttcgtctccaactttctacaaaaactattcttgtcaatgccgtacatattaatgcctcctcctcactgagtctcatgcttagtcctcatctttcttgactcaacagtagtacttgacatggccgaactatttgcatccttaaaacacggtcttcacttggcttcagacattacttgatcttgattttccttttacattatggatcatatttcactcttttcccagtgttcttgaactccaattgttgacatgccattcttctcagtgcttgggcctctttatctacattcatggattgcatagtgttttatgcatttaaaaatcacccattcagtgagtattcccaaatttatatctctaatcctgtcttctcctgaaagcctcagacttgtatcccaactgcttatgtggcaatgtagactaataggcatctgagtgataaaaaattttcaaatctactaaggtagtttgaaatcctcttaaataagaactaagcatgacagtcaagctccttgggaaactttacctggaaagtatgttatatatccatacacctgacaaaggtagtagcagcactgggatttgcaacctcttagattactagggcctattaaaacaataataataataataataataaactcctctgtaggataagagttataattattgatctgtatgaataagataatacatggcaacaaacctttatttaaattgatttacaatttaagtttataatgcattaattacaataaaagctgtatttgttcaaaaatattgctaggcataaaaatagataatatttattaacgttagctaagtcaccataggcccttcacatatactgctaacttaaattgaggaaactattagtaagacttctgctttacactcaacgagataatctgcagccctccagaactctgtgctccacatttagataactactcatgaagataattcaacactaggagtcagagaaatctattcttgttcatttttcgctacttaccagttatgtgactttgataaagccacttatccactgtgagctttagattctaaatgcgtaaacagacatcctgttgcgtggtctgccttgcaaggtttttataagatatacataaaattaaacttgaaaacacctaaatgtgagacattatagttatttctgtagacacagtctaattattattgtagacacaggtatattttattcttcagttcctctcttgttagtatttttttttttttttttgtttgagacagaatctcactctgtcgccccgcctggagtgcagtggtgcaatgtcagttcactgcagtctccacctcccaggttcaggtgattcttttgcctcagcctccctagtagctgggattacaggcacctgccaccacgccaggctagtttttgtatttttagtaaagatggggcttcacaatgttggccaggctgatgtcaaattcctggccttaggtgatccacccacctcagcctcccaaagtgctaggattacggaagtgagccactgtgcccggcccctattttgttagtcctttaagggaccatataatcatataatatagtgggcaacctggtctctttctctacagattcaatttctaatcacgaaggaggagaaagaaattgagttgtgtctttgggtatattcttgtgaaatgaaattcagtggagtaaggaggaaaatatgaggcatatcaatggcataaatatttgtattttgagtggtgtagttggccaaaggattggcactagcttcaggtgtgtcctacttggcagtggtacaagtcaacatggttgtatgtgtcagttttgttacatattcaaatgtacagtataacaggagtctcagaggacactgtgatttctaaaaataagtaaggtaaaaatgggtttgtagttttagctgtttgtcctcttttgttccaattgcatacacatcaaatcaaattattcttgtggactgtttttctttatatgttcttcttctgtacccacatagaagaaatcataaactttaacaagatgataatttacatatcaaaaacttgatttaagccatagccagtacataaaaattcatttttgtttagtaggtttatgtctaattagctgaccaacagggggtgtgctaatagtgtcagataactgaagtaaatggtatttaacagcatggggttccaataacacaggagaacacaggagcaaccttctaggctttatttcattcaagtccataaagtcccctgtggtcgcagcagtgcatatttaaaatcagttaatcatgttactcatgggtgttggatatctttcaaaatggcctctggtaatgagctatttgtcctgcattgtgacaataagtctcttccataatttataaagctcatgcagatgatggttagagattccataagaaaataatgcagggatgttctacttcctgcttaattcctacttaaatacagttagatactataagtgcataaatctacatagtccacaatacttttgtgaaatatcatttcattttattatgatgatttttgcttttgtcttgttcaagtagttttaaattttggatgtgttggtgggtataggagtgactaaaagagagaaatgtctattgacccaactggtacttttcatactttttttccattctgtcattgtttgtcttaagtactctacattttgtaagcattgatctcatctttgcacactgtagtgataaggggtatgcatattcttacacatacagcttctcccctgacttaaccaaatatatcaagcaagaaaaacaaccctcttcagctagaagtcttcatcaagaaaacatatatgaagtatacatacgaatacacacacacacacacacacacacacacacacacacacacacgggagtttacaaccatacattacagagttctgcaaactcaaatagcattccattttctggacaattctatctgtagacatcagatgtactcgcaaaccgtacattgttgtttaaagttcttcaataagagattctaggcttttaacctgtgtttataattctaacaatctttgcatttagaatgcaaagtcttgaactctaacctttaagatgctggttttttacctttcagaggtcttctgacagggccctgccattgtacttccccatttcatatccttattgcccattaattaatagcttcaaggtttaaccgaacatagcctgtggataagttcttcttcatgtgggggtgtgggaggtgtgtacttcctgttctcaattccagctacaggaacatcctctctcaaacattgacatgagaacaagacagtgtaagacagtggaatcaataagctaatgaacatcaatacaaagtaaattctttcacctcaatttgaatgtgaagtaagattaatccttattaagaaagaaaatgatgcaaaatggataaatgtgaccattttgttttatcatgttattcaattcatcctaactgagcagttagagattttctagagtttggatggagaagtggatcatggtttcatgtaaaatattgattcacatggttttcagctttactagatcttggcaaacctttcctcctcccttcaaacacacacacgcactttctttaaacattctactttccattttcctttaagctcctaagcatgacaacctgggagcccactgtaaatgacttttctccaggtcgctgcttatggttacaacttctacacagaaaacaattttgccagtatttccctcatctcatcaagcacagcttcctttctgcaaaaacgacagcatccaacgtgcaatgactgaagttattataacatcttgttcaatgtaagcacagctgagttccttagaacatggtttgcctaaaggtcagatgctcaggctcaggttgggagagaaatgatattgaagggacaaaatagcaaacataagaagccacctttgctcatttctgcttcccagcataatttcccaaagcgcttggccctgtgacaacatacagtgctccaaaaaaaaaaaaaaaaaaagaggtcgaaacaaaataaaacataccccactacgtctcttgcatgagtcagtattccttaaaaaataaatgaccctaatcattgcttttttctaacataaaataatgtctgataggattaaaaattatgcctctataatctgtaatcatgaatcatataatctatcagtatcatataatctataagatcatatcttatcatataatctatatgagtgtagcttatagattacatcttatagataagatatactcttgtccctcattaccttaggggaagctctcgttcactggcagattgccatggctaattccagctgccgttcattcaaatgttaatacggatataggattttatttatttatggtagagttgtaggaaaacaaaatgtctctattaacatttctctattttgctaaaatattctgaaattataggctctgataaataatatgttatatcttataggtaagatacactgttacatccaaactttaatataattttacaggtactaaccccccattacctatatgtaaacatcagaatcaaaaattgatcccttgacttaactgaatatttaaacaagaaaaacaatcatctccaggtaaaagtcttcatcaaggaaacaaataagaagtatacacataaaagaatgcaccccgccccccgccacacacaggactatacaaccacacattaaagagttctgcaaactcaaacaccataccattttctgggcagctttatttatttatttatttatttaattttatttatttatttatttatttattttttgagatggagcctcgctcgcttgcccaggctggagtgcagtggcatgatctcggctcactgcaagctccgcctgccgggttcacgccattctcctgcctcagcctcccgagtagctgggagtacaggtgcccgccaccatgcccggctaattttttgtatttttagtagagacggggtttccccgtgttagccaggatggtctcgatctcctgacctcgtgatccaccctcctcagcctcccaaagtgctgggattacaggcgtgagccacctcgcctggcctgggcagcttgatttatgatccgtaggcatcagatatagatataaagtaaaaccctatgtcaaaagagtctgaagaaacacctgtctaaaagattttcctggactgtagactttagtctatagtcctcaagaaaacttctaaataaaacttacttccattctttaaaaacttaattttctttcactcaacgcagacctgtggagactaatgaaagaaagatcaaaggaagatattccagctggattatgaaggttgaggaaagatcgtattaatatgtatagaatttcaataacagcaagctaaagattgttgattagaattcattattctagagagtgttaaccagtttgaagagtggtctttttctaatttcaaaagaatccaacaacttaaagcagtctaaaatgatgattcaactaatcactaaatttaaaataaactgagcttgatatgattttaggttaagaaacagaatctacaaatgagaaagaaagccagtagtttatcctcctcctttgctgggttatgaggctggagtgggaaggaggtcttggattctgtttctataggtgaagaaaatcaggggcttgatacatcgccttactaggatgatgccaacaataaagatttcactgttagtcctaaatcttgtctgcaaagcagctgctgttatcttctctttgctgtggttcatcttaattagaaagactattttatggtaggaggaagtatagtcccatttattttgattatactacatgagaaattctaaaatcagagggttgaccctataatttagagagaataggaattttcagaagtgaatgtgtgagactgggcacaatgccattgtaatgaagcataaggcatagacatgccacttggaaatacatataattttttatgtaatgagtctgggaagttgaggaaaacctctcaaggctttcaaaactttctcttctgtgttcaagaaatagatatgaagacatgaatcaagttactttcattcctaaggcttcagtcatctcatctgtggaaatcaggcacttggcttccacgatctctaaagtctatctaactccactatgctgtcattctaactcttgaaatttttggtaaccacagaacattctaatgaagaaacagcatattgtcccttattaccttaggggaagcccttgttcactgacagattgccatggctgattgccgctgctcttcactccaatgttattatggatatagggctttatttatttatggtagagttgtaggaaaacataacatctctatgaacatttcactattttgctaaaatattctggaattataggctctgataaataatgttaatattaatcttattataatgtaatagcatattttatgagcttaaattcaaaagtatcccaagtgactttgtaaaaggaattctatgtgaatatatgtgtgtgtgtatgtgtgtgtgtgcgtgcgtgcgcatgcatgtgtgggcgtgtgaagttttgcagcagcaatagaagttgtgatgatatctcaaataaattcagtgactttaatattcttcccttttaatccagagtaaagtattgtggtctgactgatctctttgatttataaatctgaaaaaacttctctttgcttaaggggttcaaattaccttagtataaaatgcaaacttcttaacataaaataaagtacacctcagtaccagaattctgttagcctgtgtaagctttaggtccactgtttctctacctgatacaatctgaaatccagccattctgacctactttcgaatgcctgaattttctattttctttccagtgttaagcctttccagtgtctctctcctttgacagaagtacacttcccttgcctccttgcccgcaaactccttttcattcaggtgtcagctagacacatttgactttcagtgagtgggttataatcctttcatgatatcagttctacatctgagcacaaagatagacctaagattttaattgattagttaactaattcatatttaatgagcatctactactactgtgtaaaaacgtcacaaggaaacataaatatgaacaagatataaacccttgtttaaaatagaaatgtggaaaacacagacttattaatagtatagaatatcacatgcgaaatccaagtgctatgaaggtttagaatagagggagttacattttgttgaatttagagagcaatttatgtggatgttaccatattcaaagtttgcaagctgtatttgccctaaagacctttagctctgaaaggtacctctcaggctgctcttgggtgatttggccaaatatcaagtgagcaggtcttggatccccagattccagttcagatggagcagctccactgtattctggggcttaaattttgaaaaccactgtgtttcgactgcaataatggtatattatgacactaatggatattctccaggtgtttttcactatcaagaaaattgatgtataacaaacgtatccccttgaagtggcacttatttccccagtcactgacatgaaacagtgattcatcaattcgtggccttaagtgatactgaggtaactcaagacactatacacttgtcaggtgcattcattttcttctattagtatttatcagaaattacatataacatcgtgatgtttaagaacagcttagtaccctatgttaattgcaaacatgtcaatattttgtagcaggaattctgggttttgaaagcaagagaaaaggacatttcccttaagaacgacaaattcctgaaatacctgtggaagaaaaatgacatcttaactacagtacgactgacccatgaactccacaggtttgaactgtgcagctctacatacatacagcttatttttcgactaaatgccatttggaaatacaatcttctcaggatgcaaaatttgcatattcagagggcatactttttgtaaatgtgtgttttgtagggctgactgctgggcttgagtatgtgcagatttggtcatacctgggggttctgtaaccagtcccccacgtgtaccaagggactgtattttcttcacttgaatatgtgtcatagtacatgatttaaactactttcaatttctgtcttaatcctgttttgaactaaactaagtatgcttctctaggattcaagtgttcactgtatgaggtaaattaactcttccagtgctctagggtagcaattaatgccccagaggaggtaaattgctaaatggtaccccacagctttcggaagactgattctgtgtcgaatggttatgttcctctctggtggagagtagattactcccagtggttctttataggtcaggatccattttcaagtgggaaattagatttcatctgattggcaagctaaagcttctgaggtgtgtcatacaatagtcacgattagcctattgaagacataaatgtcggttatggaagctcaaaaagacagtaaataaatatgaaggcatgaaacaaaatattgggcagtactgcatatttgaagttttgtaagcaagtgagatttgtattttatcatgagctggaattttatatctttacttagaagcatagactattagtggtactccacaaacaccacaaatagtattcattcctctcttcatttattaaaaaatatataaatagatatatagacatgcagaaaacttttactctcgcctcctctttatgcatggttttgtgtgtattgcttgaatactctcactgattttaaaacacagtgctttttctatggatcttactctttggaaattttactttattttgaaataaaaactactttactatatgttatttgctcataatgtacaaatagttttgagtgcctattaagtatgatgcactacacggtgaaaacaaagcctggaatcctgacttcttgagctttacattctaacgagaaaaacgaaaacaaagctacacacataaattattacattgtgaaaagtgcaaggaggaaaacaggtaaggtatgaggtccaaggtagacagcacctggggtcagggaggtgggaagcagccacagatgaagtcgccattgagcacctcattcataagaagacacgcttcatcccgaagagtgtgaaggagcagcctgtgaatggcagagtggggtcaagtgattaagtgcaaaatcccttgaggcaagaaatatgttttcatatctgaggaacttcaaaaatacccatgtgactagaacaagctgggtggtatgagttcagatggagggaaagttggtgtcaggtcatgtaaggccttgtaagctaaaaataaagaagctgaattctattctaagtctagtggaggaagggttttaggtaggggagtgacacaaactgaattatagcaaaaatagcaatgatattaaatattcacacagcactttttttttttttttttttttttgagacggagtctcgctctgttgccagactggagtgcagtggcacgatctcggctcactgtaacccccgcctcccgggttcaagagattctcctgcctcagcctcccaagtagctgggactacaggcgtgtgccaccacgcccagctaatttttgtatttttagtagagatggggtttcaccatgttggccaggatagtgtcgatctcttgacctcatgatccgcctgcctcgacctcccaaagtgctgggattacaggtgtgagccaccgcgcctggcccacataacacctatttataccagagagtagcaatggtattaaatatttacatagcacttataataggccaggcatttttctaaggaatcaacatgtactaattttttctaataatcttatgacatagaactaaagcacagagagattagatgacttccgtaaaattgtggagctaggatgttgctgaaccaggattcaaggctgggcagtcacttacctgtgtggtagctagtgttctatgaatctgtctctatcgtctatctaacttctgtatttccaatctatttacatcaataatttaactgttaaaggttgtgcataagcaccataaaatggcacttgagttcatgggaacagattatatttttcagagaaatcattgttagaacacccaggactgagctctaagtgactctaacagtagagactgggtagaatgatgaaactgtcaaaagaaattaaaattagtaacccagtaataagaggaaactcaggaggaagaggtggcgaggaagaggtggctgacataggggagagtcctaagacaaaatcagaggtcaatgctgcggagagttgaaccaaatgacacgagaatatttgctagattacattgtgggatgtgtccatgaccctgagaagggttttcatgaagtaggaagttgacagacaggatcaagggtggatgagagagaatgctgacttagaacagggaggcagctcttttgaatttggtgttgtgataaaagagaaaaacagctggagaagaatattgggtcgagggagaacagggagccactggggatgccgaagagaaaatgataatgaaaatgttggctatgtagaccttcttgaagggacaaagcaagagagaattcaaagaataaatggaaggttcagcctttgatggaagagggacattctttgatcatcatacaagagaaaaaaagttgcttgcagggttgataaaggatggaaaagggcgaatcatgagtaagatctaataccgtttgtaaggaaccacactctatgctaaatgttttacatatgttatttcaagtaattctttcaaaattttaaatcattattattttttaaatttttaattaacaggcagtggatcttaggctcagaagaattaagtgatttgcccccaactgcaaatccactaattaccagagctgaaaaattaaggcaatcagcctcactccaaagcgtgatcagagagctaaaaatttacttagttattgaccagtcaatttgaagcccggagaactaaggctgacttacagagtatatgcaactcactgctgacagagtttcgtttagaatgcagttctcttcactcctactctagtattcttttcactgtacttatctatttttttcaattgctttagaggcagtatacattttaaagtaaaaatatatgagtattaattataaactttattcactgaaaatgtagtggtaattaagggaggaaactgtaatgattaaaattataagaatcaaatataattggttttcaagagagaaaaaaataagttaaaggactccgtatgactactataaattctcctagtgagaacaccaagtatatacaattagtttaaaaaaagaattttccaagttctttattaacttttaatcagaatgcaaagataattagacacagcctgtttatgtatggaacaatacaatgaaggacagtgttctgctttttggaagacacatacactacaggaacctttgaacatgcaattcagaggaagtttaatccttctgttaacaaatctgattaaaaatagcagtggcaatatttcaaaagttacatgtgtgtgtttgttaaatatttcttcccaatgtaatcgttttttaatcttcaatttttttcttataaatggttgtcaaatttacaagcccttactataaaatcccaggagaacttttaaattccataagaaaactgtatggtttttattcagtcttattatttattgtatactttcactctaattatgtaaatgtggtatcttgcagaatttttgtttgttttctttcttttatccaactgcctccaatgcaccacttcatatgcatgtcttttactctagccattgtgtgttatcataatcatgtctacccagagttcaaatggcttaatacaggtgtcacctcacagcacctctgctcagatcctgcagactttgcctctctctaaggaccctcagcagggcccacaggattgagcccctgttcctcaaaatggtggccaaattaataataaaacttgttttggtttccctttttccttttcattccctcattcttcacacatgctctccaggatggcaaactccaatgaactaagcactaaaacacttatagtaattaaatttctacctggagaagcataaaggacagatacatgtgtctttacttttcatatctaagtgacaaaatgaatcttaccttatcaaaacattcacagacacacacacagacttttatgtcagtgttttacaactacttgtctaggtttgtgattttataaaacaaatgttttagattagttaaaatattagaatttaactcattatgcacaaatgaaaaatgtgaactataatatggcaatgagtcagttgtgttttctttaaattaatcacgtggtcaaatgaaattcacaaaagagcctggggcaaatattttttgatatctgccattagatatgaaaacatgtctattaacttaataagccagaaataaaggggctgcttccactggaagtgaaaatgagagtaagtgtgcaaagtaactgaagttaaaccagtggtactattcctaattgcagtcacactaaatggaagaattcttatggtctacatcaatgctatacattaaaacgtgtattggcaataatagtgtctataataatgggagtatccttatttttacttcaattttcctctcatcatataatttgctgtgtcagactcaggtgaaataaagagggatgtatatatggatatagatagatatgtatagatatatatacacatagatatttgcatactgatggtgatttttgtgcatgaaaaagtgataatgtgttttctactagatttaatcattttctcaaaattctgtgacatagtgagaatttagacctgagagttttttcttaaaataattttttttatccgttagtctagaattttttaaatgccagaattataaattcattttgagtttttgggatgtatttctgataataacatttttctaatcaagtataagttattagagtattaaatactttaataagtatacgttattaaaaaccatttatccggacaaggcacgtcaattgctttgaatctgcagggaagaaaccgtgtgtcacattactcttcagacaacaatcataagaaataaacctacaaacaccaaacttcaaaaaaaaaatcctgcacaaaaagtatttttgaaatcagatgatgggcccaagaagaccaaagggatttaggatatgtggtcaaagttgttctttgatgtgtgtttgtgtattcagcttgtccatccatcaagggctccacctgtcttggagatattgtccatcatttatttatgtgcagagagactaaagtccgaactgatcttcatttcagtcatgcactgaatataagaattgtggaaaacattttggagctaagatacaccctttttttctgaaaagagaagttgtacttcacaggcattttggagtcttccagctcagatttacttttggaaaatgacataaatttcatagataatcccctgatccatctttagacagacctcaacattttgtcaggtcaaattatgaaacagaatcttacataagttttctcaatcatatctttccttgaaagaccatagttaatttcaaaatagacagtatatgaaaatagctgccttgagaaatatcagttaaactccagcattgtatgagaaccaatgaacaaacaacattctcatctctgccaaagttttcaaggagagtgcatgatttcatcctttagccatggtgattcattgttgatgactaatatcatggatgctcacatttatggaaagtactgtattgacacacattgtactacctgctttatacacatcgcctaatttaatcctcataaaaataccatggggtaattattatcaaatatattttaggttaagtaacctactcacttatcttgtaagcggcagagcaaatgcagttatacatttcattctatgcctgcatgattcagaaaaataaaacaaaaacatgtaagcctttggtgtacttatatatcaaaaaccaatttctttaatataagagtttaaaaagctgtacataatactactgtagatgaaacaaagtgtaatggaagacagattgaaaggaaatttgttactattaggatgcttgcaatcaaataatggggataaaacaagcacatacattcctcatctctgtatagacttaacattttacagagtcctttgagagactttaattttattgtatcaaatttttcatgtctaagttatctattcctttcagtctattctgtatgtaactcaattgcctttttgcctttgctaacacagaaatccattaaaatttttaaattaatggacattttaattacatcttcttccttagtactaataaaaatttatatactatgtatatgaatatgcatctagatgactatttcaatatcaatatatgaggagataaaatgaattttccacaaactatgattctgtgtcatctaaacattagcttgcacaggccttttaaagaaagcagagtgaggactccctggccagtgttctctaccatctcttctgcctaccttcttttctctcatggaagtaagaaaagaatccatttcatcaaaggttgaacattccacttcatccctgaattctctcttgctttgagttcttaggtacatctatattagatatcactttctcctctgcatccccaatgcccttttccctcctcagcatacctgatcctctgtccttgctgacctttgtatgtgtgtgttttctcccttgatgacatatccctcttcagctattgctctatttatattcagaatcccaggcaagcaacataaatagatgtctccaaggagtaagtgatttaattagcttgaagtattatatatattttcacacacacagacataaacatatatatgtatgtatgcatataaaacaaataagataaataactggaaaatatatgcaatgaagtcagtgaattagcagatgagataaacatcccagattggtatggtattgtacggtacggtgtggtatggtatggtttggtaccacaaggtctagtgtttagagctggctctgccagtcactatccctttgatactgatcaaatcatacaaaatcagtttcttcatccataataaagccttcccttgttactcagagttgctgttccagtcaaaaataaaatgttaatttatgatacagaccttgataagctgtatgaaccttacatgatactaatgtagtaagatgcaccacggttcattcagataagtgtcccagtgagtcctcagttttcacaaagtcatttcctatccccagttttgtttatttgtgcacctctgcatttacctagaacaagaattgttatattctaagtaattgccaagaagtatggtaacaaattcactactacttgattcttcagtggagaaaattatatacatatatatatatatatagatgcttgcctaaatgatatgccattcttccatacttttaaatactgtaacttgtgttattgaattaagccagccagtcaaaagcttgaaattaaacatagtattttcctatgaaatatattttttaacattataaaataaaatttggaataaaagcattatgtatatatatatatatatatatacatatatatatatactcataactcttcattcatttttgtgaatcagtctcattcgtagttttattgtacttccaaatcttcatttttctttggatcattttcctttgccagcattacgtgtgtgtatgtgtgtgtatgtgtgttttaaaagggccataagaggaaaacagcaagaagtctgtctcctaactttgaaacctaaattttagttttctttcacacaggaagtcatcttgtggatctaataatattatgaagttattctctttttgatggacatttaggaatgttttgatgtttcgtacaataattcaagttgcaagaaataagcacacacattttgcaagtacatctatgggatatgttctaaaaaattaaagtgcattctttgtcccttaacctatgatacgggcattctttattttgatagatgctgcagaattgtcttctaataagtcataggaatttacgttttcagttaaaatgtataacagttcttgttatataaaatgtataacagaaaggacttttgatttctatccatctgaatgatgaaaaatagtaagttatttattaaattattatttaccttcacatatgtatagtggaacactgagcatatgtttaaaagctacttgagtttttaaaatctgtaatctgtgctttactcattttctttattggctgttggttattttttactgatttttgatgcccctatcttgttaagaaaataatatttttataatatatcacatttatcacaagttactgtttatctttgagttttcttattgaattttgacatacacaaatggctcatatttactctttttatcagcagtgtctttgttagttcctggatttgggatatgcttagaaaagtttatcctaaacaaagacttgtgtacttttaatttattgtcatgtttaaatcgttgctaaatctggaatttattctggagtaagaagtgaagtagagttctaactttactttgattttgttttgttcttattgttgtttttcttccagatttgttatctagttgtataaaaaccaatgattaaaaaaaaaaagttttttcttgctgggcaaggtggcttacgactgtaatcccagcactttttgggaggccggggcaggtggatcacttgaggtcaggagttcaagacaagcctggccaataggtgaaaccccatctctactttaaaaaaaaaaaaaaaaaaaaaaaaaaaaattagccggcgtgacagcatgtgcctgtaatcccagctacttgggaggctgatgcaagagattcgtttgtacccagcatgcggaggttgcagtgagccgaaattatgccgctgcactccagcctgggggacagagcgagactccttttcaaaaaagagaaaaaggaaaaaaaaaacatttttccttaatgattttcactgtcaaaattattatttattaattaaatatgtgtgcattttacaagatgtcgagactttgtatcatttgtttgtctattcagacaccagcaccaaactgtgaattaatatagccttaacatatgctgaagcatttggtagaactagtcgccactcattaatctttttttcttttgaatactaaatttttatgtaaattttaatatcagcgtgccttgttccaaaggaaaccacaaaataataaagacaaagacaaatgaaagaactccccattatttgtatggcaaatgtgtgtacttatagaataatttggtgatttatatttgttatgtttataatatggatccttatccaaaacgtgcaaaagcccatttttatatgtaccttaataaagttttaagatttctttgtgatctatcaaatttattgttaatttaaaagcttgatagagctatactataaattgtatttccttaattatgttgcaatagtaaatgttgtttgtatatgatagctaagaatttttaaaattttaattttatattaagcatctaagatgaattattctagaagatgtaataatgatttttttctcctcttcaattttctatatagctaatcataccataattatcattataattttataattctgctccatccattttctggtgtgcatctgctatttcatcttttttgcctatggactacccttgcaaaatgttaaataatggtgataggagcctcaataatgaggcttttgctactttaacaacatacagtgttaaaatataactctcttgttccatgtgtatatttacatatctatccttttaaacttatgtaagttattttgcaatataatatatgccagtattagtttttttttttttttttttttgagatggagtctcgctctgttgcccaggctggagtgcagtggcatgatctccgctcactgcaagctccgcctcccgggttcatgccattctcctgcctcagcctcccgagtagctgggactacaggtacccgccaccgcgccagctaatttttttattttttttgtatttttagtagaaacggggtttcaccatggtctcgatctcctgaccttgtgatccgcccacctcggcctcccaaaggccagtattagttcttttgtgtcatttaaaaatattttgccagctgggcgtggtggctcatggctgtaatcgcagcactgtggtaggccgaggtgggcggattaccctctgaggtcaggagtttgagaccagcctggccaacatggtgaaaccccgtctctactttaaaaaaatgcaaaaattagctgtgcatagtggcacatgcctgtaatccaagctactcgtgaggctgaggcgggagaattgcttgaacctgggatggggaggttgcagtaagccaagatcgcgccactgcactccagcctgggcgacagagtgaaactccatctcaaaaaaaaaaaaagaaaaaattgcatatataaatttttaaaaatatgttatcgttttaattagaggagtcagagagaaataaaggtaattgtaaagaagaccctatatttacaaaataggacaatgaagaggatattagttggggacagaatgagtggaaagaacagatgttaaaatctatcttaattaagaagcacacttaaaggtccatttataacgctctcagtactcatttttaccctggccatatctttatcttgagtaactaatgaagtagaatacgacctatgcagttatgctaaagaagtttcgcgaattcctaatttcttttcagccaatgccatagaatggcttatatgtattataaatggttttcagagtagcagattttctaacacttaaatggacacaaaaagataacaaaccaaaaagagatagacagataaaacacttgaaccatttcatacaaaatttctctgagatttgtctactttttaatttatttgattacctatattaccattcctccatttacatgaacaaataaaagtttattgaaaagttcaccacatgttttaaaagcaactgaaaccaattttaatttctaagaagtaatgttattttcatgttcccaaatgatcacttcaaagaggcgagtaagaggcgagtaagaaggaatataagctctattgttaataaacctagacgtaccctaaatgaagaccaggagtgagtgaaggttggtaatttacttagtagagttgaggaacatctactctaggattctccacaggagttcagctcaaatgatcatttgaaaaatgctaaggatgcgaagagagagaaggcaccaaaaagaaggcaattggaaagcaatggaggtacagaaaaactcttttccctcatgtttgtataagagacaatagaactttgggttctcaccacaaaccttgttcattcagatgactacccatcttccagctgtctatgagacagatcacatattacctgaaaaaatcgtgtgaggagctctggagaaaggcatgtgataataagaagggtgaaactagtagagaaaattaaaacattaagggaaagtcagcatgctgaatggtaagattatccacttcgctgtacttcagaaacatggcagacattgaaaaatccttctcagggcaaatagatccaccttggagaaaagacatttaactgcagacatttggggatcttccacaaacatctaagtaactaactaacgtttacaaccatgaaaccgtgaagtggacacgattctcttcagtatcacagagtctctatttagctatttggtgcctcgccttaagccagaaacaagacttctaagtatctccaggcatttgaggaaaccttcagacatataaggagagacagtaactatacacagaaaaataaaaggaacttaacacatacacacacacacacacacacacacacacttaggcatgaggtcaaagcatcaaaggaagcaaagtgagagaagatttgatgtctttatgaaagcagaattttcttttttaacaaatattagaaatatgttgaaaaaaatggaggcaatctcccataaaatacaccagaaagataaaaggatggagtatatgaagcagtataaactcaaagcgtccaaaatcctagaattaagattcctggaagaataaaggaaaaaataaaatgatggtaaaaaattgccataaatataacagagaaaatattcccaagactgacagacatcagtctccagacataaaacataattgagaaattttatagaattggggtacatacggaagatccacaatggcttccagaaataaaaggtcatatacacgttatctggaattgtatcagaaacaccattctgaaaattcgaagtaactggatgaaatctttcaaaaagttgaagaaaaatagtttttaatcacattcctaaacaggtttgagaatgttttaaaactttcaatcatgtagtttttcaaaatgtgtgtgtatgtactttttctggtccaaggatatatttcatttaaacaggggtgtcaaccaagaaagaggaaggtatatgaaatagttgaagttgttgcctttgggaagcaaaatagacaaaaaagataatggttacagaactagggttggctttgtttttttgtttacgtttttaatcaaatttggcttttaaagttgtatatgtgattatgaaaaaaaaagtggctttaaatgttctaattcaaaagtaagttaattaaaaatatctaaaatcacaaatgataaagagcttccaaatttaaagcatttatgaagtgcacagattttaccagaaattcactcacaaatcttagcaatctcgatagtcatagaaatatttaatgtcttctcactaaatgtgttgtatatccttgctgttaaaagatcagttatccttatacttacataaatatgctacaaaagctaagaaaaacgggatgactagaaagatattcacaagaggccacattatcattaaaaattcactttagctgtgaggaaggatttaaggaaagagcctgttcttagtaggaggcctttgatgtagctgaataagtgtgtaactgatgtgagtggaacctttttaattgacactgacaatgaaagcaaatcttctgggctgctcatcagagtcagaggggatatgggaaattaaatattgtgttctagctttttctaaagcctataaagataatcaaacaagaggcatcttttaaaatctatttgtgagttgatgccattcatacggattaaaataaatagtacttgaatatatgtggttttggtttattttaagcgtcttttcaacaattttatgattttgtaaatggaatttacaactaagtaagtgaatgtgcaactacagaatttgtttaaaatctgatgaagtattatcagatatttacgctgatatgctagtttaaaaattctcatatgctagtttatatatttccctgaagaaaatatattaaagtgtgattcagatattatttcaactgctgatagaaccacaaagaaacacattacatattgcctttgaaagatacactggaaaatttatttttaaaacttcacttgtgttcacaaaaacaaaacttcttaaagcaatgtcatttccctcatttcactgtttcaataaacaatacatttactaactagttcattgcttctctgttaccagactatctctcaacaattatttcaaccattgcttttactttcctggttgaaaagaaatgcttttgctctttctctgcactactgtcaccagtcatattgcaggagtatggactccagccagaataaacctctgtgacatctgcagagacatgcggagaccagagcagactcacccaaacaatcacagataatcttcttccagctaaaaccacacactgagcttcagcaccagtcctgtcagagaagggattagtgggtgccttttgctgtttgcggtgtgaattacattcatctaatatgaggctggattgaatcctagccttatggtcctatgatgaaagaataataaaagattggtggcataaagaatctaacagttcctattctccgaattataattagttattactacagtttatagtttcttatggcaaattttgtgagatttgaggcatgtttaatgaataactctgattgcttttaaaaaggcaaccaaacaatgaaataaatatttttcccatttaagtcagttatttaaacatacttgattttgtagatgtagattcgatttcatcgtgtgacccagtgtacaacactgaatgatattaagcaaggtctcctgatgagaaattcttataatctcctataacttactcttatgtaaattcccttaaactatcccttcatcactgtatgccagatacgtgggaaaatctcccataggttaaaccttcaccttctctttgccttcaccctaacagaaaaaaagtttgctgaagaaagtcacacaaccaggttgactggttttactttaaaatcatgagcgtataactgccaccaaattgacactcagcattgtagggtatcttgctacctctccccagtaagatagggttcccactcttttagttggctgcttgccttatgtttcagtaaaaacaaaactataagagcgagccaccataatctctccacaacctaatttagaagtttgctagtacacatatctatagtctttgctttttacctctggatacaatggggaaaaaaattgtagcttctttttttaagtttaattgcacttcttgtgctccgaattccttactctcttagagtcttacagatttaatctattcgttacctttgttctttttcttcactgctcatctctcttctaaataatcattctcttcagaatatacagaatacaacatgctataatatttctcatcgaaagcaaacacataaataaaaaaagaaatgttaaaaaaaactttacaccataagggttttcagtttccctcattttttggctttctacctatcaaaacttcttgtaagagttttctatattggctatttttattttctgttatttcatctgcatgtattgttattgttttttccagtttatattttaatcaagaaataattcccagactttggtatatttctcatgccccatgacttatctgaacacattgttacggtataaatgcatgtgtctcatccaaatctctattgttgtaaccaaagacccaatttgataatattaagaggtagggactttagggagtgattatgtcatgaaggctccatctgccctcatgaatagtattaaaatcctaattttagggctcaagagaactagctaagcccttttgcccttctgccttttccaccatgtcaggatatagcattagtcccctctggaggccactgcattcaaagcatcatcttagaaccagagactgggttctccccagacattaaacctgcaggttccttgatcttggccttctcagcctccagaaatgtgagaaaataaatttccattcttatataaaatatacagcctccggtattttgttttagcagcacaaatggtctcatacacacattggcaatgtaatgaaactcagaaaaactctaggctctccactgagtctaagttccatttcattttggcttcctcacttcagctgcttttattgatgtcaccagttgccaaattcaacacagagcaatgtgctctcttttgtactttgaattatacaatactgtggaggattttcgcctataaaagtttttccatcttagcccaagtgttccacatgcttctcgttttctcccattcttgcttacttgttctcctcaaggtccttttctgttttctgccgtctacctgctgagtgtctaggtttaggctcctttcaatttctatttgctctcttactttaagtaccacctatatactgatgactattaagaatatatctctgaccctgatggctcccttaatcttttgggtcatatatccaactgcatgcttggcagttctactggattgtctaatgagaatctgaaacatactatgtccaaggagtaactctagacccctcccagtcactaccggccactctctacagccacttgatcaactttttatcttgccaacttctctgtctcagtaaacattatctctgtctacccagttgctcaaattaaaagcctggaataagagtctttatctttaatgatatatactaatatatttagagtaaacttatatgatgtctaagatttgccttgtaataattagggcaggggctataaaagaaacattcatcatgagttattaattgttgaagttggattatgagtaatataacatgcaaattctgattcaataggcccaacgtggggcctgagatgctgcacttcaaacaagctttgtgctttcagtacctcctacctcatccacaattcttatgttactatgctacttattttcttaatgggaatttcataatacttatctgcacttacttatctgttatccttgttaattttctgcctttctccctataagggcatgcattgtatatgtcttacttatcgccacatcagaccagctcagtgcttggagagtaggtgctttataaatatttataacaatgttatggagggcaatacaggaaataataacaggtgaacaataggtgtagatgttagtgcagtgccatgaaactgaattttgtaatcttggttgtgagattacaaatgatatttgagtttcactctcaaaattctggattaattggcttgaaatgttgccttttgcagagcttcccaggttaattctaatgtgccagcaaagttaagaaccactgccttagatcatgacgatgatgatgatgatggtgatgatgatgatgatgatgacaatgacgacaacaaacctaccatccactttgctctttgcttggagctatttcaagtactttatgtgcattaccttatattattcttataagaatcctatgaagtagatactgctatggttatgttagaactgaggaaattgagatgtagaaatggtatataatttccttaagatcaaccaatttatacatcatgaagccagcatttaaccactatttaaaccaaggcaatccgagtccatacccttagccattgacttaagatgatggcatacatgttacaagcactgggaaacaaaattgtgtgtatttttatttctaacatatcactcatctaaacaatgtgaaacacaatactcaaatatggcaaatgaaggagtaaactttcttgttttccctaaaatgacgactttgggactacttatacatttgctgaagcaaagtaatcattttaggtcccaaagctatcattttagagaaatcaagaaagcagagagacagagataaaaatacaaggaccatcatgaattatcaataactcaagaattactgtgcttggtttgaacaactagagcaacagacatgagccctgctcttcgcagagattgttctggtcttctctggctctcctttgcctgcatcccacaaggcacagtgtgtgtggggcctaggagacttgcctatcttgagcctgtgcctctacacacctcttttaaaccaatgctcttagtacccagaaccttgggattttctgcagaatgggtgcctctttcctgggtatgttttctcagtgaagagtaaaggtaattgtttgagaggagggtgaaattgtaatttggaccaattaactggggactaatttgtgtgtgtgtttcagaggcttatttggcatatgtatttgagggatgttatcagggaggaaattggggtacagactttggacatctacttgcattctcaccctaaaggtgcatctgcggtcaaattccaattccagagataaggtcaaggagttaatcttaagaaagtaaagggtaaatcttgaactgaagatgagactctagaaatactctgttatcttaggtatttgaccaatggcaacttcttccctattccattctcagactccttgaggaatttggcaataggtaacgctactcatgttaagttgctataagatagaaatggggcttccattgttcactcttcctgtgttaggagaaccaatattgcagtttgtcatcttgtggacattacattctcaccaaagaagcctcctttgcctcctccaactctgtttgacctagagattgacaaaggaatctgcttaggatcacttgggattcttctttctataggcatgtgggacgataatttgggtcacgtcctgagattttaaataaatttcaaaagtgcaatgaggagtcagctttgtaaaagaaaaaaaaagacacttccataacagaatttttttgtagctttcaaatttagctaagcatttgtttcctactgaataatcaacacttacagagcctgaagttataaatgtaagctgttttaaaattatgtacagactttctgcaattattttttctagaacaagaaagtgtattctctttccttttcaggtaacttaaaaagagctgaatatgttgaacttaatgtgctttatgagaatgctgacttcttaaatgaaaataaaaaatattaattttctgcttaggaaatgttgagaacaatcagtctcataatgattttgcattttaactgagcatatccctgtatactgcaaaaaatacactcaaattgcccatagctaccatgaaaggtaatgatgcagtacacttaattactgtttagcagtgcttttttatttgagtattttgaaatattagtaaaagcgttatatctcatatttttatgaaggacttcaataaaaatgtggtaatggagatcggttaaataagaatttcaaaactagaagtgattttttttctctaaaagtaactgatgtcgtctttttagaaaagagaagaacaaaattaccatggaaagcatttctggttttgtctcttcattattcttggcacaattaccaaagatgttttgaagatcttggccatcatagtaactgatcttatctttaaccatcataaaaaatttctggtgtattaaatgtaccaaaatattttaaaatattttttcagttatttgttttgcatttcccattactctacctatgtataccatgttgagaaacagggacaaattattctttgtttgtatcatttcttactgtatttacacataagtacatatgttactaacttcaaagaaaaaaaatatttcttgcttcttatgcacgttctttttttttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggcctgcacgttcttatatactcacctcccacaatgactctgggcttgaccatgtttctttggcccatgagatatcagcgaacatgtcacaagcagagactcaatgcactttggcacattgggacatgcttttttaatcattgacctgagattgctacataggaaatatcaaatctattaggcttttgttcacaaatttgagaacaaatctataaggatcttattgaagaattgccatagtagagttacaatattaatcaaaaatatattaacttcttttttaaattggatgagaccatgtatcctagagaaagactactaactttagaattctgtctcctctttccagatatgagaccttggggaggtcatttaaactctttgtgcctgcttcttcatttgtaaaatggtgataataacagtacctaccttgtaaggtttttatggggaactaaatgagttaatattttacagtgcttaaaatattatagggggtacataaatataatagttgtcaaataaacagagaaggattagacatcggggttttatgaggacaagctctttgtaaaagttcaaagacctatatcagttacatagagagtaaagtaccagaaagaagagctaaagataagggcttataagattcattttattttgggaagaaatctcagggacagaagtaaaggactagagagacaaagaaggagggaaacacaaatacaatcgtatttttttactgctggtccgctgggcttgatcttgcctagggctctgtagactgcgacttagaaccatttgtcccagggaaaatcagaaggcagcgtttatccatgagctctcatccttccctgattaaggtttgcccccatatgataataacttctttggaacttgaatgttgttaataaaggagttgtggttgagtttcttcaggttgctgttttggtagcattaaagaaagcctattgaaaatatcaagatatttttctggaaagcttgagcaaggtattgtcaggttaaacctgttggaaacttatgacaaagtaatgcatgaaataaagggtagactgaaagaatatgaggcaagaactaagaagatgcaatgggggaacaagtagatgtcacctagacttccagacgtttgcatcttaacattgcagaagcaggtgcaatcgaacagaaaaacaagaaagaatagtgcatagaaaaaggaagatggtaacctacttgaagagatgaaaggaataaaataattttcatgataggcaggaagaagagtaattggggaaagcattgatttgctgaatgttttcctgtgctatttcatttttatctaatttttgatagagaagtttgcttgaaaacaaggtaatttctgaggttttctgaaaactatgtcaatgttcattaggctacaccaaacttactattaataaaattgcataattactttataaagtacatataattacttttcaggtagctccatctagcaatttaacaaataaaatagataagtaacatttaaaaattttgacaccaacctgaccatggagatgcatagaattctgtaaataggataattcacttaataagccagaggtgataatccaatctccatatcaggatctgcttaaacaaataaagttagcagtcctcattagtgctgtgaactgtacttagatgcttttagaacggtgctgccatgagttatgactaaccgagaaaaatgtattctatagccaaatgaaatcagaaaaattatttttaaaaaatatcaaaccatagatgaagaatttgaaacgactacataaaacctttgaaaattaactcccaatgtaacctatgagattatttttagttaaaaaatatgattttccccttcactgataattttctccaaaaatctctttcaaccttttgaaataccattatagctgtaaagccttctggcatagctggcattttcattgaactcattgattaatttagtatcatggaaacaatgtgaatctgtgtgaaatagctacagattgtgagagaagttggtgtactttattctgaaatgtaaaaataatatgctgcacaagcatgctgattttaaggaagccatcagtatcatagactgattaattctgtgttgctttgactgctaaaatgtgctcttccaatcaatttcaatccaattaataaaaattataaactggatttgaatatctatttaacattaggtcttccatgcagtttcacatactgtatatcacttcacaagcagtatggcatactggaaaggtcctcaaaatgggagtcaggtagctggtttttaacggcatttctgatgaaaatgatctggtggaaaatttgggatacctttctgcatttacgtattatttatttcataaaaaattcagctacatgattttaaataccccatacattctaaattgtaggatataatttaatatagattcactttttggtgtgacctaggtgaatctgatctttcaaattactagtttcaaactttacacttacacatttcccactgctaattggtaggaaattaacttggtatatttcttatttcttctgttttattagttttgtttttataattttgatttcctttgataaattctgaccatagacattttgagtaaaggcacaatatatcatttggacaatagtcttgttttcatttggatgttaactatcactatgaaagtggagatgccttttttggaagagttatcatatctagagtcagtatctctggcttttttatgtgttagcctcagcaaggtttttgatagcataataagtatcaatgaattaggttaattttttcatagagaatggaaaaatcttaccctcaacctgtttgttagctgtaatgtaaaagagtgtcactgattcgatattgagctttggctcatgctcagatggcttagacagatgggccatacaagactctgggcatccaaagtctcctgcggagaaaggaacaaaaaagaaatttctgaaattcactgagcatcttagaaaatacccaaagaaatatatcagaaagtaaaagtaaaataatgcaaaatgtggtacataaagtgaattgtgtgctcctcttcccagaaaaattagcaaagttaatgccattctaaacccaatcatattgttagaactttcgttgtacagaaattatttctgcttattgacatatgaagatcagtggagcacaagactcctagcttgaaacatttgatcaagcagtgaagatatccagcatatcataaaatgagaatcataaaaccatgctgaaggagtttgtgagtttagccttttctgagtcatcaaagacaaatacttattaatagaattgtatgttataatttattatatgaaatttcagattttattttgagctaccatatcctctgtaagtattaaatttattagtagttaaatatttgaaaataaaccaaaaggtatttgttctccatgtctttttgaatcaagtatcattgtgtaatcttatgtagagaaagagtactttgtaattgatcagtttattaataagcacaatgtttcttacaagagacagccaagactaatggttaaaaaaaaatgtacatacacacatactcctcagtgaagaaacagaattgggtttaaagttgggactatgccttttgtcttctgaaaggccttttgactccttgactgtgttagtcttttttcgatgtaattattacttcccctaccataatgtcatcacacttcagtagtttatttgcctgattgagcataataataattgagggcggtaaatgggatgatctggttcactattttatcatcagtgtttggagcaagccagaaacatagttggtcttcagtatatttggtgaatgaataagtccttatttgtatagtcactagactatacattgtcaatcaaagtggcgcagcatatacatgttaagctgaactcaacttttcactgatccaatttgtgctgcacccttccattgtatgaaatcaccatattccatttttttttctaccactaggtttccttccagctctaacatttcttaattctactgatataaattattcataactcctattgcttgtaatcttgttgctcttccagggctagaaaagtcctaaagggcttgcctagggattaaagttaattccctacagtattcccacctgtacagagccatggcatgggtagtgctgccccaggggaataatcttgggtttatcttggttttaaaactggtaactgaaaaaacaaaacaaaacaaaatgcaaagaatacccacacatcccaatcaagtgacatatatgaatgtttgtttataattcagctaagaatagttaattcacgtcatgcctcatgattaagtgcaaaccatttcaaaatatgaaacaaaacaaaagataatttaaagtccagccaagtaatctctcttgtacttgaatttggatgagatttatttgatcttctcacctaaattccatttataattagggatactcttgcttttctgctgtctcctcactggagaaccaaatggctggagattgactgattactgatcccttggggtttcagagaagctgctttctcataatatcagagttgaaatagttttcattccgttgcaaagatatatgttttaaaatgcttacagtaatgggttgttaactctatccttccctggatgaggtttctatagtaagctgtcattgtattacaactgttttaaaggatagataaagtaaaccaccttctaggtagtaaatggcaaacaatgtgtttccattattgaatttttattttcataagcatatcacatacaagtagtttaaaatcagatagtactaaaacaggcttataatgaaaaatagcagattactggcctcattccctgctggccttatccccaacaggacaacttgctgtcctgctccctgggtcaatagctttcactttcttagctgtttcttctggtgtttactcttatattcataaataaaatatatttactagtatttctgaataagtatattttatacatgtatttattttctatcctccaacacccaaactcccatgctcatccctcctcccctccatttgtcccattatagaatatatcaaaagtttgaattaaagcaatgttcaatgctcacattattttgggtacatagctactgtttaaaattaaatcacttggaatactgtaacttcacattatgttttatgttttatttgtatttgtattaatttatttttttgaaacagagtctagctctgtcgcccaggctggaggacagtggcatgatcttggctcactgaaacctctgcctcctgggctcaagtgattctcctacctcagcctcccgagtagctgggattacaggcgcctgccaccatgcctggctaattttggtgtttcagtagagacggggtttcaccatgttggagactggtcttgaactcctgatctcacgttatccacccaccttggcctcccaaagtgttgggattacaggcgtgagccaccgtgcctggtccacattctgtttcatataacttgttattgtctttattgtaaataattgcctcattttcatattggctatattttctctgtatcattagttcttttccaaaaattttagcagtatcatataatgcttcagagaatgatataattcatgaaatctgtaatctagcatgttatttcctctttgaaatagtgtgcccctcaaataccttgacattttcctttaaggttgtggtttgagatagagggaagactggactcaagttcttgtttgctttcaagaactcaccaagtgaagggagaatgcccctaaaatagagaagccaaagacactctcacccaaaacaaaccccaaatcacagtccccacccctaccctataaaaagcactcccaagtcaagcctcgtttaggaaaacagaatttgaggaaaacatctttgaagctgtaatttaccagcccttgatctttgaggaagatgagaagtgaataatgcccatgtgtttttcttactttccaagtgaggtctggggcttttgggctttaacttttctggatttaacttccagagcacctgcactggaggtcatagttagagcagaaactattcaacccaaaaccaccagagagaacaagagcagacattcaagatccttgtcagctgcctcctgccccaggtgactcacagaaacaagcttagaacagcctactccccttcagccctagaggtgtctcagtttatgtattcattattccctttcatttgtttcttctctacttcttccggatgggtagaccttggaagaggatgccagtcttcctagtactttctcattttggtaggacaaatggtcagtttcatgaagtaatatgtttactcttgctttcttatttcataaagagatgattccttgagacttagctcatgtgttcaaaaatagactggttgtgcccaaaccctactgcatagtagatgggacttaatatttccatcaggctgtgcaccttcttttccaccttgttctttggcatctatgtttctggctgttttattcctcattttggtggagaaatgaggcctcaacctcctgggctgaggcaggagcctccaccagcttcctaagaaagggtgcacccaggagacaaaattctgagacttgtatgtcaaagaattcctttagtttacctttcctctcgataaatctagacatttagggaaaaataatttttcttcaggatgctaaaggtatttattttacagttttctgtcatcttatttttaagatgacctattctgagttctgatttttttatatcatgtgtgtgcatgagtgtgtgtgtgtgtgtgtgtattctttatttgaattttctaaaagcttttggtatcttctcttgatatgttttagtttctttttattttttttttaatttttaacatttattttatattttttcttctcgggaatgcttttggccgggcatgaggtctcacgttggtaatcctcgcactttgagacgctgaggcaggaggatcccttgagcccaggagtttgagaccagcctgggcaacatggcaaaaccctgtttctacaaaaagaaatgcaaaaaattagctaggcatggtggtgcatgcctgtagttccagctacaagggagtatgaggtgggaggatcacctgagcccgggaggttgaggctgcagcgagccatgactgtgccactgtactccagcctgggtgacagagtgagattctatctttaaaaaaataatatttgtgggtatatagtaggtgtatatatttatggggtacatgagatattttgatgcaggggtacatgagatattttgatgcaggcatgcaatgtggataagcacatcatggggaatgggggatccatcccctcaggcatttatcctttgagttacaaacaacccaatcacactctgtaagttatttaaaaatgtacatttaggctattattgagtatagtcaccctattgtgctatcaaatagtaggtcttattcattcttcctattatttttttgtacctgttaaccatctctaactcctcaccagccccccactacccttttcagcatctggtaaccttccttctactctctatgtccatgggttcaattgttttgatttttagatctcacaaataagcaagaatgtgtgatgtttgtctttctgtgcctggcttgattgtagatcttgctgtggctcctttcaatctgttgtcagaagaagatgcagagacaagcatctagagaggaaagaaaagtcacatagcatacaggggatcctgacttcagaagaactggctttccaaacaaattaatagcacaagtgttgaaaggccaaaacaaaacaaaaaaactataaaatttctaagtttactcatcctatctgtggtgaaataacagtgtctttgtcacgtgattattatattcgcaaaaggcttgacttattttcagacatcaatatagcaaaaatcaggcacaacattatttttattatggagcaaattgtaggaaatagtcacacacacacacacacacacacacacacacaattttattccctatataaacctaaagaggactgtcctaaagaggacatctgtgttttagttttgcttcaaaactgaaaactgatgttcttaagttctggaaaattttattaatttttcttcttcttatctctaccattgtcttaattctttttgtaattcctagaattactttttcctactatcttttctatccttttttctgtctttgtctttttgttattctttctggaaattttcctcaaattttgtccaattcatatcaacttttatttttaattttaaattgtatagcttttattttaaaataagagctttttcttgtttgttttctttccctcctttttctatagcagctgttctatttttatacatgtaacatttttatcatccctgcattgtcttttctctgagccatatttctttttttcttttttcttttcttttttctttttttttttttttgagacagagtcttactctgtcactcaggctggagtgcagtggcaagatctcagctcactgcaagctctgccttccgggttctagcagttcttcctgcctcagtttgccgagtagctgggattacaggtccccactaccacgcccagctaaatttgtatttttagtagagacaggattccaccatgttggccaggctgatctcaaactcctgacctcaggtgatcctcccaccttggcctcccaaagtgctacgattacagatgtgagccatagagcccagccccgtatttctttagttttggtctctgcctttcatattgtattctggtctcaccctaaacttgcctaataatttttagtaattaaaaagtaatattttacttttagtaaatattccaaaagtaattgtgcaatattactttgttaatatttttaaatttacttctagtaattaaaaaagtaaatattttgctcttcgtaaatatgtaaatacaaaagtaaatattactttgtaaatatttgtaaatttacttttagtaattaaaaaagtaaatattttacttttagtaaatacacaaatagtacaaggcattagaaactaggtgccacattaactgggtgatcaaacttagtatcaccactaatggaacatatggacatgatggactgtaggatgagacccattgacgactgcaaagtgtcacaacataaaccgaatctaatcaggaggaaaaaatcagacaagttcagattgtggccaattctacaaagcaacctgcttaaactcttcaagtatgtcactcatgaaattaaaatatatgtatatatatacacactatatatatatattctttcatgtaataaaatacatatattttcatgaaataaaaatatatatttttttcatgaaataaaaatatatatattttttcatgaaataaatatatatataagtctagattgtggcaaattctacaaagcgactcacttaaactcttcaagtgtgctattcatgaaataaactaatatatattattatattattatacatattataatacgtattttagctgggtgtggtggctcgcgcctgtaatcccagcactttgggaggccgaggtgggcggatcaaggggtcaagagattgagaccatcctggccaacatggtgaaaccccatctctactaaaaatacaaaaattagccggacacggtggcacgtgcctgtagtcccagctactcaggaggctgaggcaggagaattgcttgaacctggcaggcagagattacagtgagccgagatcgcgccactgcactccagcctggcaacatagtgagactctgtctaaaaaatatatatattattatatatcgtaaatatatattatattatatatttagtatatatatttattatatattttatatatataaaataggctggggatgttttatagttaaaaggacatgacaagtaaatgtgatgcctgcttcttgattgatcctgggacgaagtggctgagaagcatgatctggggtgagtaaccaataaacaaagcagcctactgtgattctgttggaagaaagccttgctttttgtgctggagcatcgtcagcacttagatgatgtgagcttttctacaacccaaccatctgctttttatctttcaaaacatctctcctcatatcttacatactatagcctcccctgtgtgttttttgtgggtttatattattcttattatagttttatgagattgccagagggagaaataatttatgttcagtatgtcttattaaatggaagtcaaatatatttttaaggatgtaacttcttttctacagccccaactttgatcttatacattaagcataaatctaagctaattctaatttctagtcaaaggttcaaatgactatcaattcacttcaacaaaatacatacctgtggtatttggttttctgttcccgcattagtttgctacagatcatggcttccagctccatctatttccctgcaaagaacacggtttttgttgttgttgttgttgttgttgttggctaaatgattagaacccatggacacatacaggagaacaacacacactgggactttttggaggatagagggtagaaggaagagaggatcagaaaaaataatgaacgtgtactaggcttaatacctgggtaatgaaacaagctgtacaacaaaaccccatgaaacaagtttacataacaaacctgcacttgtacccccgaacttaaaataaaagttaaagaaaaaagaaattcataccaatttaattgcttttaataaattttggtgagtagtattaagaaatcatatgtatttacatgataatggttaaatgcttgtgtgcaggtatgttagaataacctagaatttagtactttggttaaggtccaccttggagattggtgtatgccttaagcttcaatttcccaacttttaaatgtcattaataataattataaatatttcatggtatttttgagaaataatacatgccaatgacttatgacattaataaattttatgatttctgtaatattatcttcataatgatcaatgatgtaatatcattgagaagtatcagaaagtagagatgtttcacaaacaaataaaaaatcaaacaaaacccaaaattggaatgtgcattataatgatgtaaaggataaagaaggatgaatcaaaattaattacaaataatcctctaaacgtttgaccaaatcagaattcatatttctccttcagataaaatttctctttttcggttgaaagcacagagaaagaaagtggaaatttcagatgttggagaaaatattcggaatttatgtgacactggataatactaaatgctcattctggtaactgcaaccttctttcaatattcctctttcctagtaaaaccctaagcatcacacaagaatatattttttcttctgcttttctccctgattttggaacagtttcttaacattcccacaaaaacatggtttgaggtaacgacactatcgactgaagaaggaatgagtttgggaagcgttgagatgtgggaaagactaattgtgccttcatataaagactcttagaaaatgacctcaggctagtatttccaatcatcttcaaatcttccgttgaaagaaagtgactgctgagtaatcatttgcactcagagttttgcaaaatatttgagatttagttaaagaaaaggggaaagaagaatccagtgctactgacaactgtggtacccagaccaatgacagcaaatgagtctgtgggatcatcttcacagcctccgaatgacagagcatcaatgaaatgaagaaaatagtgctttttgcgcttctattatcttctaactgataacgtgcatacattgttagtatttttccacagaatggtttatgtcaaatacttaggctaacagcatctgtactgagaagactctactcaggtgcttagaaatttttctactgaagtgtttttccagtgacaaagttctttcatattcttcccacctggaaacataatggcatattcacagttttcaccctgaaagtgtattaggtatgacataatagatgcctcattccagctaagagttgctaaataaataaatccacctggcagtgacatttatactagtttcgggaaatttttctttggcagtagagaccttgataatgcaacttaatgtggccatgatggtgtcttgcattgtgaggttaataggaccaatcagtggggatgaattatggttcacctttacaccattttatccctgctttgctgatatagacctgaaacagcctatctaattcctttgggaattctctaatggagcctccctaactcaagttactataggatgggtagatcctccactggagctgaaagcctcctgttgggtcctcatttgtttagtttgttatctctcgatacttgcttaattctctggaatgtcttcatagatgtggctggcaggcaatgccatttaatcattttttttttcctggttagccttatagaaaatgtttctttttttctggatggtgaatacataaaaatttattaaatataatcatttaaagatagggtaatttaaaagaggcataagcttaagcatatctgcatgtagcctccatattttgttcaaagatgtgtgtacattcagtgtaacataaatttaatatttgttgactaagaagcaaaaatatattgttaacaggtattctatgacacagttggccagtcagcaactagttttcttcagatcttttcaaaggctgcttgttgtcgctttatccaaaggagttgatagatgtgtatgaagcattctggctgacccatggcaatttgtgtttggaagaatgagatttagagccagggttagtacaccatgtggattgccatgggcattatttaggtgtagataagcttatctgaaattgcatctggattacctgactaatccaaaaaaggaaagaaaagtagagacctgctatggaaatagtcatgaaacaaaggagcgctaggggagaggtgggtaactaaatgctagtttttaaataatgttatatcagacttaaaagatacatggaagataagacaggcctaagagtttgctagcagctggatcagattgcaaggaagaatctcagtctatcctttattactcaagccagagcacaagactagtttccacattttataaatatagagtcttttttggagactgtgaaatttggatagaatgttttatttctcattactgtttacagattcgttatgaccttggcctgtatacactttcatgacaggttaagtgaacagaggttaaaggaggcaaactgagagtatttaaataaagtttacttgctatatttgtcttatctccccatgaataataaaaatatcatttattatatgtattacaaaatgttctaagtgctttatacacctaatattagtatggttatttcacacaaattttatgatgtctgatttctttttctttttatagatttggaggtacaagtacagttttgtttcatgcatatattgcataatggtgaagtgtgggcttttagtataaccattcccagaacagcgtacattgtacccactgggtaatttctcatctctcaccccctcccacctgtttgcatctccagtgtctatttttccactctcgatgatcatgtgtacacattattttgctaccactcataagtgagagcatgtggtatttgactttatatttttgagctagttcacctcaataatgatctccagttccatctgtgttgccacaaaagacattatttctttctttcttatggccgagtaatatttcatgatctatatacatatataccacattttctttatcgcatcatccactgatggacacataggtggattccatatctttgccattgtgaatagtgctgcggtaaacatatgagtgcaggtatcttttatagaaacttttatcacctctatttaacagctaaggaatctgaggctcagagctagtaagtggtgggtgtgggattcaaacccagggagtccaatgccagagtcttaactacttcaccagaagcagagggaaggggagccattttattattcttgatttcaaataagcggtagtttacagttagtactgcgtacacattacatgctcaacacataatagtgctaaatagttttttttgttgcatccctattcaggatgggggtaggtgagccctcctctcccagtattcctcatccttagaaataggcactaaatagttccagatcacagtttaaaactattgctatgggaaatgaattgaacaaatcatgtgcttaccttcagcactaatattctaaatcaccttagattaatgccagtaaataccaagacagttaaaaagtgcattcgatgtaaataactacaatgacaagttcacaaatagcaacacaactaggaattccacgtaggagcagaatataaagtaaaatgaaatgatgatctagatagacagatgatagatagatagatagatagatagatagatagatagatagatagaggagagagagagagagagagagagagagagattagatggacaggtatgtagtttcacctataagcaaaggcaaaaatgagtatctcagaaaggcagatttagggaccactaagattttaagttgcatcattctgtaaattggagattatcacttactgtactgtcacaaatttcagataagttaacattcccgaatgttcttggcacagcataaatgctcaatatcttcaattatcatactttttccccttcatccctgccctgacacatgatagatcatttcttaaaatatactacagcatgtattaaataatatttctactgctcagttttctggggaaaatagtgtttagttaatttctaggttttgttaagaatttacaaaatatatttcataaatgtgttcttttcctttcagaaataaatgtataattttactcacaacatttcaacaactttcctaacttgcatacttcatttttctagtgtttcataaaagttctaaatttaatcatatgatattttaaaataagatattaagcaagaaaacacagcatctattgtatttttaaacgaatcttatggtttttattttattatttcaattactgttactaaattattaattctaggttagaattataaagcattatcaaagatacagtagattgcaattagagtttacttgatttggcaattattaaaaaatgaacatttttttctgtgtcaacaatgaagtcagttaaaatgttttgtggaactaatatgctgatagcaatgctgcagaattaaaagtcgcattattattacacaaacattttgctaaagtttggaaattattcctttattggggttctgttagttttggagaatatttatatacatatatatatgtgtatatatatgtatataaatatcctgcaaaatgtagacctttcctcttagatcagtactagcatgctaaatattttattttttaaatatatattaggtaactgaaacaaagaaaaaaggtttttatttgcttagagagataacaataatacttaacttgtaaaatattcctttgatacattcataaataagaagataaattttctaattcttatctgagaagcatagcaatttactttttagaagcttatacattatggcatcctttgattaatgcagtacattttttctcacaatttataatggacttccaataatcttgcctttaaactgtatttgacctcccttattttactttccaactagaatgaagagatgggctactagttgtagttcactgtagaggctttatgctatctgaaaattttagacccagtggctttaataacattgtaaactgattctgggtccattttctcttgattgacatgtctacttccacatataatggtaaatgccttgacttttctgctccttgtgagtagattggtttgcagatttacataaatacatttcccggagaccacatttaccacatttgctcatgacagcaatgatccttggtcatttcacatgctgtagttacatgccattcaggaggctattgttgattgcctgtcatttctcctgcctagatgtcattcaaagggttatttgttattttaatttataggaatttgtacattaagttcaattaacctaacagggccacacaatgagtcaggttcaaatgaaagctgcagatattacttgtgaaagttaccatggaagatgatgaggaaggagtttttatgactgacctgtggagttagacttatttgtttttccaatgatctctactccttatgtttccaatagtttaagtgattttgaaatgaagtttttcataatatctggaaatacccacccctccaaatttatacccataccagtttacaatactttagacatgacagtatataagtaggaataatccattgttatacaagccccaaaagagaaagaacaaaatttgagggcagattggaatagttaagatattttatgtagaactatgtcaatattaattttgtataccaaaatttgacaggcttttatttatttatttatttttgacatggtcttgctctgttgtacaggctggagtgcagtggtgtgatcttgcttcactgcagcctcaaattcttgggctcaagcgattctcccacctcagcctccccggtagctgggacttcaggcacacgccaccacacctgactaatttttgcattttttgtggagagcgtttcaccatgttgcccaggatggtcttgaactcctgggctcaagtgatccgcctgccttagccttccaaagtgcagagtgcagggactataggtgtgagcacctatacccggccccaaacttttttttttttttttttttttagcatatcagtgtattagttcgttctcccactgctaatttgtaaaggaaagaagtttaattgactcacacttccacagggctaggaaggaatcagggaacttataatcatggtggaaagggaaacaagcatgtccttcttcacgtggtggcaagaagaagaatgagagcagagcgaagggggaagccccttataaaaccatcagatctcatgagaacttactatcatgcgaatagcgtggaggaaatccctgattacctcccactgggtccctcccacaacatgtggagattatgggtactacaattcaatatgagattcgggtggggacatagccaaacaacatcaaccggaatcttgtattgcaagtttttattgaattttaaatcatgaagctaaacacttctttgataaacatctagaaggtgagaagtagctcaactctggagtaaggctaaactgggtctgaatatgttttatattctctggactttgaaatatgtctcttgataataaactagttaggtctctctgtgaaaagtcaaccctgcttactctaaaaatatatatatatttatttggcctgtaaaagtttaaggcccaccagggcagggagaggctggaaatcaatatttttcttatgaatttaaaattttagaaaacctatttcttttttaaaatacttaatatttaataaaaaatatatggatttttattttcaatcctgtcataataacctatgtaggtagaattgccttgaactttctctttcctctgttaaatataaatgtttttactcatttgtttgctgagttattttttataacagaatacattttctttttcctttctttaagaacgttttgacaaataaacatatatatttgtggtatacaacattgtgttttaatatgtttacattgtagaatggataaataaagctaattgtcatatgcattacctcacataatttttggggggtaatgagaacactttcttagcaattttcaaatacacattttattaactataattaccatgatatacaatcaatctcttgaacttattcccattgtctaactgaaattttgtatctgttgagtaacatctcccccaaaccttgtcccttccctccagtctctggtatgcagcattctactttctaattctgttagtttgacacttttatgactccatttatacatgagatcatgctgtatttgtctttctgtgccggacttatttcacctaacatgatgatctccagcttcatcgatgtatttgcagatgacataatttacttctttttaagtctgaagattattccactgtgtatatataccacattttctccatctgtttatttgttgatggacacttaggttaattctaaaagttgcctgttttaaatatgctgatgaacatgggggtgcagatatagcttcaacatactgatgtcagtttctttgactatatacccagaagtgtgattgctgtaccatatggtagttctatttttaattttttatgactccatattgtttactgtaaaggctgtagtaatttatattcctattaacagtgtacagggctccccaccgcccttgccacattcttgcaactcttgttttcctcttaattttattatttctacttcagtttccttaactaagaagagaaataaatttgcttgttgcttattttgggatgatcccacaattattatactaattctgttagtataataattataacacttatggtgtctttctgggaaaactgaactaggtggttaactgcagttctgggaaagtctagaagaaaaagtccagttttggtaagagaaccctcttgcctttttaccttccctgggctaggtatggttcctgaggcaaacctccctccctccctccatccctgcctcctaccatagcgaaccaacaatttcctcagtctgaactgttccatcatgctatgagtgactcttaactattcatggaaacttctagaagtaaaatcccgaatttgtgcaatgagttaactggagaaagctattctagtaaaaaaaaaaaatatgaaaaaaaggaggctgggagacagcaaaacttctttgaattaccattttcttccctggtaggtattgttctcgactttgtttctgctatagtaaaatatatccaggtggagtaactagacaggcatgaggacttgatggaaaagaaagcatggatagtcatcacattcaagttgttttagttatctcttataagcaaaataattgagaagtaaggctgtcacataactagacagtgaaagttagtgagagaaggaacaggctgtgatctttggaaaggagatttctatttttgcagaactgctgagaatagtgagtaaaagtctgcataagacatactgagtgaaagtttggggttgttttctttaggcccatgacataactagctttgaatgataagttaacaatgtgaacatcatgtgtgcatagaatcagctttttaactattagttgttgattgtgctctgggaaaccttagtgggacactgaaaaatgagttaatgttaaataaggagttgcagaggctgacagccttggaacctttgggcacaggcatctgaataactttgcaggaatgacctgataattcttggattaataaggaaattctccctttacagaagatgacgtgcagattattaaaaactgagaatcttttttggaacctgtggcaaacccaaactcacccaatctatgtcataattttagtgacttggtattgtttgattgtaatgactaacaagcaaaccagaaagtcttccagaacacatttaagaagttacgaaaagggctatagatgaagaacaaaacagcactatttaaatttcattgcacacctaggactacaaaaaatactactttgtagttttcttgagtctatataactttcctaatgttttctatacattctccctgccgctcagctaacagctagaaatcactttgtagaataaaagggctgaggattgtatttatttccaagacagtagggcctacagaggctaaaaatcagcatctcatttttcagtcgatatggccagagactaggcaagtaacggagctggtggcagagaaaaaaataaaaaataaaaaataagtagattagggagaaatggaaaagaacaaaggcagctagggcaggtcaatgaacttgacagagaggaggcttctatgttccctcattttttccccggcataatattttgtgatttgacatttatttgataccccatcaatctgttccttggaacacttgtactgtagttgattttgtagagtagcacatgcttatttttcacatatataaattgtgtgttcaaagagtatctttatggtttactttctgattaataggctctgaggatattttgcttatcctggtgaataatttacatctgcctcgtgtgttttgcattttcctttggcttcattttcattccatgaaattttgcaagatgcgttctctcctttaagtggatgtgaatttctactcagtgaaaagcaatctagacaaaacagtgtaatttattagctatttttcttacaaatctcctacaacaaaactttattttatcactgccaagtaacatctccagtctgttttatgcaaaagaaatttcatatcctgattggtcacagtgtaaagttggtatttaagaaatatatttctcatatttatagctataatgtaaaaagcataaaatgtaaaatttgaaaatgtgttttattttcaactaagggcatgaaataaatataacttttataagtattatatgtagagatgaattttcctcagaagttgaaggtcttccataagtatgttcatatataatgatcttttatacaatttacattgcgcaactgtaccacttatattcttaatagatgagtgtgcgttcatttcatgctgttaatatctgcaataaaccttcaaattaccaactattttattgatactgtgttttgtagagcaccatcaacgtgtgaattcttaacctgtgcttcagctgttttctatgtatttgagctaaagtactatctacactttgcatgtcaatttttaagtctatatttttctcaatacaaaagagatcagagacaatctctcctgcttggttcagggaccagaaacacagtaggttctatccagagtcatcaatagccattgttctttttattgttctaaaataaaatgtaaaaccataaggatagcttaatcatgctacagacgaacttatgttacaaaagaaattatttacagtaacactctaattatatctacctgccaaaaaggaagtaagcaaataattataacacaaagtgataagtctttaagtacagtatactgtgagatattggaattgtttttgcagaatttgaaaaagttccttagatataactaggtttctatttattagcctatataaacacaaaaataagagaaataaatgtaagtggtaaaataattagacttggtgactacatcaaaaagttttacttaaaactttggcagatttaataataaatttcagtgaagtttttatagatatgaatcttccggttgaatttttgactttgaataacttaatcaaatgcggctctggattgcataattatagtttacacttgcataattgcatttttatacttttgccttatttgaagtattaaagtaattatttattatttgttacactatacattgaaattaatgacctagtcacacactcacttatatatatttgtatgtcttatggaagttattcatacaaaatgttgagattttaatgaattctaattgatactcaaacttgtcatattcactctatatgcatttcataatttttggtaagggtgtggctatagaggttagccaattcacatcaatttttaattatatactttttcaaaaactataatcttctcagtgttactaattatgaaattcataaaataatatccatgaaatgacttgggtgataatccagtaattatcaatagtcacttgctatcatattcggatgacataattataacttagactaacaaagtttgggtcatttgatgaatgggtggcttccttttattttattacaattatgagacttgttaataatgtatagaatttgtataatattaggtttaaatttcttttctgctgcgattttgttcgtttgtaataaaactatgaaacacactatttgagataatgtgaattcgccatttttatttttgatcagtttctaattaatacatttacttttggggggaaaagttgatcaataatgagctgaaatattgcctttagccctaataaagtatattttggaaaacaaatgttaccttaaaatgacaataacaacaacagcaacacaaaccttcacataataagagcccaaatgagatagtttaaatctagcttaagctctacttaataaacaacaataatgtataacactattggacaaaacaaaatattaaaaacctctccaaacataggtctagaacagagactagcactgtcttcactgggatagtcatgaatttccagtttcggtgtactgagattcagtcagaacttggacttaaaaaacaaagacactttgggaggccgaggcgggcggatcacgaggtcaggagatcgagaccatcccggctaaaacggcgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaacaaagaacttggcctcttggttttagtgacttggaaataagaagatgaaaagatgaatattcactgaagaactctttctttctcactcttttctgcatcagtgttttacaagtagttgtggagtgagttatgctgaagcagatggggacgcagagaagccagtagcagatgggcacatccaggttaccctgcatggttgggccgcaaaccatggcctggggtggaatggagaaatctgtacacatccttttcacttgtgcgttttagcaggtgcagcatccgcagcaacatccttaatgctttctccccagttcaagcttagtttctcccttagactactgtaataacttcctaactgatttctccatctcatttttttcctcctccaatccaatttcaaattatcagtcagggtgatcattttgaagtgcaaatcaacttgccacaataagttatccattggtctgagaataaaaaccattctggagtaactacaaaggcctgcaggatctggaacctgaacgcctgtggagcctcatctttactgctcagccatcccttccttgcccctcccttctcctttgcatcactccagcccacttgccatgcttcttccctcctcgtccttctgctggagttggccttgggcttcaaagcctcccaaacttctctacttagctaatttttattcatccttcacatgtcaactcaaacttcatttcctttgagcagtcttcccctccgttccacattagttccggtcttctactgtagcgttcaggatgccctgtacattatcatatttgtaatgacatatttatcaatgattaggtgatatgtctttctaagtacagagttactggcctctgagcacagggcttggcacatgatcaaattttagccagcagagacttccctcaagatatttggaattggaagtaaaaaggaaatatatttcccatctggtgcacgaagctgacaaggataaatgcaaagttggagataagagaagtggagatgctctaatgagccttgttgttgtccctgaagctacctgcagccctgtcctgatggtaatttgggttgtaagtcaataagcatcctactttcatttttaagtttgttgacttgggtctctctcactggcaaggataacaaccctgactgaaagaatccttacattatgaaactgtaagttccataagggctagaatcttgcctgctttgctcagcaacgttgatacctaacaaaagtttgttaaatgaatgcatgttatgcaataataaattcattttaagttttctggtagatatagcctgtcatcacactttcatttgatgtgatctgaaaataaatttttctgagatatataagggccattgaatttaaagataactaatattacacgtaggtattatttctctctgaatttctagaattatacgtacagagagaacatgattaagaaaacaaatacgtaacaggtaagacaaattaaactggctagtgaattttttgatactcggaaaaatcagatttttagtttgtgtttgaagcaaatattcagaattatcaggacaggtttctacaaggattttaatctgattccttcaccaaaatcattttaacatttagctataagatatacaaatcatatttacacctactgtgttaaaaaaaagtttaacctttttaggacagaatggggccagtacaatcagacttatgtaagaaatcctcaaataaccttcttttgtcacgatgacaactgggagcaaataatatttaaagcatgagtgagtagttggaggagtatttgacagtttctgtgaggaaccattgactgaaaacagtgatcaacccactagatattttaaagtaaatttaaatgagcaaatcacaattcctgtcactgagaatgacagcactaattgtcaaagtgaggaccagaggttcagagctaagtggatgtttagttatatgctaatagaaaaatgcttcctaattaagatatgcttgaaagttctctctctgtctttcatctctatagcctatatttaaatctcctgactcttcataaatatgcagtggtgaccttaggacagggcactgtttagcaaatatcttttaaaatcagaatccacaaattctattttttaacaaaatgttgtattgcatcgtcctccttaggttttaaaaacatacatgcacatttaatgataaaccaatgattttaaaaggcatgtgaactgcttctcttcagacatggttgaggatttttgaacatgatgcaatatatttctttctaggacagttacagaactggacttttctttcttcctggtgtggtttattaaaacaataaatcaaagcacgtagaataaggagctgagatcttgagaggctgacatgcagaaaagctgagatattggcaaggcttaatcgttgaagcacccagtcaaagactcagtcagaagaggaggtggaggagaacagccaggaggacaaaggggtttcaggcttgggctgaacctggcatcacacagaggggactacacctcctcctctggggactaccttgagtcaacctcgcagaaccttttgtatcagagtaaggtatctgaaaaaccagagcagctgctctaatggttcagggctatcatccttagatctgaagggtcatggctacacatgcatagaatatggaaagcagccaggtgaaggcatcttccacaggctctcatcattctagtgtgtgtttttcaatgcatcatttatgtcagaagtgtttgaaaaaagctgttacaaagttagtccttattttcatagatcactttctaagtaaacatggtctaaattataggatgagagttttgatcaatagcatgcctgtattgggtgctaaaatagtgccttgggtacttgacggcagaggacatcagtaatgtgaagaaggctatagaaagaagcaacagtagacacagaataaaactgtgcttttctaattttgtctaaggttttcgttacaaagagtcaggacaacatgaataactttattatttccaggaataccaaaataattggtatttatacttaatttctagttgttttgtgtcttgtggaaaaagcatgatcagttaaatatggtgaagtaattaaaaatatggagataagtatagtgagaatcatcattacataatttggtaggtggtgtcatgctgttactactgtggttccatattgagcaaacattcaagtctcatgaaatgtacgattttaccaactcaaaatataaatatcttaagactggacacattaaattcactgttatagtgtattactgtttataatgtgagttacaatcttgtgcaatcattttggtgtgccacggctacgcaagctttgattgaggagagaactgtagagaaaaccaacatagacaacctcttccaggaaacttctgggatagtcatcaacgcagaaacttcatttgcctcctaatcatctactgccatttccccagaagctcagaaatgtgtgacttcacatggtcaatgaacattgaatatacagttgactcttgaacaacctggctatgaactgcacggttcactgtaatgtggatcttcttctacgtctgccaccactgagacagcaagaccaagccctcctctttccactcctgcccagtctacttaatgtgaagatgacaaggatgaagacctttatgatgatccactttcacttaatgaatataaaatatttttttcttattttcttaataatattttctttgttttagcttatgttattgtaataatgcagtacctcatacttataaaataaaaaaatgttaacagactattatcaacaaggcttctgaccaacagtaggctattagtagttaagttttgggagagtcaaaagttacattcagattttcaactgtatggggagtcagaaccacaatccccattttgttcaaaggtcaaccgtatctggaaaaaagtcacacaaatcttctaaaatagatgaataaaaagttgaaccatattaattgcttcaagcaaaattaaccattaaaaataagcaattcattgcactttatagagactattaacagaatactttaataaaaataggactttttttccttgagttaaggatgatttagtaaaataaactggttgcaaaaaatgtacacaacaagcagcacttatacattctttagcacagaagggactgcctcagagacctctttaaattcttaaggcaaatttaaaatcttggcaatttcctcgaaggtgaacaactaatagtcctttgtagggacatggatgaagctggaaaccatcattctcagcaaactgtcgccaaggacaaaaaaccaaacactgcatgttctcactcataggtggcaattgaacaatgagaacacttggatacaggaaggggaacatcacacaccagggcctgtcatggggtggggggaggggggagggatagcattaggagatatacctaatgtaaatgacgagttaatgggtgcagcacaccaacatggcacatgaatacatatgtaacaaacctgcacgttgtgcacatgtaccctagaacttcaagtataataaaaaataaatattaggtaaaaactacttaataagcatggaagcatctatgtagatatttgaaataatacacagatattaaaaaaaaaagaatcaagaaaagagagggtccttgcactcatgtgggcctggaatcaaatccacaccgaattcacatgccttcattggtcactttagcttcagaacccagccttctcatctggagaatagacacaatgatgactatatatataataatctcatctaatccttgcaacgatcctacaacttagaatatggtaggtgtttaatttatttttgtattttactctatattttcttacccatgataaataaattatgttgtgcatcacaactctacttggggaatgtaaataaattccatgaagtcattcaagacgtcattttaattttgagtcagtgtttcttctccagaaaaatcaatacagtattaaatatctaaaggtataagtcattttgcgaggctaataagatgacaccttttataatttatgatttaaaaaccattgcttaaaacaaatcacttgaaatcacctaaaaactagccaatcgcttaaaaagaaaacaaattttaaatagagttttagtagcaattaagtaattttttagttttaaagatacattagaaatgtttattagttggaaatgtttatccatatagcacaggatgaataagtgattacataattcaagaagtaaagcagaaaacattcaaccaattagaatttttgaacatcttgtcctttaaatatcagatatgtcaatatgataaataaatgatatctaaaacatctatcacaaaaactgggtcatgatgagaatatttatatgttaaatttgttagcttttctaattttctcaccttcccaagggtaaaatcatgcttatattcaagattaatcactgcatcctcctccccaaaggctttctacccttccactaagattttttattcctaatacaaagccaaaaacctttacaaaaaccactcttcgaaaaccacctgggtcagggtgatagagaagaaatagtaatgcaccagaaattacagttccaaattctttacatccttgacatttaccacttcaaggtctcagtagtatgaaagcagggcagtggggtggatgcaatgactttcaaggtccttctgacttggtctttctgtgtgtcgcctgtgctctgtaatgattacttagaacaccccttaagtgagaaagttggggctggacagaacctaacaatcaaggacctggtatatttgcagtaaagtatctattccaactcctctcactgttctctcttgtctctactctggactttcccgtatttattttgatgctaatattcggagtgatgttgatgtctcatcacgaatgccattccctagagcaagcttgggcaaatgactgcctgtgagctaaattctttcaaccttttatttttgtaaataaagttttattggaacccagccatacccaattgtgtacccttgtctctggctgctttcatgctacatgggaaaaactgagtagttatgacagaacctctatggccacaaagtttaaaatatttactatcttgctatttacagaaaatatttgctgacttctgccctacagaaacataagcaaacagcagtaatcactaatatcaattaaatggatattattggaactcttaaggggcactttatctatagatatcatttttttgacttttattttaaattcagggggagacgtgcaggcttgttatataggtaaacttgtgtcatgggagtttgttgtacagactatttcatcacctaggtattaagcctggtaacagttatttttcctgatcctgtctttccttctaccctctaccctctgatagacttgagtgtgtgttggacccttctatgtgcccatgtattctcataagatactaatttttatctttgtgaaattttgtttccttgaccaacatctccccaatccctccactccccagctccaaaaaaccaccattctagcctctgcttctctgagttcaactttttccgattccatagataagtgagatagtgtggtgtttgtctttctgtgcctggcttacttcacacaacataatgtccttcaggtttatccacgtgtttgcaaatgacaggatttccttcttttaaggctgaagactattccatggtataaataccaaattctctttctccattcatctgctgaaagacacttagggtgattctatatctaggctattgtgaaaaatgcaatgaacctggaaataagttcaagacatttattatacatcacagtgactatagttaataacaatatactatatacttgaaaactgtgaatagagtagatttttttttttttttttgagatggagtcttgctccgttgcccaggctgcagtgcagaggcacgatcttggctcactacaacttctgcctcccgggttcaagcgattctcctgcttcagcctcctgagtagctgggattacaggcatgcagccaccactcctgactaatttttgtgtttttagtagagacggggtttcaccatgttggtcaggttggtctcgaactcctgaccttgtgatctgccagcctcggcctcccaaagagctgggattacaggtgagagcccctgtgcccggctaatagagtagattttaaatgttctcaccacaagaaaatatggtaagaaggtgaggtaatgttaattaacatttgttaattaacttgatgtagccattccacagtctacacatatatcaaaacatcatattgtacgccataaatatgtataattttatcaggcatttaaaaattattaatttttattaaaacggttataatagttccaaccgtgttgtgtgtagattcacaaccattagaagttacaaattgccacatataaagggtggtataatataaagtcagttttaaagagattggcatggcattttgtactgtatttgaaacatgatcaacattgttatttttattttattttattttatttatttacttatttatttatttatttattttatttgagatagagtctctctctgttgcccaggatggagtgcaatggcatgatctcagctcactacaacatccgcctccctggttcaagtgattctcctgcctcaacctcccgagtagctgggattagaggcatgcattaccacaccctgctactctattttgagtagggatgaggtttcaccatgttgatcaggctggtcttgatctcttgacctccagtgatccactcaccttggcctcccaaagtgctgggattacaggagtgagccaccgcgcccggccaacattgttattttgaaatgtttgtatgagaatagaacaaagcagccaccttccccctggagccctgcaggtcggctcctgttaaccaggagccagggacgtggccaaacaagtaacaaagtcactacacgcttcacagccgcaatgctcttatctgtaaatcagacaaaatgcttgtgtataaatgtctgcaaagatgtttccaataaaagaaagatttggtttgtggatgtgctttgttattcttcttattaatttggggctagagacaagagaagagtctcagggaaagaaattccttgtttgaattaatttagtcaaatcaggtcagagaatccagaacaagacttagctgatgtttcttcagggcacatatgtgactgcctttccactgtgaataatatctactcaggccatgtattcattctaccacttgtgagatttatgtagcattcttgcctccatagtgctaaagatgcctggtagggaagtttaaagttactgcagcaatttcttttcggtgcatattaaagttgtggtgccttatctatgaggcggagctgtaagtcgctgtgatatcttgcttcgaattaattcactagttacattcaacggacatagaagtagagtttggcagtttagaaagctggcaaattttctgtggctcctcaaacattactgtaaaatttgaaagctttaatatgaagggtttcagtttagtcacagagtaaacctaaaatcctgggatgactgcttcccttttatctgtgcctcatgaaaatggatacatttttttatacctcatcagatagacttttaaattccaatcgtatgaaaatgaagacccccctcagttagagtagaccacaaaatgtggctgattgtcggtgaatcaggctattacagttacacaaactgcgttgcagagcaaaaaacaaaacaattgttactgtaagtaatgaaaaagcagcaaaatgcagccacataatggtaaagacatgagacttctctagtattttaaatgaaaaagcacttgactagctgagcttggtgcttaacacatgagaaagatgcaggaaagaaaatgatcaaaaggcatggtccagcctcatgagagaagagggtctgcatgtcgtgagggccactttctcaatcctgtttggatcttatttcacggcttcaggttggaccttccacttgcaacttgctgtggaggtgctcttctgcaagtcccaagatcccaaaaaggaaatacaggagtttcggtgtttttgagcaaaacaaagtaaaaagctgagtaaggaaacactatacatagctggaaataggttattttctatttgcagacaaagaacaatataaacaaagctcgagatcatctgggcaggttgaaaatagcttcagtctcaaaacagttacacatctgatctgatttcatcacattttaatttttcttcctctgcctcatcttcctcgttctccttttcttccttttacttgttcttcttcttccttatctctctcttcctgtttctctctttctcctgctcctccttctcatacttttctgcatttgtactgcatgtgagatttcaactactcaaatgaattacactcataattttcccgagtggggcagagagaagggggactttcaaaataagcctttaaaaggaaagcactttttacctatatttttcttttcttttttttcttttttaaaagttgagcttataagatcatgcctggtgaagctgtgttcatccactcctctcagcattagtggaagaattagagtattaacgaccttatagaccaggtattttgtagcctcctttacagtttgtcaagttgttaaaaattgatacaagaaaacttaattatttcttcagagaaaagctggacatgtgaactatgttaaccataaaacttgcctgtcttatgtttctataaacagccaggtttgaagcacaagggcaaacctatgcatctatgtgtatatacacacgtttctattttatatgcatatatttacatgcatgtatagtttttgtaaatttattcgtgattcttagtggttatcaactaaatatgaagcagtgttctagctgcttaaagagttggaagaaaagggtggtgtcaactctgcgattttgctgatcaaatcgagattacagatacatgttttgcttagcccacataggattgttttaaattacattttgctgtgtttctgcttttagaagttgagaagtgccccatgagtatccagagcttgtagcttctcttgagaaatctgaaggtcttgcaagactagacctgctgccttccccagcagcagccgtcatctggaaggtgatagttgctaataccctgagtcaggggagactatttctccatagtcctggcagctgcctactgtgttatccctgagcttcactcatttgttttctggcctgatcctattgttatttcgagttcctactcctatagatctataaggggtgactgaaggggtttggaaaaagactaggttgggggtcagttgtggggtattgtggcaaaaatgctgggtttggaagtaggtggtctctctgatgagcttgcttatgcctggtatgcacccatgatgttttccacaacaaaaactagaaaacacttgccaagtatctgggagtggaataacaggcttgagagaaaggtccccttttggcatagaggcgtgcatttaaaagcctttattctgctgctaaatactatttgaaagagaataaaataagtacagtctcttttggggggaatagggtggaaaaaaaggagtgttatttgcaaatatttcaaagtattctataatgactaatacttgtaaaaagtaacttaggaagccttggcagcgaagggcagaatgccatcggttaatattccaagttttgtgtgcctagtgaagcaagttagcttgtaacagtgcttcaactggaaaaatcacaattgacagcttcaattcataaggagcaaagcaccacagtccatgaagaaagtaactgccatggtgagcactctgcatcagggagaaacacacacacacataccacaccacacacacatacacacacacatacacacaatgatcaccttcctggaggaagaagagtagtgaattttaaaatgaatactttttatttgtgtttttctgttattgccaactttaaaatgtactcgttttgattaagctaggttgtgttacaatattaggaattaatttcaaacacattgtgtttttacttcaaaataatttacttcaaaaaaatctttatgtgtatttacaaaaatagtacagctagtaaaatgacactgtattggcttttattgccaaaagaaaaattaagtgtaatgcttaatgaactctttgaaaattttaactgttagcataatgcaactcattctgatttccattagatgtatctattatatttgacccacatagtttaagaaacctgtaattaagacactccacttttgaatcataggaaaatctctacatcttatcttccttataagtttaaaaaaatttaaaaaaaatttgcaaccaatcaaagtcatgctattccttattttaatgccagttttcctggtattttcgataaatttaaaaaattacaagtgatatttatatatgtaaaatgagggaaaattctacaactataaaatcaaattgttttcatttcttaggaagtcaatataaatggtctttcagttgataacaatgtctgttcattcacatcaataaataatttcataattccaaggctctctttatccaattgtattttaaagagtacacattttgtgatagtttataaattaaaggatatatattcaaagtcacataaaaaatatttgagttaattacaaagtaatcatggaagaatattccttacatttctatttattattgcatgaaaatggataatttcataactttttatatataagattccaactggcctttatttcattacatataaaatgaaaaaagatgagttgatctgacagcacagcccaagttttcaaaatttgttaatgttattgtattgtcaacactaaatgttaaatatatatacacacatatatatacatatatacctatatatatacctatatatataatataaaatgctaagaatataaatgttaaggacgtacatccacattttgacctgctccatttccgacctgggtcagtttgcctctcgtttgcaaccacattacacacagctcctgagaggtcaccacattgatgccaaatagtgcagacatgtgatcagcatggcacattataaccaggagctcccaggcccaagcaatccttctctcagcctcctgagtagctgcaactagaggggcttgccaccacacctggcacatgcacattttatttctaatttaattttttaaaaatatgcagcttattatctaaagaaagacctttctaacccttccatttaaagccataaaatcatacagaggcaaaaggacttcttggagctctgtggttttcctctggtggctaattgtggttaactctgcttatcagagttcttttatctggaaatgactatctttctagtgcatttcaagtatcatctactttaagttctgatcacatttcatttaccacttatatttggtgtgaatgcaaagatgaatcaattacccaatttcgccatctttttaaaatgcatagcatctatgcactaaaaatacaatacaataatgtgcaactcaaaaaattccccaagcaagaagactgatgatttcttaaatattatgtgaccttctatcgcctgattttagaaattctaagtgaggacaacttggattgtatcctaaaatattatgctgtggactcactctccatgtatacaataggtttgacatttgatagaaattaggggacagcagaagagaaagaattcttaactatgtctgtacatagttaactaccctaaggcactttaattcttgtccatcctttattctagtaaaactgtcactgaaccaaaagatatatctgtataaagagctctgtactgtcaaaagtaaagctacttggcaaagcttatgagactttatgtcagttttctacttgaattatagttatttcactaactagttatctttttcacatctattgtgactagagaatgagatgtagcagcaatctttgttgcatgccatttgtaaactaaatttatgtcatagatttgcatgctaagtacctctctggtaagaagagctctcaaaggcagcatgtttatgccactatttgtgattaaattggaattctaaagcagacccaagttaaacatgaagacaactttagatcttggtctgaagtcaaatatagactgtttacttaccattggagttatcttcttcttcttctttttttgtggctattagcaagataatctgtgatagtttttaatcatctctcttttactaacttcatagttttaaaattttctgtgtttttggtgttggcataaaaggtatgtgttcaaaattcatgattggctaaaataataagatctggagtttgaaagtagtttcaacaggtgatttagtatataaaattatatatacttacatatactatgtagttattaattaggtaccaggctattgtcatcacataaatcataaacatcttcaccagaaagttttcacttattcattcatttaacatatatatgttgagtgtgtatgaggcaccaaatgccacactaggctgtcaggtgccatggtttaccagatacactgttcttgaagtgcttaccttccagttgggggatataaaaaaggcacaaacaagagaatgagttagagaaacagaccatgtgaaatcacacaaacacatggacagctggattgaccatttggtcccatttttcactgtcatttaacttcttagtcttcctcatctgtgaaagagaagaagaagatgtgacttacctgttttaaatggtgatgaaactcatcacagttttcagctaggggccaaagccctgagttctgtgtgcgtgaatggtctcagcctggagttctctctagttgctctgacttgcataactctgtttcactcggccacaaattaagtgtcagggcacatcccagcacctacttgacctcccttaaataaccccagtgaggatctctaagataatttttaaattatgaaattaaatgattaatatttttaaatagaaaaggtagaaaaatgaataaaagatgaaatctctctgtacttcttttgcaaagtttccccagagggaattactatcaactgttggctttacctttttctatatattttctaaatagtttttaaaagagaaaatacaaagttctgcaactttttggctggttaattttcttaaattggtacataatgcgtatttattttctcattattaactactcaaatactctaaaatatatacagggaaatccttctttggtacattctttctctcacctgtaaccccaggaaaccaatgttatataaaatactatcatatcctctgcaaaatattgttatgatttgaattgtgtcctcctgaaagaagttgaagtacaaagtctttacaaatgatcaatttgagatgaggtcattagggttaatcctaatgacacagaggctgacatgcacagaaggaagacgaagtgaagacagggacaagatggccatctacaagccaagcaaggcctataactaccagacattagaagagaggcatagaaatattctccttcactgtagtcaaaggaaccagccttgttgacgccttaattttgcacttctagccttttgtatttgtccattttcacactgctgataaagtcatacctgagattggggtatgcctttatttttctataaagaaaatgatttttttataaagaaaaagaggttcggtggactcagggttccacatggctaggaaggcctcacaatcatggtagaaggtgaaagtcacatcttacatgccagcaaacaagagctaatgaaagctaaacaaaaggagaaacctcttataaatccatcagatcttctaagacttattaactaccatgagaacagtatgggggaaactgccctcatcattcaattatctcccaccaggtccctcccacaacacttgggaattatgggagctacaatttcaagatgagatttgggtggggacacagccaaaccatatcacctttggaatgtaggacaataaatttttcttgtgtaagccacccagtttgtggtacttctttatggaagcctgagggaactaacaaagatttcatacctatgtggattggccattttaattccaattattatcagagaacaataaaagtgaccagaaatatcttctttttatattctttaattaaaaaaattcaatagtaaatgggcaagagttgaatagacatttttcaaaagaagacctacaaatggcaaagatatgaaaaggtgcttaacaacattcttcatcagaaaaatgcaaatcaaaattaaaaacaggtatcatctcacccctgttaatacggcttctatccaaaagacacaaatattgcagtgtttacattcctgccaccaggttgcccacagttattttgaacactgaacttctttgaaagatgactgaagtctacatattttatgcccctaactactatggtatctctggaaatctgaatgtaaacattgtcatggtattgtcaaaacattagatggatttaagaaaataatatagagaactttttataccctgtatacagataaggcctgcaaaagtctttccatataaaaaaaggaaatactttattgacagaactgttttccctttgggccaccctctaggaagagaagaaacggagctctgttgaataactttttcagagattcctgtagcccagaggcatctgagaaatatttgtagacatggagaaaaggaaaatgaagcagttgtcagtactttactccatgtgctgattttaacttacacaggtaactttgaattggttaaaaaacccaggcaatttgactagagctcatctattggaatctcaccttcaagcttgagagtcttgaataaacttattctttgacttaaaatgacctgatttctttttgcaagggtttctgttaatgaacaaagtctctgtctcccccgtcactgcctgatctaaaatatcttattccttgagtcttgcccatatttaccagatcattggagacaggtgcaatagtgaattcgcatttttaacatttttcaatctaagttttaagattctattattgagatgaaaatatttctaataagttttctggcaatattaatgtgtgggcaataaactaggtatggcagtacacctgcaagaagacagttagatatggtctttgttgtccactgtctcaccccaaactaaagtcttctctacaacagtccttgtaggtgggtgtctatttttccattaaatgtttgtattgatagagagatgctaaagctgtctgattcattttactgaggcttgaaaagtatgtaatgtattcatgatattacaataattccattgagttatataagacacatcattaatgtaggaattgtaacattttcattgtttcattattgatcaagtgatgttagtagcaatttgtaggcactcagatctatctttggggattaatgaatgaagaaagaaacaaaagttatgcaagctttcacattggactgttcagaatgccctgatagtcacattttagctgtttatgataacatatccactttactatgcaaagattttcggcatttatatgagggatttattaggaaaaatgaactttgaagtgaaaggacaatcacaggtatagagtgaaaaaaggtatgatgtcaagaagagtacaactgagctaaaaatttgtgagtttatagaaatactgtaagatttgtcatctgttacatctcctcttaaaatgatgaaaccatataatggaatttattttgaaattgaccatatttctctcttaacaagtatgtataccatggtattgacatagaattagattgaactattactatagcatcaagttggctatcaattgttttatttaaatgcatacagaaataatgaagcataatgctagttgtgaaaaacataaacaaatgtccctggctcttgcttaactaacttctaatctattactagttataatgattagttagaataatattaatgtgtatatacacagaaggttttatggaaaatgtgattgatttcaaattaaaattgagttttacaacaggtagaaaatgcaggtgcaaatgtaattcagaaaataatcttttaaatgtttaaatagtcattgaactattagacatctacatattttttcatttaaagttaatgatctaaatatttataattatcaattaataagcagttttcagaatattgccaatatctagatgtattaaaagtcaaatccacatttattacaatatagatgaaagtgaatatgctagaaccatagaagatatcatagacatatataagataacatatactgagtcttctttctactccagggacttaggctctttcacagaagtaactaaatcattaattacctttgtatcttacaaatttcccaattatatactcatatacatgaatttatatataaacaaatatagacagattttttttacacattggacttttctatatattatagatgcttgtttcactgaagagtacaactttaagatctttttatattagcacacagaagtctactgcattctattcaacaaaagtgataccagtgcatcatttccatatgggtaatttttttttagtattttcacatcaactgtattatttattattttttaaaattaattcttatctcaatagcttttgggatacaaatgtttttttttacatgcatgaattatatggttgtgaattctgagattttagtgcacctgtcacctgagtagtgtacattgtacctatggaggttactttatatgatgtttattacagaaaacattgcaataaatattcttatacatgtatcttcttattcttatgtaagaatacatatataagaatatatacataagaatatatatacatatatgtatgtgtatatatatgtatatatatatatgttagccatttaagtcataattctgtgtgtggtctttattttctaccttcaaataagttacttatgctattttgtcatttccatagctgaaaaaaattccatgtgttatctggaagaccactttttttttcccacttgacatttttcatctctatttgaaaaactctctatcaaatgctcaaagcatgacaatttgtaagagtaaattgccttatagcacacaacacaaaatatccactaataccaatgctgttttatttttatatttttaaattaactaatttattgattttggtagagacaaggtctttctacattgcccaggctggttttgaactcctggggctcaagcaatctgcctgccttggaatcctaaagtgctggaattgctgacctgaaccatcacaaggctcacaaatgcttaatttttaaagtagtgatagtctgcccattcaaaagagaagctagtttacttatactttagcaaaaaattaattaaaatatgccttattggagatatatgtagtgcatcataagataaaagggatgaaatataaatcaaagtcaagattaagacattttctgtcttcagctctctgtattttctgtgaagaaaatactgttacagcactactaaaattattttctggcctcttgcaaaatgtacctaatgctagttatttaattattgtagttagccaccttttcatatggattctctattctcattttattttacattcctttctttccagtctttttacctcttgtgcaacttttcttattatggttccaattttcatttctttatttgttctctcttgggaaggaagaatagtcatatgtaaaataacatattgaactttctgtcttttaagtatttagtgtgtattataattacagtagcgatcaattctatgagtagatttttttgtttccttagctgttttgttcatatttatttttctgaaaatgaatattacagttcttcccctcaagaattttatgattgatggatataacattatcattaattggagaaaaaagtgcagataaaagccatggaagaaaatgtcagaagttttagaagtgtgtatgcaaggaaaaaagggttagagagatgaatgattgattcctactcttccatcttgagtacctcatggataaagacaggatatttgtgctccaatttttagcagccacctgcttttctgctccccaaaggggaaaactagtgacagtaacatatgagaggaatgtccagaagccttgtccaaatgctctgcgtcatgcagattggcctctttgtgtctccaagtgagtcttctaggcatggtattcctttacacttagcatttattttgctcagcagcacttaaattcataaaaacagttatagcaaacatttctagaatatatcagaaggtagatcttttcttttttaattttcaggaaaaattatacaatataagaagataggctttagtcagataaatcttaaattcagataataaggctatgaaatgtatcacgttactcaatttctgtgatgtctctgagctttttgtcataggcgtgctggagagatgaagtgaccctcctcagttaattcttttgagtattaaatgagataatatgtctgaatcactcaaaatatttagtaactgttagtttttttcataatatcctcaaggagaacttgggggaaatttcataatgctcccaatttatggtggtaaaatgaagacattcaatgtgaaaattaatctaaaatgatggaacagctgtactcagtgggattcatctgcctcgaattctcaataaagttgaattgaactatgcttttgagatcttcaaactccccctggcccattttctgtaattcactaaaactcacaggattcggcacatagccaaactaacggctatgattgattacagcaaaaggatacaaagcaagatcagcaaagggaaaagccacatccagagaaaactcagtgcaaccttccaagaagcttcttctactggagtcagacgggacacacttaattcctccagcaatgagttgtgacaacgtgtacgaaatgtctactaggaaatcttgcccaagattagaagtttaggatttttatcatggttcagcaaacgccttctgtcaaatatatgccacatttctagtctttcagtaggaaagccaggtattcagtataaattatttagtttttacaaacagtttaagcacaatggactcctattatcatttagagaaagttttatatccgtgtagggaactatttacccttcaagttactgaatgccagtcaagcgctaactttgcaagccgtccattctaagaataacagtctcaagcttactatgttaatttgtttttgcatagatttcatctaaaaacagcagaaaagagattaagggaagggctcagagagagtagagccaacatgaacagcaaatctgttatttaagtactagttctaccctatgtagtcattaaaacactgtcaataaacaagtgttgcaaacctctctgacatattgaaaaaaaaatttacaaatgaagccttataattatcagtggtccacaatctaatacgttttcaatttacttacattttattattaatcactaggtataaaaacaaatccagcaggggaaatgtgatagatccaccatgacatccgtaaacacaacactagatttaaaaacaaactaacaaacaagaaacagaacaaataataattaaaaagctcttttctccaaaatgatgtttttaatttacctttgtattcatttgggttttgattattagaatatcctcacccttttctaaccctttcctgatacttgattttttggatagtttactattatgtcatttgtgttttttgatgagtataaaacccattttgttaggagaagaaaagtccccattacctgaactgttgccataaagctcctaggaaagtagaaaatgcccaaagttattttcctttttcttctcttaaaaacccctttccaataaaaacaaagaattggcaagcagccattttgagagcaatcagtattggtaaagctgataaaaagagaaacatctttgaggctgtggtcccttctctaccatccatgtattttagtacatcaataattattttttgcagagtgagaaattcaggaaactgggcactttgctttcctaagctaaggagatagggcgcagaatgtattttcttatatctgaagacccttgtggatgatgaaggaattgaaatgccacagtaacaaaaactacaagtataattattgattaacattcttgagggataagatgtgccagactgtgttctaagcgctttacctatgtaacctcatgtcattctctaagtgaaccctatgtggtaggtttttattattatgattattgtcttccaccttttgaggagaagaaactacaaacaaacaataaaaaactaaataaattttaattaaaattaaaagttaaaaaaacaaaaaaaggctgggcctggtggctcatgcctataatcccagcactttgggaggccgaggtgtgtggatcacctgaggtcaggaatttgagaccagcctgcccaacatggtaaaaccccatctctactaaaaatacaaaaattagctggccgtggcggcgcaagcctgtaatatgagctacgcgggaggctgaggaaggagaatcttttgaactcgggaggcggaggctgcagcgagccaagatcgcgccactgcactccagcctgggctacagagtgagacttcgcctcaaaaaaaaaaaaaaaaaaaaaaaaattaaaacttaaggaactgagacaaggtgtcattatacaagtacccactgcaggagcagagcagacattcaagcactagcaccatggtaccagagctcatgtgttgctgttttaggctcacgtttgcctcagtgtctttctggggtgtttctgtgtgcacgtatgaaaacaaaatgtatatatatatatatatatatatacacacacacacatatacacacacatttatacacacatatacataaatgtgtgtgtatatatataaacacacacacatatacacatatatatctacttgtacacgtgtgtatattataaaacattttaaaaaatttaaaaatatttaagagcattaatcagttaaatcagttttaagccaaaagtattacagtgactcatttcaataacacctttaaaaaaaaaaaaaaagcaaaacacagtgaaacttacaaaaagaaagagtaaaatgctagttgccagaggctggggaggtggagatattggagacgtgttgttcaaacgacacaaaatatcagttagacaagaggaataagttcaagagatcttttatacatcacggggactacagttaatatattgtgtacttgaaaattgataaaagagtagattgtaagtgttcttactgcacacacacacacaaaacaaacaataataagtatgtgaggtactatatatgttaaaaagtttgagttagccgttccacaatgtatacaaatatcaaaacgtcatgctgtacaccataaatatatacaattttacttgtcaatgaaaaaaactgcttattttccactattcatctaaagtaaaaagaaaacaaaaactattatagttaagtgcttccacatattaaatatctgaaaagataacgttatttttcagaaaaaaagcaaacctcccctccgtgatcattaaaaagattatttatatatgcatctttaaatagatcgcttttaagtttcacctccaaggtcatatttacttaatgacttggaaataagtgataagatagtctttactggaaatgatttaattctctgccatctagctaagggacaaatatttttgggaaagagccagatagcagatattttaagtttcaggggtcaatctctgtcgcaactcaataccgccattgtagacatacataatatgtaaatgaataactgtggctgtgtttcaataaagctttattatgaatgctaaaatttgaatttcacttaattctttcatgtgacaaaactttattcttcttttgatttttctttttaccattaagaaacataaaaagcattctgagcttaaggacactagaaatctagccattgaacaggattttgcccaagagccatactgtgttgatcctggatctggataacaagaaactgctaggattatctgtgattgctttgccttgctaaagtctttcttttgcctatagttacatacgttattttgtctatagctatatatgctcattattttatcatctaatgtatcttttttaaaaaactgttttcaacttttaagttcagggggacatgtacaggttattcagttttgttacataggtaaacatatgctatggtggtttcctgcacagatcattccatcaccaagtattaagcccagcatccatcagctattcttcctgatgctctccatccccctgtacctccaacaggcactagtgtgtgttgttccctgccatgtgtccatatgttgtcatcattcagctcccacgtatgcgtgagaacatgtggtatttggttttctgttgctgcatgagtttgctaaggataatggcccccagctccatccgtgtccctgcaaaggacatagtctcgttccttgttataactttatagtattccatggcatatatacaccacattttctttatctattctatctttgatgggcatttaggttgatttcatgtctttgttactattgtgaatagtgctgcaatgaacatacacatgtatgtgtctttataatagaatgatttatattcctttgcatatataccccatattgggactgctgggtcaaatggtatttctgcctctaggtatttgaagaaacaccacgttgtcttccacaacggttgaactaatttacattcccatcaacagtgtaaaagcattcctttttttatccaaaaccttgccagaatctgttgttttttgactttttaatagtaaccattctgactgctgtgagatggtgtctcattgtggttttgatttacgtttttttaatgatcagtgatgctaagctttttttcatatgtttgttggcatatgtatgtcttctctggagaagtatctgtttatgttcattgcccactttttaatggggttgtttgtttttttttcttttaattttttttaagttccttgtagcctctgtatattagacctttgtcagatggatagattgcaaaaatcttctcccattttgtagtttgtctgttcactctgatgatagtttcttttgctgtgcagaagctctttagcttaattagattccacttgtcaatttttgctttcattgcaattgtttttggcgttttcatcatgaaatccttgcctgttgactatgtcctgaatggtattgcctagattttcttctatgactgttatagtttggggtcttatattttagtatttaatctctcttgggttaatttttctatctggtataaggaaggggtcaattttcaattttctgcatatggctagcagggaatctttcctccattgcttgtttttgtcaggtttgttgaatatcagatggttgtaggtgtgcagtcacatttctgagttctctattatgttccattggtctatgtgtctgtgtctgttctcataccagtaccatgctgttttggttatggtagccttgtagtatagtttgaagccaggtattgtgatgcctccatcattgttctttttgcttgtgattgtcttggctatttgggctctttcttggcaccatatgaattttaaaatatttttttttctaattctgtgaagaatttccaatggtagtttaatgggaatagcattgaatctataaattactttgggcagtatggacattttcatattgattcttcctattcatgagcatgaagtgtttttccacttgtttgtgttctaatttttttgagcagtggtttatagttctccttgaagaggtcctttacttcccttgttagttgtattcctaggtattttactatttttgtggcagttgtgaacgggagttcattcataattctgctctctagtttcctgttgttggtgcatagcaatgctagaaacgttttcacattgattttgtatcctgagactttgctgaagttgtttatcagcttatggagcttttgggctgagatgatggggttttctagatacagtgtcatgtcatctgcaaacaaaaataatttgatttcttctcttcctatgtgaatatgctttatttctttaccttgcctgactgttctggacagaacttccaatgctatgttgaataggagtggtgagagagggcatccttgttctggcttacaagggaaatgcttccagcttttgcccattctatatgatataggatgtgggtttgttatagatggctcttattattgtgaagtatgttccttcaacatctagtttattgagagtttttaacatgaatgaagattgaattttatcaaaggccttttgtgcatctattgagataatcacatagtttttatatttagttatgtttatgtgatgaatgacatttattaattgcatatattgaaccaaccttgcatcctagggatgaagccaacttgattgtgttggataagatttgatgtgctgctagattcagtttgccagtattttattgagaatattcgcatcgatgttcatcaaggatatttgcctgaagtttttttttttttgttttatttttttaatctctgccaggatgtaacccatgtcttagtgcattaagaaacaccagtgcatggaggaagtctactaataatgcacatgtccaaataatcacagaaagtatatctatttatttatttaaaaatctgtaactttgttcaaaatatttttctggaactggagtatcttacagcagtaaaaatatttcctaaggtaaaaccaattttagagtatataccacttgtaatataatctacctttcacttgatagtctttatcgaatctttcacagaagtagacaggatatgaatgaatgaatagataagcaaatgcagacattctcttcattttatggaggcagtaactgctattaagtggtgttatataatgtactcaggatctcagaacaattaatcagcatggcctggctgcacctcaattcttctaactacaagatacttttacacctaaagcagctagcatttaattgactgttttaatagaaatacagggtgattaccaatctacttgatcctttttcaattctaattatttttctaccaaataattgcacgttttgagagtttctaaatactcaactgtgtgtataaatcaatgattaatttttccttgattttaataatgaaaatagagcttcatatgatcaagaacctgaaataatacagttcaattaacataattccattaaaaacaaaggaatggaacagttaatctattcgtcgtcactgtgagacatagcagatgttctgttaggctgtttgaaatattagaagtatttcataaggctcctatatctgtttttctagactacatattgagaactgctgtaattacagtatcatcctcagtgttagatgtaaaatgttaagaaaaatctgtccatctggcaagaggaggtaaaagtttgttagagtgggcagaagttaggtctgatagcacctaggtctagagaaacacaaactccaggtaatacatatattctagtaaggtttgctccatttaaaaaatacaaacttatagaaacagaaaggcatttattatgctcatttagtagcaataaatgccttctaatatctttgaaaatttatcatgcattctcttcttaaatgtcttcaatgtgtacagagcccatagttaataacaattctaattattaaagaatatttccattgatttcatttaagtctctggtcctgcaacctccatttgttgatttttggcttggccctttggaataactgctcagaacaatcttatcttgtacataaaattgctttagttattcttcataagatatgatttctatgtttatgactgcaatatttatagccaacctgtgaagagcgtactatttgccaggcatatttctatatgctttatgtgaatcaataatttaatttttataatagatcaatgagttaagttgtattaccatttccattttcataatgagaagactgcgttatcataaggatcaatagacaaaagtcacaccaaagtcacacagctggttagtaagtaagaaaaagttttgatggttggaacaaagtctcacagctagttaaacagggagccagaattcaaactcagacagcctggctctagactaacacgtttattttgtgctttattaaatacccagttattggattatccttctggctccaggttcttttttaaaaatagctttcgtatgatctgagaaatattcttacatcaaatacatttgtttgctctctctttgagatttcacacacagaaaaaacataaatgctcaatcattaaaggtggtgaagatagctctttctcatcttgtggtcctactgaaaagtcattaagaacaagaaatcctgtccaatgccctgttataaaaagtaatgacagtaaagaaattattctgagcaaaaccaactaatttcaacagtcacagcaaaaagtcaaactcagatgattcaatttactcattgatgtagaaacaggagaaaaaaacatatttgaatcagatgatcaatgatcaaggaatgatgtgtttcctgttaaataattcttaattaaagaggaatgtttttatagtttttcaatagaacatcttgctatgtattattatcttgagtcatgctcactgtttttacatactataaagtttaagacatgttttactttcttgtcttaggaaattcagtaaaataaataaattgaattatatattttttgatcattcagaggtctagcattttttattttcttctaaatataaattctcattatgaaactctgtaaatgtagaaactatggaacaaacaatatatagaatgctctttggagatcaaaagaaaattaatctttttcaagtgattttgaaaatgtccattctagtggaaggaatgctagccaggtagaaaatgagggttctaaaaaaactctgccactaattcacgtctttcctcatttgctaaaataaaggaatagggttaagtggccacaaattccatttagttctttagttgcattattagaaaagtgatgtttgttccttatttttaaagtgtgaagagcaaaaccaaaactgcaggtatttgaaattagctgtactctctttaatatagtttattgtgttgatgcattggtctcataagaatcaaagcctgcattctccgtgccggttgactttggagcactaatgagttgtaagtgcatttattaaaccagtatcactccacggcctaggcctttctctacagagaaaagagctaatgaaaggaactaatgaaagagactcgagctaatgaaaacaaaaatcaactcaacccccaaacaatggtgtctggagtagctgaattatccttcctcctaaactaagaagtgtctcgcatttccaaaccgtcagtactctattgtaattgcttttgtttggactacaaagtgtttgggggctccagaacgtagggtgattagtgatcccaatatccatgttctctctgctaaattgaatttagcatatttgttacaggtgatccctggggcctttgtacacacagaaagaaatcaaattaataattcaaaacgtaaaagctatctgttggtctctcttaacttaatttgtttggggtcaggtccacaccttctaattcagaacgcgatttcagtgactcttgagctgtgatgctcagtgaatggagagtagaaaagctcgaggagacaaatctccttaaacacaataaaaccgacagtgggagaatttccaaaatggggttgtgattgaaaatacacattgacaaaggcttctctttacttctgcttttcataatataaactcaaatatgtgtgtacatatatatatttaaagtttcagactgctgtaaaaattagtctgtctatggatccagagagttcatctatatcatagtggaggaatgtggaagatgagtgagaaagcaagcatgaagtcatgagttcagaaaagattgcaaaatgcttctctatacagatggtccctcatcacgctgtgttgtggagtgtcgtacagacaactgtgaaaacatggagagcagagtcttgtgtcttaagccatgcattgcctggtgcaaatgagaactccgtcatgatatgttgatttgaataaatgtatgtacacaaatgtaatcattttagaagaagcccagtcttacaggcataagcagcaaacctaaccacagcttccacctttcaaaagtccttcttacggtgctgaaggaatttattttgcattggtttgctggaaagaaaataatggtcttgactattacagttctttactttcttccagaaaagcgaccatggcctgggtatggttttcagactgcatttttacagagtatttaagggcaaaggggcatttatttttgccaaacagactgaatttcacaaatgatacatgaggattagtgaatggtgttcactgtagcattaaactgctttttttatggccagataccattccaatctaaatctgcagaagctattcatgagagaattacactgtgaggttacatttgggttggttctactcaataaagtgacataaaaagaagagccaatgtagtcaacagaatttctaagaggcaatcttattagttttcttatttataagcgtggctaaagcattaatggtgctttcacagattttacgccattgtgaatgcatgttgtcaggggactctctggatccacaggctaattttcacagcagtctgaaactttcaagcatggattaaaattatgcttaccctttacttactattagttcataaccctcaacatttatgtgaataatctaagtttctttataaaacatagaacagagtttgcaggcatgatacgcttcagaagaggtgggagcacaattttaggcaggtggtgaagaaattttgaaacaaattctgaatcaaaatttgtttagattacaaaaatagaagatgatattgttaataataacggcacaattatgtagtttctgcttaactgtttcagcaatggattaaaacaatattagagaaggttaaaacaatagaaattataatagcatatttctttgtagtaaattagaaatttaatatatattgttttatacttaattcctggggaaaaaaaagaaacttgtggcagttcagagtggattgcaataggatttattgaatcccctatgtgtgccaggcactcattcagggccgctctgcagggctttgtgatacacaaatcaaaagtgtgcaattcacagaaacttcaatgcaaacttttctctctctctctttgttgtgcaactcaggagccatggaagtttcttatttgatatagaaaatcaaaaggtatagaagatgaagtttctgcttttgagaaatttctactatgaggggaataggtgttacttttcaggatagtctcatggtcagagggttaattaacttgcttttggccaacatagctagtgggatgagtatataaaatctgaaattcagatggtctaatttaaaatttagtgttattaacattatattgcattaatttcttttaacctaaaactttgcaccaataataaacttttttaacttataattcttgtaaatttaactcctctctccaccactgcaaaaagtgcttggcaatgtgagtaccagctgcttttagaccctgctaaaaaactgtgcccaatattttgagtttccatttcagttctgcgtcttgtgacttctagttaaaagaattgtgtgcctttgtaagcgtagagtttgtacgaacaaatgatatgaaatcagttagacttgacatctaattttacatccgttagttatttatcagctgtaaacatctctagtagaattttaaaatctcagttccttgtacataaagggtcattgaagagaccagtgtttcggagatgtttgggagtataaatcaggcagtatattatataggcacttagtacatctgagagaattgataaaaacgtgtgtatgtcatgtatgctaatcacttcttagtaaacatatatttcaaccccctttatttaatgcttttatttggacatatgttgtaggagtcgttcctctcctcacaacaagatatgatcatgctatcatatattttaaagagttaagttaggaaatggagtcaattctcaacaggagcttatctgcagtagattgctttggtcaaatccaagatatacatacagctagtaaataacatacttggtaaatgatatgccaagatttggctgaatccaaagcctaaacttgtatatttaccagtatatactttctttttgcaaacaatccagttattgatcacatttccctataatgccgatgagttattcagcaaaaatatgacagtttagggaatgtctacattattcttaatttataatatagaaaatactgttaattacctataactagcaccatgtatctctcctagcaatactcttagaataaaccatagggctaagtccgcataatactttggagattttatgttttttgtgatgggtaagtgggtaaaaaaatcttcattccccatacaaatagatgatttttgacttagattaataatcagtgtctacaaaagaggtatgctcttatgttcttgctattagcaggcatgttgatgtggctatatatgttgcagtggtgataataaaaatgtggattcataatttttcacatgtatattagaaaacaacatgtgacaatgtctgtgttgacatattttccaaatttaatataaaacaaaactatttcagttttaaaaataagcacctaagtaatcacaataaggggagataataggaaaatttaaaataattcacatacttataaaatacaataggtaacataaagcaaaatgataaatacagaaaagctaaaaacaataaaacacagtttagaagaaacaaaaacacagagattatttgtatcctggaaacagaaacctctaaaacttgataaatatttttaagaacctaactttaattttgaaggatgcagtatgaaaacaatttatgaaatttcttaaacaggacaatagcaagtgcttggtgtataaactctatggaacattaactataaacatgttattccgttatattaaagaatggagaatataaaactgagaagaggctaagtagactgccctgttgacaagcaatatctaaagctgtattgttaacatttgttgacattgtagaaatattagaaagacaagaatctctataaattataattctaaaccatgggtccccaactgccgggccacagactgatgctggtgtatggcctgttaggaaccgggccgcacggcaggaggtgagcggtggcaagtgagcattactgtctgagctcacctccctttagatagcgttggcgttaggttctcataggagcgtgaaccttactgtgaacgtgcatgagagggatttaggttgcgcgctccttatgagaatcaagctaatgcctgatgatcttgggtggaacactttcatcctgaaaccatctaccccaacctcaccctcctgtccgtggaaaaattgtcttccatgaaatcagtccctggtgccaaaaatgttggggacgactgttctaaacgacaaaactactatttcaaagatataagcatagctcatgtatgtatgtgtgggttatacactattataacacagaataaaataataaatgccatattgaatcaaaactatatttcatattatctagtgaaatgcgtaccatgtttaaggtgactagagataattttggcatctatttaccattctccctcgcattcatacaaaaatattatggttgaattgtaagtgcattgctcaaaaatccttctcatgaaacgtaagcttatttaaaccagtatttctcaatttgtgcttcattgacacttaatcctataaaatggcaaactaaaaaaataattgtacatcaaaataagtttggtaaataatgaactttaaaatttctccttagatgctgggataaatatattaatgcctgctaaacattccatttgtttccttatattttctagcctgtttgggcactcaaatttgtgaggagttatggccaaaaaatgtgatcaaaagtgaagtggattttggactaagacactggaaaactcatgtgcaattccccaatctcgtttttttttttgtttgtttttgtcccctttcttaccggagtaagggaggaagccccatgttgcagatggtacaaccacaaaataacagtacctgtattagccaggggttgttatggaacagaacatcattgctatcccatgatggggacatagggttaacaatatacacatctttattgttaagcccctaggagttcagggtttgctatcgagacgtaatctagcttacattggtcatatgctatacattatacatatgtatatcttactagcaagcccggaatgcctagtatacatatgtgcaattcgtatcatataataaaaaactcttagtcttcatgcagtaaagggaattctcaaactgtttctgtcacatatcctacagttatttatccatagaagctttttttttttttaaagagtctattcatatccccttgatccagggttccatggaacacagcttgtgaaacactgattttagatggtttttcatcttatttatttcattatcctttttagcaacaagggatcaaacactgtgaaggtttactctctactggataagagagtaagtctatctttgcccaaatattaccttcagaagtttgggctacatatttataatgagctgaaaacttgtgttcatatttatatttcttttattagtttgcattttaattatatctaatttttcacattttcagacatggtaggttattttcatgaaaatagcaataatactactaagagtttctttttaaatagttttccaagtctttaatttagttgttctttcctggattttctagaattcttttactcataattgaacaccaaaaactatttttacaatggttgtacaatataatttctaaaagattaagataggttttttattgagctttggttgatatctcaaaacatttagagtggacaccagggaatactggaaaaatagggattcattttgctatctagttctttctctcgggcacacacttgttgaacatggtctgtcatcctgagcatagattttaatgcctctaaaatcatttctattcttcaggctattttcataccttaagaagttttcttttctaatttattcatgttagctttacattgcattttcaaaaacagaaaacagtgtaggatttcattatatcactttttggattatttattactaaaaaaaagtaccgccacaggtggatggagtatcttaacattaatacatctgttctcttttttaaaactggagagcacatttctccccagagaaggggactatgtatcccttccttatatttccagtgtttaagatattcattttttaaaaaacactctcttcaatttcaaagacatacaccaaagttatgttttctctcatatagtatgcttgtcaaagtgtttagcagcttatctattgatgtagatgccactaacttctttgacatgaaaacatttcttattctttatttctcatactgcttttagagccagtagctggccttcttttttcccttaagtatgaatattcatcaaggaacttgttggacatttttttgtttgtcttctcttctttcctcctggtattatatatgtttatttagccttaatcattacttcaaagtagatgatttgaaaattgtatgttctgtccaaatctcatctaaaaactcaccccatatttccagaagcccccaaacaaaatgccatctgcatctacttcttcatatttgaagtttaatttctacaactttccacaaaacagaattttttccttattttcatatatatatgggagcagaatgactcttgtcgtagtcacaaaggttccaacttgattaagcactttagagaggtacttaaaaaaacacctttccttacattgtatgcaaaattagcatatttttctggatttatgaaacaatcccactttcaaataatctctctcggataggcgtggtggctcacacctgtaatctcagcactttgggaggcctacgccagtggatcacctgaggtcaggagttcgagaccagcctggccaacattgtgaaaccctgtctctactaaaaatacaaaaattaatcgagtgtggtggtggaaacctgtagtctcagcaactctggaagctgtggcaggagaatcgcttgaacccgggaggcagaggttgcagtgagctgaggttgtgccactgcactgccctgtgggcaacagagagcgactccatctcaaaacaaaacaaaacaaaacaaaaaatctgtcctatattaacataagtatattaaaatttgacagaccagttgctgtactttttggattggtttttgaaaacatagactttagtagtaagaaacttagtggagtaaaagtaaatgaagatgagtacttttaaaatttaaagtgtggtcagttaaaacttatttaacctaacactcaattaagtgtatgaaaagtgctgagatttatccattaatttttctcataagaaactagatcacgtatttcttttaccaaaattctatttgacattcaacttaaaatccaaagagtgtaatgaaagcccttaagataatgactgtgaaatagcaatatagcctgacgtttaatgaagtggatgggtatgtctcttacctaaagagaagatgtgaaaatttaaagtcacactggttatgctgtctgtgtgtatatcttcatttttaaaaaaatcagactcttgagaatttcattacctagccctccaccaaaacaatgcatctgcgtaaatatttcacaattttccattgttttaaagttggctgatgagaggttacttagtactgtttggtatttttcccaaatcttttataccacaacccggaagtacccatgcctcacttgtggtaacataaatacatagattcatatttctgattaagttataattattattttacataaatatcttgtctagttatctgaaaaacctaatattagaatttaagatagggagatgttagttcagtgaagcagtatcttcattaccaaatacgtaatgtgattgttgattgtacatttggaatgtcacacagttcattcttgttcccactggacataaatcaagatgttacattgacaacttgtcctacaagtctaaaataagagtcagttttgtcagaattgtaggcgtatttcacttactcataagttgaagattttggagagatgaacgaggtgatcagaggatacattcaataatgtttttgacctttatttaaaccctgtcagtatgaaaacttcagaataaaactataaacatatgtaatgagtgtgactgtcaggtcaaaaattcaaccgtgaaaaaaattttctctggaagacaacttaatatctttcttaagccctattcttctgggttggcaaaataaaattttttggggggtttgtgactaagtttcagaggactttcatattgcaagacaattcatatgcaagttgtcctcaagtcatctctctatgcggtatctcctgaaagaactgtctccctatttggtcttcgattacagatacacatcaactctcttccctgcccacctgttcctttcatttaaagtggccctctctgctgctgattacatgcatggccatggagatcattctctggtttccatccatggatgtcagtgtctacaagatgagttcattggcctaaacctggcatgcatttcctcttgctgatgctctggagtctactgaggaaggtcctctttgctcttgaatctcgcattcctctctgggtttttgccagttcccaaaatctctacctgagaagaaggcatggagctcctctcagcatcgcctctcatctcttctgctgtgtctctcttttcttcgctcctgggtctccagctggagacaaggacacagagatgatcagatatttactagtttctgcattattgtctctttcccaagaagtctcatggaagaaacaaacaaacaaaagagggtaaaattggaaaagataaaacatgtaaagatattaattttttgtatcttccttgtaagcttgacatcattctctttcaaaacacaaaggtactgtcatgtatttgcacatccctcatgtcttctgtcattatttactcttctgaaattatttcttctcttggaggagtactttctctgtgtaattttcaaatgttgtttgtgtatatttctgtgtgtggcaaaacttttgaagtcttctattccaaagagtatatatatttcaacctcactttcaagtgatgaaatatctatatataaaactgtaagccacaagttatttttcttttacactttagaagggttcatccttatcttcttgcatcgagggtttcttatgcccatctaatttttgttccttgtttcgggaagtcttttgaatgtttgcactttctttacttaaaatatactatgatacatctaagtgtaggtttttaattctaaatgttatgtgtgttagtggtgagataggtacaaatgcaatagaggaaactaggaaaaattctcaatccatttggggtgtgtgtgtgtgtgcgtgcgcatgtgtgtgtgtatgtgtgagtgtgtgtgaaacaccttcctccaaatcttaatcttacaggtctttttacctcatcaaaaaaactcagtaggtcaaaaactctgtgttgaattggtacctcttgaaagagcctgatgccccactaacatctgtggtccatcttgaatggggacagcttatcacaatagaaggagctattgatcgtgacttatccttgagtcccctcctgctcacttgacatttttgtggtatcgtactagccctgcacagcacacctagccctgttccgtggatttagccttcaggattccaacattagtacttgaggcttgaggactgaggaggtgagtgtaagcactaagcattcttcttgtcttgggtgcagatttcacagtatttccaaagattcgttcatactccatggcttgtgcttttgaagtttcgttttcattaaaaataaaaacatgggccgggcgcggtggctgacgcctgcaatcccagcactttgggaggccgaggcgggcagatcaccaggtcaggaaatcgagacaatcctggctagcacagtgaaaccccgtttctactaaaaaaaaaatacaaaaaaaaattagctgggcgtggtggcgggcgactgtagtcccagctactagggaggctgaggcagggaaatggcgtgaactcgggaggcggaggttgcagtgagtcgagatcacgccactgcactccagccttggtgacagagcgagactccgtctctaaataaataaataaataataaataaataaataaataaataaatagataaataaaagcatggtcaggttttgagaatgctgacatgactaaaaataattatactttacgaccatcttttccctgtaaagttaaatggtaattgcataatcgtatttagaataaaagagagtttcagagtgtgcctctgctctttccacccctttcattcataccactatgctcaggcctccctgtttagaaatttggggactactcctgagatacagagtgagaagaaggaaaaattaggacaaagccgtaataactcttactgctcccagtatttgcattaattttttgtgttaaataatttaatccatctaacaaccagtttataacattagtgaccacagtgtcgtcattttgtaacaaaggctatttggaaaattaccaaaacccaaaactgagtaagtagcagagctatattttatattcaggttttgtctgcctgtcaaccactttttttataaagaagacatctagattaagaggcaaaagacagagctgctatcctagcgctgtcaatagtgtgatcttccataagccatataatttctttgtgccccaattttatcttttgttaattaatagcataaagccctattctagctggtttgagcattaagcagaattacataagtatagcctgtgaatatggctagtattatcacagtgttctgtatacattagctgaatttcagtttgtgaaaaattaatccatatcccattttctcagtagaataaactgtctaattagttggtatttatcatgttatttatttatttattaaatttttttgacagaatcttgctctgttgcccaggttgtagtgcagtggcacaacctcggctccctgcaacctccgcctcctgggttcaagcaattcttctgtctcagcctcctggaactacaggcactcgccaccatgcctgacaaattttcatatttttagtataaacggggtttcaccacgttggccaggctggtctcaaacgcctgacctcaagtgatccacccacctcagcctcccaaagtgctggaactacaggcatgaaccaccgcacccagcctatcacattttttaacacagtaaaaatgaactgacttacatgaatcagaaatttgtatagtgtaaagatttactaataatttaaaggatacaggtaatacatagatacaggtggaacatggcctgaaggacccaggattcttcctaggtggatagatacatcctggactggatacatctgctggaccaaagtaatggatgagccattgcaatgaaggtcgctgttcacctcatgtagccagaagtatcatgaactgttgccactttactgatcattcagggattacatgacattttccaagagcacatgcttcataaatccatagatcctctctctcttttttttttttttgagacagcattttactctgttgcctaggctagggtgcagtggcatgatctcggctcactgcaacttctgccccccaggttcaagcgattctcctccctcagcctcccgtgtagctgggattacaggtgcctgccaccatgcctggctaatttttgtgtttttagtggagacagctttcaccatgttggccaggctggtctcgaactcctggcctcaagtaatccacccgcctcggcctcccaaaatgctgggattacaggcatgagccacccaccgagacacataagccaccacgcccagcccatggattctaagtgtgttcacctaagtggttccacaccagggacattctgctcaaatcatttcataaacaaaaaaacttccttctaataagtattagtacagtttccaggaagggtcagattttataccagagtcaccaaaatttttatccagggagagaaataaaaccaggctatgttcaacccaatcctctccatgtggccaaagtataatgagattgttgtaataaatactgcagtaaatattatgattttattttttatgcctgacgttgttgtaactgtaaatggggcaaaatcaaatcaagtatcatagattgagtagctgttgtgtacatggtagctttgaaaaaagagaaatttacttgtgatcaaaattcctttcaatgtctagaaatgcttgcctcttcttatgacatgataccattcttatctttgaaacagaataccttatataatagaaacctagagcaagcaatttcacatgaggtaacaaaagagttcccagagtttttccagatcagtggaagacttaagtacaggatggagggaaattttaaaattgttcaaaacaagaaagcatttccccattagagaatcaaataactgaagagagggtgtgtgtgtatctctttacagtttcttttctttttgctgtttatgtgcttgcattatcaagacattttcccaatatcctacttttattttagtagcattttcaaaatctgtatcaaataaagatagcaagtagtagagcaagatgaatgagggagggagaaagaatggattggtagtggaaacaacatttcccacaagcctatttattgtagcattgacagtaggaattcttataaatgctaggttaacttgaaattctaccaaatgtctgttactgtttgttttaaatagaattctagtatctcgggtaggaaatttattacaggcaaccctaagaagatatattccctaaactctccttcaggtgatgggattaatcttggtaaagtgactaagttgcttcttgatggttggtacattttgaaaaagaagaatcacattaactccagagcagaaaagaaccgtagatcattcttactaagttcattggtcttacatgtaaattgagaaagattgctgaaggcaagattgccccaaggaatttaacttgaaatcaagaggctacataaatgtaaagtgctactgcttaaataaaaaatattatgttttaataataatcatgataatatgacacagtatgaagcaaatatagtgaaaactagaaaacagtcttggaaacagttgctacattgttattaaggactaaaccaatttagaggatcgtggctgtgaacattttaatatcccactcagctccaaattatctagagaaatcttctacacattctacaatatggaatgcccaaggctgagggtgttgcagaaaataagataaaaaaaagaaattatatttgcaaccagactagcactttcttcagaacactgtgatgtcagtttcacatcagtgaacatttattcttaaaaacaaatccctattattctttgcctcagtggtcactgagctaagaaaaagaccagttggttctaggggaaaaaacaaaacaaaacatgtgagacattgaaacagtaagtgagaagttggtgaaggtagctcccaggtggattctgtcacatgctgatttattttcaactctgaatatttagcattgcacagaacacttgagcaactcttgaagatccttatttagatggctggagagaaatctacttgaaatatacagtatactcacctatgagtcctgccctacctcaacaaaatattccatcgcttttattgttctatattctataaaggcccaaaagactgactatggaagtggactgcttacaacatttatcttagtccagctctgtatacagcatattaattttagactttttaggtattcaaaaagtagcaatttatactaactatggcttcaatacctagcaatatttttattttattgttaattttgctttaaagatatctattataaagagaaaaattcaaaacagtatcttaggaaggcactggtcagcttgcctaagaatacaggtcatattatgctattcaagttacatttcagattaatatacttctgctagatttatgctgcatctaacatttgggggaacaaatggatgtattaatatgattttaaatgctgctctgtgcttaacttttattgctcaatggagagtgtacgccacagcacagttatgccaagaatatggtttcagtaaaagaaaggagctaatttattgtctcaataactagctcttttcttatttgatgttaaagaaagaaatgtgcatgtctgaagttgaggttcagcaatgcattagtatttgccaaattatgagtgacccttctaaaggctataatattttagtttcacctattatgttatatttattttagaaccaatttacaattttcaaattgtttcctacatttttattagttttatgatgtaacatagaatatatactgacaaagacaatattattttctttgacattacataaaccaaaaaatatgcattgttataaaatatgagaatcttgcaactgcaaatcagaattgagaagctttcatgcttcattaacacctgtgctataaattcaggtttaacaatttgatgaaggaatatttcagattgcaataatcacagaagtatttattttaatagtttcaaaggccaagcagaaatctgttacagttaataaacatcctaaaatggttcgtgtatgataaaagaatatcaatggtgtttactcattactctggggattgaaattaaatcatataaaaaaactgtgtttaagttccatatgcatttgttccttaattgtcagtgttttgaatttacgtcatacgcacatttgaaaaaatggggataacaatttgtgaccttttattaataatattggcttccaaaattggatgataataagagagtctctaagagcttatcttttttcaacaggaagcttcctcttattcttaatttaattcacaagattcccatgaagtatgtaacttgaaatagcatttactgagtaaagaaaaatggttaatgctaccaacaccaatacatatttaatgattgagaaatggctgttaactatgacaaaactatcaaatcacaaattaagaggtgcctcagaaatcgattgtcatccttttatccacatttagggaaaccaaaacacagaaaagtaatgacaattttctaagacaaaacagcttgtcattccataaagtggctactacaattgggtctcctgccttccagctcaaaatatttcccctatactctgtaatttcagaagggggataaagaatataggattttttttttaactttttaaagttatttttatttccgtctcttttattaaattctttgtttatagaagattgcacttaccgttgctctgttctcatattttataagcactttgtttttgttttttttttattatactttaagttttagggtacatgtgaatataggatttttacagtaatcgtttgttaaaacattttatttaaaactaattaagatgcatggaaatttgcaaagttagtgcagagattccatgcattttaaactactttcctctaatggttgtatcttaccaaactagcataataaatggatattggtatgatgtttgtgtaatgtcgatcacacataatcactgcaattggaatatagaactattctgttaacacaaaacttttcttcacactacacctttatagttaaaaacgtcacccatcagccctatacataacaacttatatccgtctgctggatgtagaaaccttgactccctgtaagtccttttcagctttgattatcccagctccatcctctttcatctctttttctgttactctgatgacatgaatgctaaatctgttattacagtgccacagctccctaaggctctgttcattcttattttcagtctttcttttctgtgttgccgaggcaaggccattgataccattctttcttctaatttactgattctttcctctgccctatacattctactgttgagtagatcctattgagttttttattttgcttattatattttcagttctaagattttcatttggttcttctttatatcttctatttctttgttgagactttctttcattggtttcaggaatgtttattatttcttgttaaaacatttttatgatggctgctttaaaatccttgtcagataatcccatcttctgtgtcatcatagtgttggtatttttctattatattatgtaatttgtggcccttttttcctcttgtgcatgttggtatttctgggttattggcttctctctataagaaaatatatgaagcaaaaagaaaatccaaggaattcactgccatgtatcctcaggtccctatgtccccaatgaacctatcttttctctgcttttcagaatcttcttaatggatgtttcatctacagtatcaatgacttggggctgcagttcacagaaagaatagagaaattatgtgtactccatcttggagttgaactggtagccctagctagccctttgatatcacaaacacatatgtgataatgggtattattgaaagaaaggaaatatacttaaaacgacatttaagatggcaccttagacagaattttgcatatttcatgaatgcccctaatattaaactggttgatatgccttttagtatgatgacaagctttagttgacagtcgtacaaaacctgtgattttacagatttcaatcagtgatgattgagagacggcactatcctgtcagcacagaaccatgttccttgtattcaggtgaatgaagattatttttattagtgatgtacaatccagttgatttctgtggagcactgacatccaatctgcctagttatcagtccactatttctatacagaacacaattttaatgtcattcccgtgttcctcagtatatccttacattattaaatacggacattatgcaagttatttaccaacactgtttctacgttgtaccttttctaaaaagcttttcttttccaaggagataaaacaacaacaacaacaaaggtaatagtcataatacattttaataattaataacatgaactttgagctatcttaaagccaatattgcattttaaagaaaatatgacatttagctgtattaatactttgtgttttatatcttatagcagtttcagttatctattgctgcatagcataccaccccaaatctgacagattttaaatgacagtaatttatttcttataaatttgtaagtatggaattctgtcagggccaagctggttagttctattccacaagggtgggcaggatttactcattttctgcattaagctggtagctgggatgaaatttccaagaaaacttgattaacttatatgggacctaacttcctcgtgtggcttctctactgcgttagttttgttttccttaagattcgaaacagacttctaagagcatacaaaaatggaaacctacaaatcctcttaaacgaagccacatgttgtctattctgtcatattttactggtgaaaacaaatcaccaagccagcctaggtttaagagaaaagggatagactccacctcttgatgaaaggaaagacccaattttattgtaaaaggcatgtggaataaaagatattgttttatgatcttatcttcaatttttttcctcttggaaaattaacatttttgaacctcagggatttttacaaataatttgtaaattaagtaagcaattttcggtcttttaaaataacacatcacgtagattgaatgggatttcttatttcataatttgtaaatagagatgctgttattttcatagtaaaaatatttatttatttatttatttatttatttgagacggagtcttgccctgtcgtccaggctggagtgcagtggcgtggtcttggctcactgcaagctctgacccccgggttcacgccattctcctgcctcagcctcccgagtagctgggactacaggcaccgaccacatcacccagctaattttttgtatttttagtacagacggggtttcaccgtgttagccatgacggtctggatcccctgacctcgtgatctgcccaccttggcctcccaaagtgctgggattacaggcgtgagccaccgtgcccagccataaaactgtttatttctaaataattgtaattggtcagtgcagttgagcctttataatgtttagagaatctatgcccaataacagagattttaagagtattcagtcgatttcccttttctctggcattaactcaatcaaaccatctcactccttcatgtgttgtatagattttccaggcttatctctgacctttccaccactccacagcctacactcttgacataaacaaggccagctccatggggatgcgacctatgcattccacagggtgctgaactcaaataggctgcacattaggtatagtgctctgctgtcactgtcttgaaattcttaatcattttttaacaacgggccctacgtttttattttgcactgcgttgcacagattataagccagtcttgtttttatgtctagaatgagctttctatacctcacaatattctactggacaagttttcaaacagtcttcaagactcagcttaaatatcattttgattttcaaaattattctaattccctaaccctagctatagaaggaataagaagaaataaggtctcttctatatatatatatacgtatatatatacatatatatatacacgtattctatatatatatatacgtatatatacacatatacatatatttatttatttattatttatttatttattttttgagatggagtctcactctgtcacccaggctggagtgcagtggcgcgatctcgactcactgcaacctctgcctctcaggttcaagtgattctcctgcctcagcttctcaagtggctgggactacaggcacgtgccaccatactcagataatttttatatttttagtagagacggggtttcaccatattagccaggatggtcttgatatcttgacctcatgatccacccacctcggcctcccaaagtgctaggattacaggagtgagccactgcgcccggcctcttctatatattttgtcttcataccacttaccataaacttctattataataattgttttattattatttgtgtattcattttcatcctccattagttgggtttaaaaagcatgatactcattattacccacttagtaatttcccagtacataatctatgacatgtatagtaaatattcaataaatatttgattgaatcaaagaacaagtgaatagattaatgcaatgtagttatgtatccttctttaaaacactgtacattgaggtacggtataaatttgttcgataacagtgtttgccttatatctctagtgaaacttctcagttatatttttgtctaattctctttgatcctcactggaaatataagacatcttttgttatcagatattcaatcgcctttatacagttattacttgaacttaaattctttctttaaacttaacttctcagagataataaaagccatgcatgtggtttaacatttacttttacttaacatttgccattctgtatgttttattaatttatatttggaaactcatctaccactagattctaagtccttgtagaagcttttacttccagccaaggtggagtagcagggaccaaatttgctctcccctctgaagaaaacatcaacttagagaaaagagaatatgaaatagtgattttgcaagactctgaacatgagtccataaagctgtaaatgaataaagtagcatgatctttgacaggttggaaacaaatttgaagagacctacaacagccccagctactgtgtggaaagaatgattccaggatgtcatgcaggtccaggaggttgtctgttgtctctctgggttgaggcagagcagtcttgaaaggccaagctggccatagtccttagagaagactggtggagaggagagcactgcacagaaacgatgttccagagatctaagaagaaaccctccggaatgttcagtggagaactgattcgggagtgtttgaggaaactatctgaggcaggtaaataactactgaaatgattaaaaggaacaattcctgaagctcgcatagagctcaaactatctgctgcttattcccacaatccagagagaaaagtctcataattcatggggcatgggatagagtttgcatcagtagtaaagcaaaattaaccctacactaaatgctgctctgatctcaactaacaactttcaagcaagacccaaaatgtttccaagtaacttaacttgtcataaatgaagcttggaatatttctaggaaacacaaatgtccagatccaatgaggtaaaattcacaaggtctgtcatccaatcaaatgttgccaagtatgaactaagcaggaaaatataacctagaatgaggagaaaaaaatccaaaacaatcaatcaatactgaccaagaaataatactgatgatcaaagtagtaaacaagaacatttttgttttactattgtatcccatatattcaagaagtgagaatgatgagcgagcatgaaaattagaggtacagaagatataaaagagactctgatttaacttctagagattataaaatgcataggctgtgactgttggcagcttagagattgtaaagatgagtgaagttgaagacagcaacagaaaccattcaaaaggaaacacaaagagaaaaaaatgactgacaaaaaattaacagagcatcagtgagctatggggcaacttggggtcctaaaagggtggagaagcaggagaaatgtttgaagaaatgaggagtgaaaaatttccaaattcgatgaaaactatcaattaaaagatagaaaattttcaaaaaaaatagaagttcaaaaaaatggaaaaagctaaagtacatcattatcaaattggttaaaactaaagataaagataaaattttaaagttatgctataaacttcttgagtaggattgaatgtagttcaacatagtgacatacacaaaatggctgcttattctatactagtagattcattttatcaaataaaatcatttcttgttatagatattttttaaaccttagatctgtcggccatttcttagtattccttagtatgaagtatttcttaccccctttacgtatttctaagaaggtaggtgacatataacaaataactttgaaataaaagttttagtttgagtttgtttacgcagaagcaagagattttgcaaaaggaacacttgttttcaataatgtaatggtctagctgatggtcaactgactcaccttttaaaatttttactgtgtagtaagaaagttgggaaggtagtgtgaatccatttacttaatcctgggacacgttaaaaagaggactttatgaaagtcctctttagtgtataaataaataatactttatgaagtattgtataaattagtatatacataatagtatatataaaaataggtatacatgaatactgtatgaagtattattttcataaggcagctatattgattgcattgctgaactgtaaaaatgattgcaaaccaaaataagagagatagatagatagattagatagatagataagatagattagatcatagatagataatagataaaaattaattgttttggaaaaatttggaaataaagtgaatataataaatacatatatatgttagcttagaactggcatctgttaatggaaaaattgtattatacttttccctcaaagttccttactttctctgaaaccagcctgtatataacaatagccagtccgtatatggctacgcagtttatcctgatgtagttgcacaccttcctttgtgccctgaatgtgggctctttgagatccactgctgttaccaccatctggagactgctcgggctcctctctcagtctgtggttttatgtcaaatccttttatcctttaatttccacatctgtacatcctccttagcactaaggcatcttttgataatgattataggcatgcaacattgccctagatgtaaatcaatcatggcaaatacccttgcagagaacagtatctctctataaggacatacaaaagaaaactgtattatgcttgaaaagaaatatttctgagatcactttattcttgatctctgaaagtcattttaatcctgcatttttattcactgatgtatccttgtatctgccatctctttctacactacatccttttatttttcccagggctaagtacccgtatgcttttcctttcaatttcaaaatgtggaccagatgttgggacataagtactagtttggaacaaacatctgtgcccttttcaggcaagaagaaatgagaatgaggtcaggcatctggttaaggacacaggaggcatccctgtctcgtttcttaattagttcttctaagaccttctctcattctatacataatgtttataatttaaaattcatagggtcttatgttgaaagggagaaaccactgtgtggaatataaaataaaaactcattttacagtggaaaaataatttaatctatccagcttattatttttcctgggcataaagaaaatacaataattaggtagctgcatattttaatagcttttaacgctgattgtaaactcaatactgaagaaattagtggtcagttggtctttctatttttattaacgaaaactgccaatgagaggaaagctaatttaaaaatcgtacaagagtaaccttaaaagtgacttaaaacatgaaatatataaaacacatgagccacttatgctgttataatttctaaagttataccatattggctataaaccatgaattgatatgaaatctgagcacatgcatacatatcactcatccttatacaagtggagagttttttcttaaaaaaaagggggaaatgtttatgtttcaatatacttgttccattcctaataaatgaaattcattgctgatctccataatgggaattcttggctggtgtcagattaaatgtgaatttttggaagtttgtgaatgccagaaaataaaaggtggttgatttccaaaatcaaaagtaagatactttaggtatgtatgtatatatgtattttaatgttttcagcaaagccaactaggaacacaaaaagcaacagcagactagcaaatcacaacaagatttccgggtcagtctgctggtcaaatgaaagttcttatctacctatgatttaggtgtaactaggaaagcaagttgcttgacagaactgaaaatagaacaaaaagttccagattcatccaaatctgaaagtttagatatggaaaacttcctctgcttgggctttatataaattttctgaagtctcacagatcctttcaaagggtttgctgttactgagaatagaaataaaatctccagattcctcaaaatctgagattctaggcctggtttacttgttcttttggagttttaatttttaattaatcttctcccaaacttcccaagttctccttaaggcctcacatcagtttttccagctgtgatgctgtgaagcaatgccttgtcagcatcaggcctaaaagaggtcagtatccctttaaaataaatcttagggtttcactaaaaaaataaatatgtctataagcattcagctgaatgtggatgatttatgcttctatacatgcaacagcccatttgcaattttgctttaatgggatagagaacagatctaattagtataaagaaattggtaggaaagacagtcttagaaatcatctaatccacaaagtataaatgacaactttctattctttgtccatataaaaatttttatgtaatttaattaatatttaaatgtatttttttcaaactgcattgcataacaccttgatctttattctactggcctcattcagattaaagttttgcagattttgatgtggaaagcactatggaatcaagcctgagaggatcagaatcatcatttgtcatttgctaaatgcaatgtcaagtggtaattcaagataaatgccttaaagataattctgcagtcacagacgtatttttagaagtgttgaattagatttcatattctcaacacttctgtgatctttatagaaagtgatggacatatgaggtacataaactatagatagttatgattgttttagaagctgaggtaaagtgtaatgtcatcaagggactgcatgtgatgaataaaactaatgactagaaagttaatcagtgtgaatattcaaaaaatgattatatattcatttttgaagctataaatgaatcaaattataatttgattcatttatagcttcaaaaatgaatatatatatatatatatatatatatatatatatatatatatatatatatatatagtcacccaggctggagtggtgcagtggcacgatcttggctcactgcaacctctgcctcccaggttgaagagattctcctgcctcagcctcctgaggagctgggactacaggtacgtgccaccatgcccggttaattttttttatttttagtagagactgggtttcaccgtgttagcaaggatggtctcgatctcctgacctcatgatccacccacctgggtctcccaaagtgctgggattacaggtgtgaacaactgcgcctggcccaaataatgtatttttatgtttaatttgcaaaaattattatttttatttatttctcaaggcacatgagaaaatatcaaaaattatttttaaaaagcattaatatataatatgatcatcactcaacaatgagttactgtcatacacttgtttgaaggctacttaaactatccataaaaggaaccaaatcatatcctttgcagggacgtgaatggagctgggggtcattatcctcagcaaactgatgcaggaacagaaagccaaacacctcatgttctcatttacaagtgggagttaacgctgagaacacatggaggggaacaacacacactggggcctgtcaggggtatgtggggagggagagcatcaggaagaatagctaatggatgctgggcttaatacctaggtgataggttgatctgtgcagcaaactaccatctcacatgtttacttctataacaaacctgcacatcctacacatgtaccctggaacttaaaataaaagttgatgacaaagaaaaaaagactgtgagatgcatgttagattattgatatctaattaatttcatttaataaatgtctattaagaaaaaaatcccatctaatacgaaaaccacgcaggaatgtacaataacaaaatcaaagattcagtcaccctcacatgcatctcttttctggaattttggtttgtagcacatgctacaacattagacagtagggtttatgtggtacaatttttgtggaacattagattttacatatgtcctatacacatacatatacatacatacaaatatctatgtaaaacctgattcattttgtgtgccaacttgactgggctatggggtacccagatatttggttaggtattattctgggtgtttctgtgagtggtatttgggaggagactgatacttaaattggtgggctttgagtaaagtagattgccctccataatgtctgtgggtctcctcccatcagttgaaagcctgaatcaagcaaaaagattggcttctcatgagcaagaaagaattctccttcacaatgctcactgcagatttaggacttgccaccctcgatgattggctgagctaattccttataatatgtgtatttctctctatatatacacatcctattggttttgcttctctggagaactctaatacaatacccacataaaatatgtcacttcttgttggttatgaaaatactcttgcatatcaaaaactctcagcactacttaacaatcagaaggcaacaagattatatttctttcaaatgtaactcacagattcccctcttaattcctaccatgtaatggagaaatcaggcctgcttcatttacaccatctttgcatgacttctactcaccgatgaaattgattttctcaaaatagcatcaacattaaaatttgtcccatggatgctgactccttccatggttttccaagaaggagaaaatatatagatggttatgtgtaggtccatgcgtgtgcattttaagaatacgaatttccacatgctgttagcaccagtcatgtgatattagctcagcaggtattaccacctcactccctcaggtagctccaattgcaagagtgatatagccaaaacttacaattggaacctggttataatatcaacatcacagcacaaattgcatgtagctcaggtcactctctttacttgcctccttgcttcaaaggaactaccttctccttgcaaatttacccaagcctataaagtgcatggagtgtcagagaataaaatacttcctgaacatgacatttgggtaaagtttgattgtctaattattatggaaagaggaaagggaaggacgcacaaaaagccacaaggaggttttaaaacacaaggaggggccactggacaagcgcggtgcctcacgcctgtaatcccagcactttgggaggcggaggcagatgaattgcttgaggtcaggagttcaagaccagcctggctaacatggtgaaaccccatctctacaaaaatacaaaaattagcctggcatgggggtacatgcctgtagtcccagctacttgggaggctgaggcatgagaattgcttgaacttgggaggtagaggttgcagtgagccaagttcaggccattgcactccaggctgggtgacagagcgagactccatctcaaacaaaaaacaaaacaaaacaaaacagaaaacaggggctactggatgcttgtgagaggcagaacagaggaagtttaacaacaaaatggcggccaagcttgggatttagaactattggaacaagagcagattcctaaactggccaaatctcaggagaatgttgacaacacctgtgataggttatatataaattaatatacaaattttgaaattgtcaggagaatgaagtctagcttcacagcaaaagcagttcaatacattacttgttttaataaaaaattataacaaggattattaattcttattaagtgttaacaagcatgtggagaaaagggaattcttgtatactgctggtgggaatgtaaatcagtacagccattataaaaaagacagtatgaaggtttcacaaaaaattaaaaatagaactactctatgatctagcaatcttacttctgggtatatagccaaaggaaatgaaattagtatgtcaaggagatatctgtactccatgtttattgaagcactgttcgcaatagccaagatatggaatcaacccaaatgtctattgactgataaatggataaataaattgtatgatatatatgtatatatactacaacatacacatatataatgaatatactacaatatgcaatgaaatactatgcaacctttaaaaagaaggaaatcctgtcctttgtgacaacatgaatgaactgggaggatattatgctaagtgaaataagccaggcacagaaagacaaacactgcatctcacttacatgcagaatcttaaaaagtgaacttacagaagtaaaatgtagaattgtggatgtcagtgtctggggtatagggcagggaatggggagatactggttaaagggtacaaaatttcagttacataagataagtcagttctacagatctattgtactgcatggtaactatactttaaaataatatgtaatcatgtattatgcttttgaaaatcgcatagatcccaaatgttctcagcacaaaaacaagtatgggaggtgatggatatgttacttgggtggacttaatcatttcacaatgtacacatagatcaaaacatcaccactgtacaccataaaaatatgtaatatttatttgttaataataccttaataaggctgggcgcggtggctcacacctgtaatcccagcattatgggaggccgaggtgggtggatcatgaggtcaggagatggaaaccatcctggtaacacggtgaaaccccgtctctactaaaaatacaaaaaaaaattagctgggcgtggtggcaggcacctgtagtcccagttactcaggaggctgaggcaggacaatggcgtgaacccgggaggtggagcttgcagtgagccaagagagcaccactgcagtctggcctgggcaaaagagcaagactccgtctcaaaaaaaaaaaatataataataataataataataccttaataaagctggaaaacagaaaaagaaatttagtaagaagatacagtaataacttttagtagcatttgtttattgctttgcaaaaatctttaaatttttaaaataaatgtgattctcacagaaaaattatctaagggagttagaaaactgtagtggaacgtgtctagacaagaataggtgaattgtctgaattcaaatctagtgaggagtagaatcagacgttggtcccttaccttttgactccgtacactgtatgtggtaaagaatatgtgaaaaataggattcagtacctgtctaaatttaagtgtatttgggatagacaacttaaatacccacactagacagcattaaaagtcacataatgctttcacataatcatttgtaggtcagtgttctggaaaaaaggaaaatcaacgtagactaggctatttttatgtcaatgtaaactgtcactgctaaaaatgaaccagaaatgtgaaagataaaatattttcttgtttcctaataagcttctctcatgctccatggttatttttattttttgaatacagtgcaaatattactttaaatattctaaattttttcttagagtttttcattgaagaaacttctatttggcgtagtgaaaagacatattctctgaggcttgaatgagttagaagacctccgaaaaataggtgatatgatccagagaatagtttggagccaaaaagaataataccacatgtcactacctggagtaattaatacttcttggtgtgtagcacactgttttatctctacttaaaccaaagcatagccttgttttgttgtataatttatcagttctcttttcttctttgtttctcctttacaatttttcttctctttcttcaagaagagatctgaatgagaattagtatgtttactagctctgactcatatgcagaaccctgataaagaaaacagatgatcctctatttccctacacagccacattctcccccttctaacttcacacataaagggaagttgattattatccagacactgtcttcccttctgaccttggtgttttcctttccgagcatctcaggatactaatcactagttgatctctttattaaagtaacactgctcttgatattggtgtgagatgcactccattagtacgttttgttttcagaatatctcttatcaaagccagatataatatagcacacaaaatagtatgtgttctgcaatatcaagaaaggagattttttagtcaaaatatatcattattactggataaatacacatgaggcccacgcagagttcttgacattggaaaaacttatttactccttgtagcggggaatagtatgttgacttagtagcattgtggatcacatgattgatcccttgcaacagtttgggcgtctctctcatcatctctttctgaatagtccagaaattagtagtagttctaaaaattacttaaattacccaacatcaggctatttcctcaagtcttctttagagggaaataaccagattgatggaggaggaaacaatgcatcagacattaaccttcccccttgcaggtgaggtaggcctacactccagttcgtcatgggagcaagggaagggcagaaagaggaagttgaatagactagaaagtattagaggataaatgggaagaaatagagggaggaaaataaaactggaaataaaaacttaagacagaaataaaaacaaaaaggagagtgatgaatacaagaagagaactgttatcttgctcaattcttcctgtctctgataatctattctatgtttcctcaagggctttgttatattaaatgagttttgccagaattatgtgtactgttgccatgatttccatgtattcacctttctttttgaattcttctgtctcttcctccttcccttctttttgtctcctgctacccccattagttccaaattctaagcaaaggtaatctactcttcagtataaatgaatgtttctgtccagtggaatcaatatgttaaattatcttgccaacctgttaaccacgtgtcaggaacattgttcttaaatgtgattgtgacaaagcaactagatatcacagtatacaagtaatatatatgatacacacacacatatacgtacatatatacatacgtgcacatgcatatatacacatgtatatacatatatgcacatgtatgaatacgagtaatatatacacatacatatgtgcatgtatgcatgtatattatatacatgtatacagatatatacatatgtgtatatgtgtgtatatatatagagtaacttaaaatattttgacaaaaataagttttcatcaatactagattctaatatagtgttaacaagtgctaaaatttaaaaaaatgatggcaggtttgtaaaaaacaataaaatacaatctattcacttatctgtttcccataaaaacagagaaaggttgacatcctttgtttggtgtggatcactattttaggtgagcctgggaggaatgatttgagaagcagtgctttagaatatctgaatttgagaccagatcaggaaacatggatatacaatgtgtttgatcctgctattattttaaattttctcctacttattttcttatattcaatttggtcacaatgcattttcaaaacaaagcgttcattttttgaccacaaaaaacagttcgttaatgaaccatctcaacagaatacttttattttgctcaatgtctttcctttgaaactgtttttttttttttttttttggctctctttcttttctctccaaacaacaaacaaatgaaaccgcaaaaaccctgtcaatagaagtaaagtttttaaggcagatttattgtctttcctcctccctatcagaatatttaataagggtgtggctttggaaggaaattgtctcagtgatggcagaagaaatctacgtaacagatcatattgaatatattgtcctaaaatgaattatttcagagaatagaagaaaacctcttatttgttaactcatctgccttgtggaaattggaaacataagctaattaacagtaatccataaaacccattagaggtgtagatgggaaagatactttttgaagtagtaagtctgtaaatacatagttgcaccttcttccctctttttctcttcctcctccttctcctcctccaattccacagctaatattttcactatttgcgaacttatcatcatttttaatactgaacacgttattctgaagtgatccatcttgcattctaatatcgagtgcttcataaatgagcagcctagcaccacgcttagcacactatgttggaaagtcttataaatgactttgatcacaaaatgttaagaaaaagttgtttccagattggctgggcaagcgggaatgaatttgagagttgtttcactgcatcattctggttgcaaatactctcttgaattttaatgatattgtagcctgcctcagtgcttggaccccatcaactttacttccattttctagctgccttttctgcagtctatgatcattccatttctgaacctagtctggtgtctgctttaattggcctgcttttgtgatttgttcagttagattggagcttttcagaaagatagtcagaagccctgcccatcaccgtatccccagctgaagcctctttgactagtctaaacatacacacacacaccacacacacacacacacagccctttatttgtgtttgtgttttctagtgcaagatgttgcagtcttgagtccaaatactcagaggctataaaggcaacagtagctagctaaatttttccccactaaaaagcaaagattatgaagtttgtttttttaaagggattaaaatgtggcagggtagcaaaaaggactcagattgtggaatggccttgagcaaagcattaaggtgcaagtctgcagcacagaacagtcagaaacctacccagctgtgggtcttgttcttcctccatctaagttccagagctattagcagttccagctctaactcttcaatgtgacttttagtgaggtgtgtagggtaaattgaagtcctaggtctcatttgtagaaaagtattaggtgggctgttccctagtctgtttgaatcatcaaatcatagaatttctgtgcattccatgtatgtgtggcagaatcacttccctttacacaagatggctaaatgtttaaccagcttctggagaggcatttaaaaatgggatcttctgagactttgcatgctgtcttcagacctatcttgtttcagagtactagagattgatacggcaggataggttattataggaaacatattttcgtagtccagaaaatgagaatttatttggtttatgttgttgtttttttatatgattctttggctaagacactaagaatgaaatctagttattgaaatcaattttatcaggaattatcacatatacggtgtatgaaaattattatctggaagttggaaattattttctttgctcttttgttgagtcgcttattgacttaagtggtgtttgctacttacctgagtagtgggcatttgaattccaggactttgattggacctctggtctggttttgactgtttacgctgggctacaccataaaagctcgttgggttctaaagactgagggaaatgatgatgtaaactagaatcaaaaagttgtttttacttccaactaaccagcaaagaagcgattcttgaataccaagtgaggggattaggttcccttcacttccctttctttttggtaaaagctgatacaaagtgaaggatgcaccgggtcagaggatctgagaggtgagaattctgactttcatgtgagtggctgggagtgggatcacatcagctttcaaataagtttttgcagcatcgctattaggaattctgtgctgtttcgtagaacttcatctttcctatacacaatttcgttacagcagggctgcatttgaactacaacaatgcttaccaaatgtgtttcaacaggctgttgttttcaacactggttaactgttaaattttacctaatacaaactgatagaaaggatcattactacagattagtgagtacatttaatctatcttttcacccttttcccaaattccctttcctttattcatttggacagctttccccaacaatatttattctagattccagtagaaaatgctgattttgaagtaatcaggaatttatagcataataaaagaataatagttttaagcgtaataaatgactgaaattgctcataattgtttgatgattttagtcattgaaaagcctgattaggcttcatcttctgatcagaccaattgttgaataattgacaagcaactaattaatcctaaaatgaaacagtctgatctaaaatatccctacttaatactttattgtgcttggcatactgctgttcctgtgaagacagctatagtgttttgatgattatgtgcatagctgtaaaaattaatatggtttacacatacctcttcagtaatatattttttatacattcaaatttatttcaatgtacttttatcttgtccctctttaaactcttctaagtacaaagtggtatcattgggggattaatggctatttaataatttaatgttaacaaatgacaatatatgaaagacttccatcattcaagtagcctaaactatttgcaaagaatttatgaactctatcatatttgaaaattagcgtgttaattttaatcagttttcaagtatattaccacttcttaactatattactaccatctggtcttctattccttaaaatgtagaatgttctggtaattattttgcctttaagaaaaactaatacaaaaaccaagtatttgtgatggagtcgttgacatgactgatttcagtatctctaagtaattagttaaaatatgcttgttgctttcattaaaagcaattttacacagactaatgcaaaagatgatggtagtaaataggttttcaggtcatttctgataaagttaaatgtggttgtcatttcaattgatcattctgcatcttttccagactgtccatccatctcttggaacagcctgttcaataaattctacaggaaataatttgggtgattttagagaaagtgcatccttagattaaatgcttttgggtacttttatttatttctatgatggataagaatatatttcagagtgttagtttcctgatttataattattgaatttccttgaaaaataactatttgaataaatcccaaatgaaatacaaattctgtgcatctcaaggaaaacaatgaattcaggtaaagttgatctagtactcacataactatatttacatatgctagataaaattattgattacttagcacaaagttataatgtcttcctgttattgaaatattgaataataccttggaatagtgtgagagcaatattgttcaatgtaatagtagttgattaaaaatacatgcatacatggcagacttgacaagcatcttatttattttgggaaaaacttgttcaagagttaaacagtttcataaagaaggtgcatttgtgttctctaatacaatcaggtaaaagaaaaaaggtaactagagataaaacagaaatcttgatagacagtatagaaagattttgggtgcaaaagaaagcataatattagacatctaaaattttttaaaaagtacatcaaaattatctcaatctggagaaagtcaacgaagaaaactaagaataataacacagtatgataaagaccgtgatcccccacttgtaggtaagaacatgcatcatggacataaagatggagacaataaagtgacgactactagagcagggaggagtagaggggcaagatttgaaaacctgttaagtactatgcttagtacctgggtgactggataattcataccccaaacctcagaatcatgcaatacacccaggtaacaaatctgcacatgtgccacctgaatctaaaatcaaagtcaggaagaaaaaaaaaaaaagaagacaatgatctgggtaacacaggaagtgcaaggagagtgtacaacccagtctaatgagtttcaaggaaatgtcaaaagactgtgagattgaactgactctgataattatcagtaggaatttgtcttgctgttgtgctgaagttcatgcaaaaatgctcaacacatagttttttttgtttgtttgtttgtttttaaagaatttcgacaaagaaataagctctctgctttggaaggtcggtaaaagtctaagttgcaacttaaaaaaagatggcaaagctgattcacctgttgcttctaccttcctcagtaagaataaatagttgggaatctggaaggagtttaaaaaactctgcaaaatgaaaattatagactgagataggtgaagcaaaaataagagaatgcacaaccaaattaaatgttagtctctagaacctgataatatgtctaaatactgaagaattagaaaagtgtttaaaaaaaactgtggaagaaaaagaggcacaggatactgtatagaacacttgttttctctgatgtcaagtaaaagaaatgatcagattctaaaggcaataaattgataagttaggacaatttttaaaacatttcctgaaatactgtgttgttgcaaagtaatatgcagcatccagctcctccttccaggaagatctgctgtcccagttgcaggaagtgctggaggtgagctgcctttacctgtcgccccctttggggttccctgagagtctggctgagggtcaagcccacatcacagcaacccttctccttctgaccaatccagctgccttcccctccctttcaccagtgtttgccccaaagcaaactccagtagccatcctgcacatcatctcggtcccagagactgctccccaaagaagataccctgagaaaatgttggaagcattaaaaaaaaaaaatagtgccactgcccagttaaagaaacagaatatgtataaccatttcttttgaagctcatacatgctctttctcttctcaaattgtttccacaaacttcagaggtaaccactgtcttaataattgacttttttttttttttttttttttaagatggaatcttgctctgtcacccaggctagagtgcagtgacgcaatcttggctcactgcaacctctgcttttttggttcaaatgattatcatgtcttagcctccctagtagctggaattacaggcacctgctaccaggcttggctaatcatttatttttatttttagtggagacaggttttctccatgttggctaggctggtcttgaactcctgatcgcaagagatccacacgcctaggcctcccaaagtgtgctgggattacaggcgtgagccaccaaccccagccttaattgacattttttttttttttttttgagacacagtcttactctgtcacccaggctggagtgcagtggagcaatctcggctcactgcaaactccgcctcacgggttcacgcggttctcctgcctcagcctcccgagtagctgggactacaggtgcccaccaccacgcccggctaattttttgtatttttagtagagacagggtttcaccgtgttagccaggatggtctcgatctcctgacctcgtgatctgcccgtctcggcctcccaaagtgctgggattacaggcgtgagccactgcgcgcggccttaattgacttttaaactaatcactcctctgtttttctttataaatttaatcacacatttgtatttgtaaacatcatgttttattttgcatatttttgaaatttatatacatggaatgagtctgttgatagtattctttattttgttttctttaccaaggcagctgaagatgcaagggaatagaagatgagttcacaaagaaaaaataaagagataataaataaacatcattaatgaagggcatatagagaaacaactcttacttgcaaaatgcctagcacatatgactcccactacctgatacgtccctttctcctttctctgcctggtggagacttgcccagatattgcctcttctttcctgaatgaatctttctaatttttcttggttgtgtttcttgctatccctaactgccatattttattttattttattttgtttcatttgttgagacggaatctcgctctgtcaccaggctggagtacagtggcacagtctcggctcactgcaacctccgcctcctgggatcaagcaatgctcctgcctcagcctcccgagtagctgggattacaggtacgcaccaccacatccagctaatatttgtatttttagtagatacagggtttcaccatgtcggccaggatggtcttgagctcctgacttcatgatccgcctgcctgggcctcccaaagtgctgagattacaggcatgaaccaccgtgccaagcccatattttatttttttttatctgaatcccatgtatctattttactaagtagcccagccagataagagtaagccttactaacaagaattctgtaaaaagtcttcctacctttgctttcagaaccatggacccaattaccaattttctgtttgtaacgatacttacatgggttaataaaaaatacaatattcacagaatgattgggagtggaataagaatcacatattattccccaaaaagagttagacaaatttaagttatattgaaaacaagcaataaacaatacaggtggatctgataaaaatcttaatccaggttcactagaaaatttgatgaaaacatgatctgggtgagaacttgctcttgttctccattgtttactggccttcctctgtctggccacatcctgcaacatagaagtcacttccttgaatcagagtttcagacaagtcttaagtcgaacctttgatagcttcaagttctccttattagcttgtatgagctgtatacatttttaagtcttaaaatattcttggttctctgcttttatgctataaggcatctcagctgtgaatcaacaatggagaaatagctgctgggtttaattggacccaatagtcttttctgatggcaaaaatgtaatgagttccatgatgtttgctgtgatagagcactcctttctgttccatttccatgtggccttgtgccagcataatgaatgcctcacacatagtagtttctcaatttgtgtgtgcagattcaataacaaatgaatgctcaaatgaaatctcaataagataaatggcgtgtttgaacttctcatgtaacacatatatagttaacacaaaattattttaatgataactattcagatagtgtaggcacattttgaattatccagaaaattgactttttaattcctataagtgagtgttggctattgcctaaatttgagaatttcaggaattctgtggatagcaaatgattagaaattaagatccataaatcactttttttgtgggaaatggggaccagttctggtagctgaataaagaaaattccaacagattctgtcagtttcccagatttcttaagaatctgaaatgaacttgcaagtttgaatgaaaatgtccccaaagtagtgaaaataaaagctctcatgggcatcctggtttggaaaaatattataaacattttatgtagctcaatttaactttcctacattatcgtcattctgcaaatgcaccgttacataggccactgttctgtatggtgtttcaggtagttctgtttcacagtgggtggatatgactacacagttccacattaatatatttagacctaatgtagggaatatggaggtctgcgctatatatggctcgtaaatcaataacaaatgagtccacatttatgcactatttacagtgaagttttgtatattctgcatccaaataattgcacttattatgttccatattttaaagaaaaatcacatcttttctgctgtagaaaatggctaagtagataacggatttctgaactaaacataatatgtagcctcaaagttaaagcaatacgcttgcattgcactcggataaccactaggacctcagagcatgagagttctaatcaattttgtttcatatgatttgttcatcattaatctaaaaatgtattactacccaacacttacataaccataccataaatatgaaaaagtaaaatcactacatctaacaattgatggaaatatatatgtgtatccaagctttaaatcaatatagattctctacaagcaaattcaaatattttcttttgcatctttctagtattaaaatacgttttacacaagatttgaatatattttcctttcttagccacgtagttggtattttgcaaggtcagtcagcctagctgagagtcgaattagtttgagcagatcatacttggacgatccaatgcacttgtaattctgctccttgagcttagagcctcttttaatattatcatttttatatattataattgtacatcttttcattttaaatgtaatggcattagcagtgggatactagatacgtgaagccaaatgataagtgtgcttaacatcatttgcagaatttgtagatgtttagagaggctagggaagaattatatttatattcagagaagtagatctatatttggcctgaattttcaacatttgagatttaaagaaatgttgagcctacaccttaatcatgagagttgtccgtgatctagcatctctgaaggaacgtctacaggctctgtggggaaaaatttctctggcagggtcagggaaagaaaaggcttcaactcctttcagttaatgcccaaggtgcccatagacaattctagaagcacaagagtggaaagaggtcactgggtaatgagtaaaactgttctaaggggcatgtctcattaggtgatgtctaggcagaatgtataaaaagataaaaagtccttgaattatctcatgcttttctggcttttttcttgcctcttttcccttcttcttttcctttcttcttttcctattttttcctttctactataaaaacttcaaaacagcccacttctatctttcctgtccctcaggaaaccaaataactcattggatgtttgagttgaatttgatctaaaccatctcttgatttccagggtgacaatattcttctttctttcttggatattgtggtttactgaagaaaattaatctcaataaacgcccctggatttaaactatttttatcacagtctacttctattcagtttatgttctttccacctgcaactaaaattatgcaaaccttaggcatttgtttttgtgatacaatttatctccgaatacctattttgtatgtttttccccccatttttctattcaattcagtaatccacaatgggatacagtctcctgggtcccacaggtttgtctcaagtattgttttgttcttccaaaaataacatctttaaaaatcatatttacattttgattacttctgtcttgtagaataaaagatttcaggattgtgtccaccgtacaaaaatcagaaatttatttttagtaagagccatctgtcagtcagaatctgacctagctaactgggtggatggccgaggtcattttaatgtagttggctagtaaaaccctctctactctctaaagaggcctaggttggaatggactctccatgattgggataaagattaaaatggagtgtttggagattctgagtgctaaatcaatatttctgcacaatgtatttcaatatatttcaggacttctgtgtagatattatttcagtttcaaagtgcatttatttttttttattttattaacctacttttccaaataaactatttgtttctgaatatttatatatatatttcatttatataatataaatataaatatatatttcattttccccaaaacatatacttaccactcatcttggaacaattttgagaacatttgccagaattttccagaatcccttcttattttatttatttatttgtattttttttttttaccatggtctacctccctccatatattcctttatgtgtcttgccaaacagggaaggagaatgctgttgttcttcacatgatttgagctttagcattggagggagttggcattctatgctgttatatttcctgtgttatatacaatactctgttattgcccaaagaatcattattgattttaaatgaactgtaaatcatcaatcgatctgaaaatagcacagacttagttacaatcatgaaaataacacatctttaaaaaaaactaagatcagttttatgttaattgtattttatttaagaattatagtgtattattaaataagcaaaggaaaaataaaagtagacctgactgtatctagattttgaagaaagatgttggcatttatatccaggtagaagtgtattgctcaatctgatgctgcttctcatctctacttatcactgtaaccagagggccaggtttaagacttaactgccaccagcttaggtgtgggtaactcacttgtgttctctggagcttagatccctaacctgtaaatttggcttgaaacatatgcctgagcacgagcgcgcacgcgcgcgcgcgcgcacacacacacacacacacacacacacgtacttacatataaacaaatatgtatatgctatatatttgtgtgaagatacatatataatttatttttctgcagactggatgtcaaaaaaagcacatatttgaaatattttgaacttttggataacaaatttacatgatgatgtgattctaatatattgggtatgttttctagctgttcttagcttgctgggttcaggtttctaacaggtcacctggcaatgcagtgattagaagaaacttcatggaagagatggggctagtgtcttaaagggagaagatatgaattggtagaacagaggaaattcagttcaaacatagaaaaaggaagccctgcattaaaatttgttacagtacatcttgaggatgagaagagacctatttcaatgaatgaagtggttttcatttggaaataggcagaaaaaaatatagagtgcagaggcctttaggatcagtctgtgttaactattagttttcgggaggcagagccagccattgagtggtttggacaggatggtataatgatgaaattgaagtttgggaatgattattctggcagtgaatggtatacagtcaagatctgggagaccaagattgacagactgaaaatcagtgggaaacagttgtagtgatctaaataggaagtgacaagagcctatatcacaatagtgacaagaaaaatgaaaaagaatgagtatatctgagatagatggcaaatgagtaactgacagtatttgatcatacttccagtcctcccaataccccaaaatatcacatatatttttggccagggagttggagctaatgatgttgtcacagtttgacagcagacatgaaaagtagaagtcacagagaagctgaagaatttagttttcaactaaatttatgattttttatgttgggaaattaaaaatatcctaaaggcactctaaattgaaaggtgacccacgtgaaatatcaggtgagttgatattgattaggaagctgtctctacacaggtggttgttgaaaccgaaaacggaatcagctctcactgaaatgtgtttcccattaggctatctactcctcaggataaacctagtcatttgtactggtttcagatacagtaaaatatcaacttcacctttatttttctctcttttgcctttaagtacaaatgtaaattttttcttctttagttacaagaacaaatttagagtaggttgtcaatgtctattgccaagtaattgcaatattcacccaaagaatcttgtaatattttatgctcattagcaattccatttgatatccaaaatttcaacaaaaggaaaattatacacttgtttatccaagctgaaggcttttgaagatactgcagaattcatagctgctatggaaaataaagcagcataactaactcctggtatttattttctcaaaaaagagatttgattttttttatttcttttttgtgtgactgtaattattatcattattttttacttttggagaggcaagcattttgtgctatgaattgaacgtagagttgtacacagaaaaatatttgttttcatgtttcctttccctaaaatgtctgctagagtacagatgaagattctacctagaatgaagataatcttttttgaaacaattggttaagattaaattgatttggtttaaataagactatatatggagaatctaataaacattgagacaagtagatacaacaatagtttaaagaagaaaaactgaatacatcctattcagtacaaccttagataaaatctcatgaatgaaattacttggcgagtagggctacaaaaaatagggaaatcataggcgcacatgctctagcaactatggctacgcatacactgccgcttcccaaaattttctatcaattttaaacaaaggtagagaataaaattatggatactatcttagcaagttttcttattttttttaaagtaagattgctagtgctgcatgaactatttgttttccccaaacacttgagttgcaaagaattttatttcatggaataatagaatccattaactatgatcctagagaaagagaaagttttcaattagttaatataattatatttgttacaagtcaatcagcaacaactcagtatttgaaaatccatgttttagtttcaactgaaccactacctagtcatgaaattgaggaaacgaatttatcactaaggacctcagttggcactgtaatattcattcagatagattattttaaaaacaaaatcaggtcatacatataaaatgactgtgaagactctaactgctttgtgaatgtgttgctaagatcattctagttttattatttgtctcatggaggattccattatacatattttacttttaagtgagtgataaaatgttaagcttcctaatgatttctgtggtctctagcatagagatttgttacaaaaagggatgccatattatctatgtaatcattttacataatacatggagttgtactggattaatctcaaccatttttaatttaactattactttgtagttgaacttgagcttcctctattcaaagattccagtaatcattcttcttcagcaaacacacacacacacacacacacacacacacacacacacacacacacacacatcttctggattgtatactaaaaatttatatattttggattgaaattaatttgtaaccaacaaagtttattatttagagactgtgattctgcccagattaagatttgtggcgttatgtttaaaaggaagacaataatacctaaattagatggtcagtgttaggattaaatgagataagggtcagaaagtgagtaatataatgcccaacttatagcaggtgttaaattattgtatgcattctaccgtcctccacaagcacacacggcccctcataacacaaaataagcactgaatataaaagcctcagaaagattaagtggtaggaaaagttacttttactctttggtaaccccagacagagagttggtttggggtttagttaggaaagcatcacaggtgagaaacacaagtttgaggcagttttatggcagagtgtggaggtttagtctgagtttgcggcttttctttcctcattcatatctcgtcaattaattttcccctttaaggaccctttcaagcctgagagaagagtacagaataaatcaaaagaaagagtggagagacaaaaatgaatgcagaaagagggatgcaggaaacaaaaacccagcaagtagaagggaatagtgagaataaagaaaacgagaaaaagaaaacaaacaaacatgcacacaaacaaaaaaccaccaagagagggtgatccatacctcacagtgctaattaagttctaagctggtttgacatttttgcctcctggacaccaacaccctccaagcggggcctctttgatttggtctcacatcagtagcgggctttgttatgagatctaggtattaaccccacatgtggaaagataggttaatttgactaaatatattttttaaattctccgcaccattgagtcatctaagtgtcacatctagtatctgccacctaatgttatgcttagcttctcctccttcaagtagagaaatccagataaccaacccctcccctcttcccctctacacacatgtacacacacatgcacacacacaggaaggcatgcatgcacagcacatattaaacacacaaatgaataaatagtagagtccgtggatgatttagagacatgtgaaaagtgaaagttttgggggctcaagtaatttaggagagttttctattaacatgtagtttaatgttgtctttccagttaatgtagttatataatatgtaaattaaagatggtgtctactgcctaagtaattattacaacaaataggaccgattattgaaggtgaactccttccttttctgttctctactcaaaacaatacttttaaaattgcttatttagtattgaagtaggaaaaaaataacgttgatacaataaaagaacttatttctgactggtaggtgatgataggatctgacaagggggtgtacttcagagagattgtcaggattctacacccttgtctgtgcctaggaaaacagcccaacctacctacctttagttttgaatggaggctgcaggatgttactcatcattgcttttagaacaaacacttccctttgaacgatgtcacatcactattaccatggcaacagacgccctataaagatgagttatctatgaattgtgcttctgttcaataaacacatctcttaaattcatcaggaaaaaggtttagtggaggcagttctatatattgacatttcttattctaaacctctgtctgataataaatattcatttcattaaagtgtttaattcaggtgtctttcatattagctatatcacataaatttataacagttttatgaatttaaaacagttgctttattataaaaatgatgtatttacataataaatgagattattcttatgctaaaaagcataaaaagaaaaaagaactctattctcagtgtctaaacatacagtgaacaattaatttataaaaaattaagtttatcaactttataaacaaataattttataaactttataagtatagagtcaagaattagcttaatggaccaaaaaaaacccaaaaaacttgtttcaagttaatgacttttagaggaatgcaattaagtgggtagaaattatagctccatatattttatttattttattttttatttttttgagacagagtcttgctctgtcccccgggctggagtgcagtggtgcgatctcagctcactgcaacctctgcctcccgtgttcaaacgattcttctgcctcatcctccagagtagctgggattacaggcgcccgccaacacgcccggctaattttcgtatttttagtagatacggggtttcaccaggttggccagactagtctcaaactcctgaccttgggtgattcacccacatcgacctcccaaaatgctgggattacaggcgtgagccactgagcctggtttttccaccaaagtagcaccctctgggaatgaggtaatgataacacaccgacagcaaattatttcgtagaatcatctcctcctgtctaaactgcaatctacaaaaatactttacataatagataaacctaagaggaaaatataaagtccaaaagggtaaatttctaaaacgaaattgtaaataaaagaatggaaatgattggatgccagaagaaaggcaatgagaataatttgtcagcaaggagaatgatttgattataggtaccagtgtcatggctttataaagatggttatgatttcaataggtcgcaaaaattacaatgtatatgattatatatcttaaaataatatgtaattttatgtaattatacaaaaaacgttcagcttctattctggacccttgaagaacataatattaatattttatggtgatctattcataaagaagttgatgcacctttgtagttattcttcgtcccaggttgcagaatgcaagctcccactgtcaattacacaaatactattggtttcacagtttgtgagtgtgtgtaatttttaagcaatttcttagaacctataaaatatatatatatttttttttttccttttttttttttttttttttagacagagtcttgctctgtcacccaggctggagtgcagtggtgcgatctcggctcacctccgcctcccgggttcacgccattctcctgcctcagcctcccgagtagctgggactacaggcgcccatcaccgcgcccggctaattttttgtattttcagtagagacagggtttcactgtgttagccagaatggtctcgatcctgacctcgtgatccgcccgcctcggcctcccaaagtgctggtaccacaggcatgagccaccgcgcccggcccccagaacctggtatattaatgaaaattttttttttcaaatctcagaggtaaagactagataagaaattgagtgaccaaaatcatatacttctcctaacctgaaactgccagccagtagtaaatggtttatcaactcattccagcaagtaaaatacatcagttaatactcttgcaacgtaaattggtatattgtagctcatttggtatatctcccaatattcctaattttcattttttagttcttgttaatcagtcctcaccagtcctaatcaacattttatttacattttacttattcgtaacattagaagaaatgtttgggtaatatctgtgcatacaggatatattttccaaggcaatgtagcatactggctctagaaacagatctggagtttaatgccatgtcaatcactatgtgaccttttgcaagttactcactgtcttttatcttcagtttcctgaatacaatgaaaccatctactgcgcagtgtttttgtgacaattgaactcaataatactgtaaagcacttagaacaatttttaggacataataattgttcagtaaatgtattccacctcctcatcatcatcattggaattattgcagttattttcaaccattattcagatcctattgaaaggttgaaggcttgtagaaatatatacggaatgattttcactgtcgctcggagtagcagatttatgaaattaattatccttagctccttgtgctaatactgtattatccctttagtcattttagcctggaattacactcttaaatataaccaagatccagtgggctacatcataaggaaaaagtagaagtggtgttgaggggcgtctcctgtagacaagaacaagtaagctaatttacttgaatttgactttgaatagaggtgaaaacttcaccaagaatttattgtaagtgtcccagtttaatagtgccctcagaagcctgtctaaagcaaacacaaatcttctctggaggaaagcaccttcaatctaaacttcaaagcatgcctatatataaagctcaacttactaggagtaaaacaatcaataataaaaaataatgataacttaaaaacataaagaaaagcaaaaaattgagttagtcaaagcaacagtcacaagactccaaccaagattcctagtgggtgcttcataaaaattgacaagctgaatctaagacctaaatggaagagccagaggctaagaattagaaaaaaaaaaaaaaaaaaaactccagtgaaacaaaaatttaaaaagtagaaaaagaaggagagttttctggatagtaaagtgtttgtgaagaaaaggtaaattaagggcatgtattcattttggatatagatgattttatgttttgtatgtgaatgcatatagagggatatatatgtatgtgtgtgtgtgtattatatatatatatatatatatctgtgcatgtgtatacacaaacatacactcatactcacattaggttggtcacagtggctcatgcctgtaatcccagcactttgggaggccgaggctggcggatcataaggttaagagattgagaccatcctggccaacatggtgaaaccccatctctactaaaaatacagaaattagctgggcgtggtggcacacacctgtaatcccagctactcgggaggttgaggcaggagaatcgcttgaacctgggaggcagaagttgcagtgagctgagatcacgccactgcactccagcccggtgacagagcaagactgtctcaaaaaaaaaaaattgtcataatttaaacatgaaatattttctcaacagcagatacaggagaataatagaccttgattgaataaatagatatcatggaatattatacatactcatggtcgagaaataaaaaaccttccaacagtgacattacttaatgtccataaacatttaaattattaaaagtgtttctcatttactatctcttcaatacaatatattttatttgcactggaaattttaaaaaaatatttttaaggccgggtgcggtggctcacgcctgtaatcccagcactttgggaggccgaggcaggcggatcatgaggtcaggagatggagaccatcctggctaacacggtgaaaccccgtctctactaaaaatacaaaaaattagccgggcatggtggcgggcgcctgtagtctcagctactcggggggctgaggcaggagaatggcatgaacctgggaggcggaacttgcagtgagccaagatcgcgccactgcactccagcctgggcaacagagcaagactccgtctaaaaaaaaatatatatatatatatatatatatatatatatatatatatatatatacatatatatatatttaagcacagagttgtgaatagcatgcattattgcatattgatacacattcattgttacataattttacagttaaataagtgagggtcagatattgccaaaggaagagttcaagagctggtttctaacacaggtcttatttttaaagcttgtttgtgtgtgtgtgtgcgtgtgtgtgtgtgtaatttttttggtttcctagtaatcgggagttttggaaaattatgatctcagtatgttcttaaaaatagtttatagataattccaagaataaaaaaagtttttaaatataataaggaatcttaaccaggtaaatgtatgtcttattttttacaaaaacagttaaaagttaaaaaagaaaaatagaaaaaaattataaaatagggatataaagaaaatatttttgtacagctgtacaacgtgtttgtgttttgagttagatttattacaagagagtctgaaagttaaagaatttaaaagttcataaagttaccgtaagctaaggttagttggatattgaagaaaaatgttttctacacaacgagtataatctaattgtatagtgtttataaagtctatagtagtgcagggtaatgtcctcagccttcacattcacccaccacccactcactgactcacccagagcaacttctagtcatgtaagctccgttcatagtaagtgcactatacaagtgtaccatttcttataatctttaatgccatatttttactgtactatttttatgtttatatatctttagatacacaaataccattgtgttacaatgaactatagtaacatgctgtacaagtttgttacctgggagcaataggctgtaccatatagtctaggtgcgtagtggtgtgtaccatttaggtttggttaagtatgctatatgatgttcacataatgaaattcacctaacaccacatttctcagaatattttcccactgttaagtgacacatgaccgcagtcatgcccaccaaaattcaggacataaaattgttattgccagttagaaaatattatattggaaaagtctgaatgctgtctaaaactaagaattacaaaataaatagcattcaggatctacctcctttaggtgtgagattttgttttaaacttttttgtttatattcatcagatttgcaggataacataaatactcaattatcctgagtcgtttatattcacaaaagagttggtgaatctttttcataaggatgaaaataggaatagacaaaaaagacattatactaaaacaaaaatctctgaaaccgtatcagaaagaaagaaaagaaagaaagaaagaaaaagaagaaatacatgtctgctttgaaagcacacttgttttgacttttggaaggtagaagctttgttaagaactgagttgtcttattgctacaccccatgattagagattaattgtggcatatttcttcttgaccccttgctaaagattcttcagtctgcaagttggagcattacgtctttcctccaacccttacatattcttatttttaaggtatagtttttaaaatatagttattttctgttttctttactcttggttcaaaaagcataatttagaaattgatcgtgctgataagaatacaatggcaaaagataaaaaagcttttattatagcattataataatgtgtgttatgtacgaaaaagagcaagactaggtttttttgttctttctgattttgccaggttaccttacaaatggtagtaattatcctcttttcttaactttaggcttttatgatcttgcaaagatatgacaaaaatgggaaagtaactgctaattgctattttttttttgcaatgttggaaagtacactgtgacaatgtttaaaaaaataaaacagagagtggaaaaaaatcaccatcatcaagcagcctttattaaccacttatttataaggtgatgccacggcagacaggcaggctgggagggaggatgtaagatgcattagtcacctgtgctatgtcctgtgtacttattctatcccaatgaatgtccacagcaattctaagaaatttgaataatgataccaattgagagatgaggaaagtcagctcagaggtatagcaaaatttcttatgtgatacacctaccagtggtaagtggtagaattggatttgacccagatgggtctgatttctgaacacatgctctttccttcatatttcctgtcatgatggaatgcttacttttttgaaagatgcaattcccagataacttttcagaatatagagaaaagataatcccatgaagcttttattttgagacagggtctcgctctgccatccaagctggagtgcagtggtgcgatcttggctcactgcagcctccacctcgacaggttcaggtgatcctcctacctcaccctcctgccatggagcttccttaaataataacagagtgatgaaataatctgtacaaaaaaaacccatgacacaaattacctattaacaaacctgcacacgtaccccaaacttaaaataaaagttaaaaaattaaaaattgatatagaatctgtctatacaatttaatctgtctatacaagttaaatagattttaatcttcataaaaatatgcctttcaaatgtaagattgcatgtttttctttgtatcagttagtagtacattcattacaaggaaaccaaaaatgtacccaacccacagcagtcttttttttttttttttttttttttttttttttttttgagacagagtttcgctgtgtcgcccaggctggagtgcagtggcacgatctcagctcactgcaaactccgcctcccaggttcactctattctcctgcctcagcctcccgagtagctgggactacaggcacccgccaccgcgcccggctaattttttgtatttttagtagagacggggtttcaccgtgttagccaggatggtctcgatctcctgacctcgtgatccgcctgcctcggcctcccaaagtgctgggattacaggcgtgagcaacagcgcccagccaccacagcagtcttaaacaagataaaaatctgctttgctctaagaaatgtagagataatcatgctagggttgttttaaagcaaaaaaataaaaagttatctgagacacaggtgccttccatctcttcttataggttctagagtctggaagaagggattagggtgggattggttctggctgctacagcattaacttcattaggagaaactctgggtggattgggtaagtcaccatcaggctattggccagtcatgaaataacagatatcatagaaaatcagagtgcccatggaagtctgttttcggaactttacgatgataaatgtgacagatctgggagcaagtttaattgccaggacaatctggagagctggaggcatattcttttgggagagccaagagaggtgcttgacagatggtactttgcctcaagcctgaaagaatcgaaaggttcctgtctcattttttcacatctgttcttggctccctaagtattactcttctatgtattcccctcacctagatgccaagtgttttctctaagaaaacattgcatcttttccagctgtactgtaacttcactctgtgacttgaatttaacacaattttattgcatatgaaaatgaagaggtctggagatttctctcttatgcatgaattgccaaaatgacatttctaaacctagaataatagttttctttagagaatgagattcgctaggacccacattctcttcaattaaatcttaatacgtataagtcatgatctcattgaaataagtcattgattcattttttccatattaaaagataacaaaaacggattatgatagactagaatgcaaattctaagttgtttcagtgccaaacaatgattggtacttaattttattaggaatgttatactaatgcccagttgattctgacaagcatgtctggatttatttgtaaataggttagttaatggagacatttaaaagattcctgaaggtacccaagaaataaaaacgctaagaaatgaaatcattgcaaacatatgtctcgtagttgacaaactcttcttttaaaatggcaaagtgcaatgtcctcctaaggaagctatgcttatctcttcctagactgatctacaacttaatgctaatatctttaatttctttaacaaacagtttaggtaagttacatttgagagtcaaaagtgagggcagaggagggacttggtgatcaattttccccacagcaaactgagaaaagaaaatgaacatgagatagttgacattcagaatgttctaaaaaattcagaatatatgattgccataaagtctggggaagagaggcttacgcagcatcctcaagtacagatactgtactaacacaggtaatgagtgaatggtgttcagatcatgggcacttggtacttaaagaagcgcagtgagacggaaataaggaaaagcaggcaagagcccagctccacgtgcttcatttacaatcttgcttagagtcagccctgtttaaaatggaggtgtggagagacagagagagacccaaaccgatctgtaagggacattaaaggttaatagaactgcgggtcaatgttcagagatttttcaacaagtctgagaagtgttaagaaaagaaaaaaagactaatggctaaaaccaaatatcatttctctagatttagcccactcttcagaggtcttgctttgtttcaaatttttgaatccgttaattttaaacatttggatcataccttgaattttttccgtcaaattgtatcaccacatctagtcagacacgcggcttgctcttttctttctttagtcttacgcacgtgaggaatttccactgctacaaaccctccatcccttcaggctttctttctttcctcccttcctcccctcccctcccctcccctcctccctccctccctccctccctcccttcctccctcccttccttccttccttcctcttgctttaatgtgtgtatttattattcaagagttataagtagatattaattatatcagatttatttagctatgtcataaatttcatttattgaaaaaaactgtgtgaaatcaggactctgtaggtatacctggaatgcatagtcattttaaaaccaaactctctattttgttaggactacgctaccacaaaagcttctcacctgctcctcctaccttccttctcttcattcaaccattcactgctgcctaatgaaacgctcttaaaacagaagttttgtttgtttctgttttttgttttgttttgtttgtttttgagacagggtctcactctgttttttgtgctggtgtacagtgccatgattttggctcacttgcagcttcgacctcccaggctcaggtgatcttcccacctcacctgcccaagtagctgggatttcaggcacgtgccaccacgcctggctagttttttgtggagacggggtttctccacgttgcccaggctagcctcaaactcctgggctcaagcaatcctcctccttggcctaccaaactgttgggattacgggtgtgggccaccacgctagggcacaacagaagtttttgagcttttagagacagtagtgttttctcaagggaaatcttattagggacatggaaacagagatttcaatttgaacagctgtgcactggcacagcagaaaagactgaagccacacctatttgaaatcgctaaagttaccacccatttttcagcagtttggggccatttcccaagtctgcattttaattactatcacccaacaacagttccttccttgaataattcttaggttaaaccttttttcacatgtaccctataaatatgtacaaatataatgtatcaatttttaaaagttactgaaaactccttaacatctcactattgccttcatgatcctcagtctcctttgattatattaaaagattatattgaaaatgagtaggaaatcaagtagaaatatataaagagcattgcaaaaagctaatttagtttttaacttgtctaattgaaaaccgaacctttctcttactgctcttttagtagtaataataatgtgtatggttcatgagaaaggctataaaatataactaagttttacattatccttacatcagaactctgtgtaacactgatgcaggagttttctcagccaatttgccaactggggacctccacggccagtgacacacacacccccacctgctaccagggccacagttggccttggaactgtcattggaggtgccctgcccacttggcctgcgtgtgctacagcttgtacccatgttcggcgattcccaagctcttgtcccccatccaagaagaatgaggatatgctgacaattcgaagggtgaagatgggtggagaggaattttattgagcaagggaatagctctcagcagagaaggcacgtgggggtggtctccaacccctgaagtcgggtggtttctttctcagtgtggctgagttcaggacttctatgggctcagaataggggagtgtgctgactggtttgagtatgcaaaaaaggttaaaacaaaagcaccacttaaaggtgggcatgacagtataaaaaacaaattagggaaaggtaggtatatgtaaaatcagtgatgggtagggatcaatcagaagaaagcgcatcaaatgggaagacaggttctcaatccagtccatagatttgacttgtagcttggctttcaggctttaaactgcctttggtttggaggggggatttcactggggacctgcccctacctgcctaggcatttgtctgcctcctgccactatcaacacctcacaagtttcaataatcatttgttgtttttttaactcaacaaatatttattgaacagctactatattttatatatctcagacactgttttaatcactaggaaaaaatatggcagtgaataatataaacctgtctatcctcatgaagcttatattccaaaggaagaaaaaggcaatatacaagataaattagaaaaatgtatactatgctaagtattggtaagttgtaaaataaaaaacaatcacagaatggaaacacaaagtgtaaagactgtgggtttggataaaatggtctaaacatgttttcccgcgacataacttttgagtaaaggctgataaatgtttgttgagtgaaacaggtatgaacaaaaaacagtaagacatttaagtgtagaattcaatttaacattttatttatggagtacctgctatatgtaaggttctgtagtacccaatgggaaaatactaagataaaggtgtatctgcacttaaaatatcgtatatatttgttaatacataattgattaggtaaaaataagttcatatttttagagttctctttaaattatctttaaattcccaaagtaacactggaattttaagtagtttattcaccttactagacctcagtatccactttaaaatgaagattttcaatgagcaataagattctatatctatcatgggaatgtagtactgataaatggcgaagcagataattttttctcactttgtaatggtgactttactgtctaaaatctaagccaattatgtaattataccaatggaaaaatatgctatatgtatttgtagatatttatctataaatatgctttttatttctctcaatcttttaaaaaattatattctttctagagtgcatattatatgaaaaaggcataaagatttttgcaaagcccccccaaaaaaaacaaaacaacaagcaaacaaaaaacccaaagatgagaaattataaggctgttatatgaaaataaagtttccatgtacaactaaatcattctagctacaagaacacttcagtggcattcagagcatagaatttcatcacagaatggaatcttgtattgccccttttatcccacacccgtgtgagctttggagggttgggttctgctcacttctctggtataataacataacaatgctcatgggaagtgtatcatcatgtttttcttctttttaacaaaaaaaaaacaacatgatcccaaagtaagggaaaatcagaaagtaagttttattgcctttaatatattgtatttttttttcttatggggacttttgcaactcagattagggcgttttggaattattatctgagctgcagtgtcaagagactgactccccaaagattaactccccaaagggtacaatggtgactcacatgaaggatgcacacgaaaggctttgtcacttcggtaattggagagcgtttttagagaggatgccaggcacccatcagagcattcctactctcttacaaacccagtgctgttagtgaatcttctatggattcagaagctgagatgaaactaatgtctcatatctgtggatacaaaagaagtaaagaaaatattgatttttgattttgaattagaaattgtggggtcatcctctgcctactttgtgaaacaaaatttctcacaatttccagaaaaaggtaattcatcttctattatgtgtctgcttgtgagaatttctatataagcctgcagaaagtgatacctccctgaaactctgtatccttgatctaaagatatgaggatgcaaaaatggttgtgactgttggaaaaataagagaagcctattgtcttgttttattttctggattccaagatggtaaaactgctctgattttctataattaagaaacgcaatgtctctagaaagatggtgattggaacgtgagtaaaaacaaacaaacaaacaaaacttattttgcgagttttcatccttgtgcacacaatggtgcactgccaaatggaaatgtttgctaagaccaaatacatataaaaggttgagagaagaggggggcaggaggagagagagggggagagagagagagagagacagagagagagagaaagcatgagtaactaatacgatttccacaatgtaaaaatagaatttgacaagccaacattcacttggcaaatactgtgcccttcctcatgttcatcttgctcataaaaatgtctttgggaaactattttattgaggttaggcatcacaaatcaatccacgttttaaacatttggagtttcatcttagttccttggttcttccttggagttgttattctaaacatcaatttgtaaatcttttcatatcttcttaagcaggtgtcaaaccaactcctttggcagaattctaaaagcaacttgtacgcaactctaagacagatgaatgtatacaaaattcaggcttcatctctgcacagagataagtgtgaactaaggttcatgcttctttcatcttgctttggtttctcagttgctttatctgtttttaaataaactgtgttgtgtatattgaagctatacaacatgatgttatatgatatgcatatacagtaaagtgtatattataggggagcaaattaaaatatccatcatcttaaacattttttccttttgtggcaaaagcagctaaaatctactcatttaacaaaaatcctgaatgcaataaaatattattaaatattttctgaatttttatttgaagtagtctacaaatatttactaggtctttatttcttctgagtaaacaacaccaaacaagatgagatttgtgatgtaatgaatacttgagtaatctaagcgcaatttaaggataagtctataatccaggcagacatatctaaataataacccttggaaataaagtagtaaaaggaagcacacgctttctaacttactttccttgacatgaactcagtttgagatcagtattgaacatgacattttctttttatttatatacctccgtttatccacaagtattaagtcaaaattgattttagcaacagaataaagctctgtaggttctgttcaatgatgtcaaatctatccctgacaagtgtcccatttttgctcttcctgaatagcatggcttcaaaaaaatctagaaaatgaaaaattctatagcgcagaaggttaatagtggtgaatctctaaaataagtagattgttttggagtcatgtttgtgtcttgaatcactttaaaaattttgaaaacaaaatttgatagattttgaaaaaggttatgtttgcatttctgttgttaaggtgatgtttcctggagtgatctaaaaagaacctatgaggaggtgaaataagagaactagaaaacagaagacagcatgtttctaatcccagaaattaggtttctgggacaggtaaggaaaataaagagcccaggtgtacaaaatcaataaagagcaagaattattaaaggtagttaagagagcctcactttctcatctagcatctcaagccacccactgtctctgggtgtgttcttggtaaaaacagacacttaaaagtttattactaagaaaaaggaaagagaataagataaaaatacagtcttttgaaaaaaatctgcccaattttattgacaaaattcaccatgcatttcaatatagaatgaggaaacattaaattaggtattatttgcaaaagaaaaatgctttgtatgagggagaaaataaccatacatattgagtacagtgtaccctgcttgagtgataggtgcactcatatctcagatgtcaccactatacagttcatccatgtaaccaaaaaccatttgtatccccaaatctattgaagtaaataaaaaatttaaaaaataaaaatgcaggccggaaacagtggctcacgcctgtaatgccagtacttttgggaggccgaggcgggcggatcacaaggtcaggagatcgagaccatcctggctaacacggtgaaacgctgtctgtactaaaaatacaaaaaattagctgggcatggtggcgggcacctgtagtcccagctactcaggaggctgaggcaggagaatggcatgaatccgggaggcggagtttgtagtgagcagagatcgcaccactgcactccagcctgggccacagagcgagactctatgtctcaaaaaaaataaataaataaaaataaataaataaataaaaataaaaatgctttgtatgtagtaaaatactaaaagttatgaaaatattgaataataatattttaagaagtgaaaaataaaagtttccctgaaagcataaagaatattatctttaaaattctgttacaaaatgtttacttataatttttttcaatgaaatgaagtagcattgataccctgcttacagaacagcatgagacttgaatctgaaaggcaaataaccaacagttaggagggtatagtactgtgtgatatatgtatgactgctatagattcatttatactgactgaaacacatgttctaattaacctgagtgggggtcttaaaggattcctggtcaactgttatactgcaatgcatttttctcactttatatttaagtataccccctttaaaagatggaatgctttaaaatacatttactacataggcaatttgattaatatttgtttttattttcccttcacaaataattcgatgagctagcttatgaaggcaatgcatctgcacatttaggaatatgttccaaatctagtctatgtttccatgggcatttaccaactgcatataacactcacagcaaaagctaaacaagattagtgattcccaactaccagaggataaaatcaatttatcatccattctagcagaagccatggagttttataagtgattaaattgaaggaggcgctttgggcaatgtagaaatagagcatttcttgataaaatgatgagtgaggttgtcaaatctgtgataagcctgtgatgccggctaggcaggtcagctcctctgggaccctagttacaatggcattttcttatgtttgacatgtatctggatccaagggagagaacagatttcccaaaacaaccctttattgttttctcatttccatgtcgagtaagtaaagcatacattacatatttgtgtgttttcttcgaattaaggtttgttctagctgaccacagaatagagacaataaaaattcatgatgtgggggagagttaactggattatgtcaggggaattgtttgtgtctagcccttgcctctgataattagttaccctctgaccttaggtgaatcactttcatctcctcgttttcagtttcctcccctgcaaaataatgaaggcaagcagaatcaaatggaaagttcttgccacctctaacaggtcatttttttttttttttttttttgccttcgtaaagcactacagtataagcattaaatttacttttgtatagtgagtattttcaggacgagaatagcatagggataaatgtatgcttggttttttgaggttgaatagtaaccttaaattttgttgttgttgttatttctatttgcattctaagaatatgcttgtgcagaagtgtagacgatggtgaagaaatgagaaagggtaaggcatgagaataaagacataggagactaaacaaggtaggcttatgggtacaagtggtaaggccaaatcaccttcttcaaaggtaggcctcaaaattcaccttgccagaatttcaaaagaaggtcaaaaaaagaggaaaatgagcagcaaagatctactcagccaaattgtgagtactggattaggacggattgtggagtgaggctccttcctacttcttatatttgctgggtctaaatagaagccccagatgtgccttgattgaggatggcaaaaaagtgtgaatgctctgttgaatgggacctcaccacagctcttccctgccctgatatgtgtctccaagtgtatttgtaacccatgcgacgtgaagaaaacatacagccttcttgggtgatgatcaagtctcctaagcctaaatggtctctagatgtggctctgagttcaggcggtgatgactttctcaaaagcccacaatacgcgtggacatgtgctgatgtccatgtggaaacatgctaaaggaaaggaaagttagaaacataagaagccctccatttacttcgtcaattccttgagtttataaaattgatcttttcagatacattcaccgatttagcaaatgatgataaatacattgaatttaatcctgtctggtttatggctattaaaaacaatgaattttaatggagaacaattgaaactaaaataaaaattacaatgaactagaataaaatagcacaaattaattctgccagtcagaagtgaaacattgtaagatatcccttgtgatcttctagaagggttttgctttccgaggctctggcaaactggttggaagctattgccttcctgattttcacttacttcatcccctaaaagccttcttttttttcccatatcaagatcaaagacgaaatccatgtctaccaggctgtttgtagattttatcacttatttcatggggattgaagaactattagatgatatttgagaataacagccaaatgagcatattagccattcaggtataacaaaaatggaagtcagcagtctatctttaattttgtcacatcctgtagacttaaatcatccaactgcagagcatctgttaatgtgttctcagttcttgagttatagttaacctaatgccactggccctactaagggggaaattcagaaacttcccattggaattgtggagtgggcattaacctcgagggaataccaaggtccacagtacatgtaatctcctttccacttcttaatgaccctgttttattgtgttcattttacaattgtgaaaactgaggctcagagtgaacaacgtgtcagtctctgctcttcttgtacatgcacctacttaccacttctacttattgaatctggtctcaggacttagtactttatctcctctgtttctaaatttgggttaaagttgtgtctattgattaaaaatcttaaacactgaaaaagtatgaatgcacttaaatttcccatttctgaaaaacatttactagttttctgattaaaacattgtttatctatctatatctgtggtttgtataatcatttttatcaagaattgaaggtaatgtattttcaaattagaaatgtatactttaccgtttactatttattaataaataagtcatattttaatatgcttcttccttccagtaaacaacacttctctttttttggagagttcaatgattttagccaacttcaggcttcttagttcctgagtctacagtgtacttcacccaaacttgtcttcataagtaaatccctcataatccatattcattctatactttctcttctccaacaaaattcttacctttctagtgttcttctatccgtcagaattaaaagaagaggtcttgtcaaattgattcttattgaatattttttgatgtgatttctcaagttctccctaaatgatttttttatttattctaacatgtatctatgattacttacttttaagtaatcatacatatgatttccatatataaacatatatatacattatatgtatgtaatttaatatataatatatttaagtaatcatatatatggtttatatataaacacatatatacaattatatatgtttattcaaacatatataaacatatattctaacatatacataaacatagaataaacatatatataattgattacttacttactaaagtactgtactggagttgaaataaagaaaaagatacatggaactcacagttagtaagagaagttaaaggtacaaagtaataaatggcatgtagtctgtgtagataaagcattaattgaattcagaagcaggaaatacatctggagatgatcttggagagcctatcaatgcaactggcattcacactgcttctaaaagaagaaggatttggaaatttaaagatgggaaaggatatctgaggaggaattatagcatgagtctgcctagaccacatcctcatttcccttcaggaactgtaatgaagaatttgggagcctccttggccatcttcaattacttcacagagagaaacatcaaaatttcctccaccataagcctgccctaatttatttttgttttgttctacagagcactccatttttagcagaaataactatagattgcaatgcttgaaaccaggttgtattttgtgaaaaatacttgttttaagataaaacaatttaattcacattacttaaaattctataagcttttccccccaaactcagagaattggatcaaattggactttagaaattttcattttcaattccgtttacaatcagtaataaaattaagcattttagattgactttttctttgatttgtttatatacactgtgaacgaaataataaaacaaagttgtataggaagaaagttgcaaaaaaaaaaaaaatcctgtcggttcagagttcatttagataaaggccctttgagtcatgttccttactttctggagaggagaactaatttttactccagtagatggttcatatatcaatttaaagagggaaaagtaacacagaaacacatttccaaaagcatgggtgctgaaaagacttagactaattttctctcaagagcactaatgtgttaatctagccaaacacagtcatagtgtaagatcaagaagtatgatctatggtgtcacatttttaaaagtacacatagcattgaagagaaatcttacctgtttcaaagcaagtcctctacattcagccttccatataatttcctgttggctgtgacttcttcatactgcatcttaaatagattatctgtactctgccaatgatctgtctattgacatgaattatgttccattctgacttgtatatatacaagctgcaatttgaaatcacttttagtctaatttatttagctgaatatatatatttatttagacagagttttgctctcttgcccaggctggagtgcagtggcgccatcttggctcactgcaatctccacatcctgggttcaagcgattctcctgcttcagcctcctgagtagctgggataacaggcatgccaccacacctggctgatttttgtatttttagtacagaccgggtttcactaatctataaaccaaatctataattccactaatctataaaccaaatccccaagccagcaccacactgtctttattattgtaatttggtagtaagttttaaattggaaactgtgagtttcacaacttttttgccccaacattttgactattttgtgtcatttgcattctatatgaattttaggattagcttcttttttttatccctccccttcctccccccacaccccgaaggccctagtgtgtgatcttcccctccctgtgcccatatattatcattgttcaactcctacttatgagtgagaacatgcggtgtttggttacctgttcctgtgttagtttgctgagaatgatcgtttccaggattagctttctaattctgcaagaatagccactggtgttgtattgaagctgtatatcaatttgaggagtattgctgttttaacactgtaactcttacaatccataaacactgaatattctttcatttctttgggtctttaaaaatttcttttagcaacattttgcagtttttagagtacaagtcttacacttttgtgtgtatgtgtgtgtaatttattcctaaatattttcttttttatatcattgtaagtaaaaatttttattaattttattttcagattgtttattgctagtgtttttttatattgaagttgtatcttgccatcttgctgaactcatttattaatttgatctttttgtgtgaattccttagaattcctaaatatcagattatgtcatctgagaataggtgttaccaaaacagattatgtcatctgagaataggtgttaccaaaacagattatgtcatctgagaataggtgttaccaacacaggggttcgggctaggtcctgcatcttgcagcacagaaagccaattactgagatgatgattattgccaaggaagaaggctttaatcaggtgctacagtcgaggagatgggagttcagtctcaaaccatctgcctgatagactaaaaattaggagtttgtatagcagggaagaaatgtaactatatatgagaaaacagaaacttagttggggggaggtaaagaagtaatcctgataaatgaggggcctggagtctcattgtctggttgctataatccggtgagtttcagttcttttctactttttgggaggcctgaagatatttttctgaggcaggaactcagataaaacaaatgtaagtttcaagctttaagaccaacagggtcaatttctatgtttatccaaagacgtgtctgtgagagtgttgggttggtttcaaagggatggctttgtttcttccttctaatttcggtacctttgatttaattttctagactattttatctggccagaaccaccaatacagtgtagaatagaagtgggctaaacagatatttatgtgttgttcctaatcttcaaagaatgcatttcatttttcaccattaattattgtgttaactatgagttgttcattgttggcctttgttagggtgaggcaatttgcctctattcttagtttgttgactatacttatcatgaaagggtgccagattttgccaaaatttttttcaatctattgagatggtcttgaggaatttttttcttaattctattgatataatatactatattcattgattttcatattctaaactaatcttgcatacttgataaatcttatttggtcctggtgtataaatttttgtatatatttttggatgatgcagtctgctagtatttttgttgaggatttttacatacatattaataagaaatattgatttatagttttttctgtgatgccttcacatacttttggtatgaaggtatataggactcagacatgaactgggaagtgttcccttctattctatattttggaagtgtttgcgaaggattactgttaattctttaaacatttggtagaattcaccagtgaatctactttggcttgaagtttctgttgtggaaattttttttttattactaatccaatctctttatgtgttttacatatatgctaattttacctttcttcttgaggcagttttgttatttgtgtcttcctaggaatttgcccattttccccagtttatctcacttgtaggcatagaattgtttatattattcctttgtaagcttttttatttgtaattaaaatcctggtagtaatatctagtaatattgctgttaatttctccttttcaaccgtaagtaattagagtattctttctttttctctttgtcaaagtagtgtgttggatagtggccttgaaaaatatatgcccacccagaacctgtgactgtgaagcatttgataaaagagtgtttgcagatataattaaaggattatgaatgagattatcctgtgttatcaaggtacatcctaaatctaatgacaagtgtcattataagagaaaggcagagggtgatttgaaacagacaaaagagaagacttagacaagggtagaagggaaggccatgttaacctgaagcagagattagagttattcatcaacaagccatggaatgcctggggctaccagaagctgaaacaaacaaggaggtatttgtttgtgtacccattaaccaacctctctttattcctctctttgccctatccttccgagcctctgatgaccaccaatctactcctaactacatgaagtgaatatttttagcattatatatgagtgagaacatgtgctatttgtctttatgtgcctggcctattttatttaccataatgtctatttccatccaagtggctgcaaataacaggatttcgttatttttatggctaaataatattccattgtgtgtgtatatatatgaatatatatatatatatatatatatatatatatatatgtcatattttctttatccattcatctgttggtgtacatttaggttgattctatattttggctattgtgaatagtgccgcaatgaacacaggagttcaggtatctctttgatatactgatttcctttattttggttttagaaccattagtgagatttctggatcatactgttgttccattattagttttttgagaaatgtgcatactgttttccatactgtctctattaatttacctccccatcagcagtgttcaagtgttgcccttctcttcatcctcaccaacatttattattttctgtctttttgataatagtcattttaagtggagtgagatgatatttcattgtgatttttgttgttgttgttttgaaacagagcccctctctttcatccaggctggagtgcaatggcgcaatctaggcttactgcaacctctccctcccaggttcaagcaattctcatgtctcagcctcccaaatagctgaggcatgctgcaagcgtgcaccaacatgctggctaatttttgtattttttgtagaaatgaggttttgtcatgttggccaggctggtcttgaagtcctgacctcaagtgatctgcctgcctcagcctaccaaagtgctgggattacaggcaagagccgcctcaaactgccatcattgtgattttgatttgcaattctttgatgataagtgaggttgagtattattttcatatacttgttagctatttgtatgtcttcttttgagaaatttctagtcagatcttttgctcattttaaaatcggagtttttttattgagttgagttccttatttattctggttatttatcttttgtcagatggatatttgcaaatgttttctcccattctgtaagtcgtaatttaattttattgattatttcctttgcagtaaagaagcttttttatttgatccaataacatgtaatttttttgtttgtttctttttgcttttgttatctgtgcttttgaggtcttactaaaaaaatctttgccaagatcaaacttgtccaacccgcagcctatgggccacatgcagctcaggatggctttgaatatggcccagtacaaatttgtaaactttcttaaaacattatgaaatttattggcaatttttgtttagctcatcagctatcttaagtgttagtgtattcaatgtgtggcccaaggtaattcttccaatgtggcctagccaaaagattgtatacctctggattagatcaatgtcctgaaacatttattcagtgttttcttctagtagtttcagagttttaggtcttacatgtaaggtcttacacttaagtctttaatccattatatttgatttttgtatatggtgagagaatgggtctagtttctttcttctgcacatggttatccaattttcccatcaccacttattgaagagactgtactttacctaatgtgtgttcttggtgcctttgtcaaaaatgagttggctataaatgcatggagttatttctgggttctctattctgttcccttggccagtgtgtttgtttttatgccagtactatgttgttttgattactgtcaggttccaacctgagctggggtctgaggggacaggtggcaggtggctaaaagaacactcaagggaccataggcagttgggaaatggtgttattctcttcccctcctatagagtcagctgtgcagttatatttctcacagacaacagtggctcaaagccagatacgagctcacacaaacaggttacattaaatggctacaaatgtgattacatagtgcgcggaattgtgcgcctgcactacaaacccactgtgtcatgctgtaccagatgtctgcctcagccttctcctgaccaaagcacagccactttccttacgctccaccctctaggctaagggagttctcctagcagggagacatgcccacagggcagaaacctggacacagaggccacagcagcaatacagggagcaacaactcactactagtattcctgctatgctgcccatgattattagggtccagcataggccagagcccagagacacccaccatgtctatggggggtcatcagtaaggctgtcagctgccttgatttcctgggaaactccttgcaaagctgctatgttttgttgattgtcagggatgaaggtacaacattgcattcccaaaacagcacagatgccaccttgggcagcaatcaatatgtaggcctatcaggttctgcactaccactttcctggtttgatcaacatcatctgtcaacagaaggaggacaacttgggtgtaattcaagtctcaagtgttatgctctggaagggccataacttgcatttctacagttacgacacctgctccagggatggttaatgctaagaggtagagccaccagggggctcatcacacttgcaaaaaccaggaacgtagcaccttccagttatgtgggcatctaaggaatgtggaaataactgtggcaagcacataaggccacccccaggtagagcggccaatcctgtttgctggcaaatatgaccatactgtgtctccacagtcccataaactcccagggggcacaaagtcctctggggcccagccttgatgtggtcacctattccatcacacctttggtgtggtgataacatattatatgtgttcagactatggcagacaaccaccccacggtgacattaccccagtgttgctctacacatcatgatacctgtgttaggggcaccttgtgttctcccactaacgagccccatccatcacagacattacaggtcagccaggaagcaagcatgccatgggttttgtggcatcccctatccaaagctgcccatgttgcattctaaacgtcagccatggaactcctagtgtccatccatgtccagttttccacagaagctggatgtatgtgccagggcaagacatcccctgctgctgcttgaagggtggtgcagatccaacggttggacacattggtcaactcatcgtaggtgtgggaccattccacaatgctgttggagcatgtcaacctatggtctaaatgacaaagtaggcacaggtactaacaggggtaaatcatgcccttcaggcaaaatacaggccaagctttcatctctagataacaatgcaactgcaaaggacttctgccctgggtgatggtaccacaacttttcagcaccccatggttcctttgggtctatatcttgccagagttactggggagctcataataggccacacaggaaatacagatgttccctggagacttccttccctggccattcccctatgaatggtcaatcatagaggccatatattaagtacccaatgagtgacatgtaaatcatactataggctctccctgcaagggactatgatagccaaccatacgtcatggtggacttggagggtctgtggccaaagccaggttttttgttcccctgcctttacagacattggggcaggcaacaacagattaccattgtccccatacctggttggaggaagtcatctttggtgtgcatctgtaagtggatggggtcagtggcacagtgtagcagtgcctctactggggcctggctgccttttcatggccgctcattcaagctttggagcaccaggtccaaccttgaactctagccccacaaagaggtggagtaacatgcaaatgtaacttatttttcaggagtcccttatatcactcaataataccagtagtttgtgggttatatggaacctccactttatgtccatccattgtgcccactgttgtacgtgctatccaggaaaatgtgttcccctatcacattcaacagtcaggggatgactgtatagggcacacaagtgttgcagggcctgaattgtatgttgttggttggccatcctgcaagggtaggcaaacagcagactggtggccgtgtctacagctgtcagcacatgcatatgcccctgcaacctcagcagtgacctgatgtagtctatttgccatctagtcaagagcatccaccctactgtcacttgttgtgtaacattgggcagctgtctctgtctggggtatgtctgtgtccacgctgggcatttctggcagacctcccagatatcttacatagacaaagatagaccatagcacttattgacctattccattagtttactcccgacgtggcccaatttctgctgcagccatagagctacatctcgtgtaggtgctgactccaaccaccggacctggccaaggcatttgcctcatcattgcccagggcagtgaaaggcacatgtcctgacacatgataaatagttacaacctttcgatggcccatttcccataggtctggccacatggcctggccccaaatgggcctgtgaccaactagctaattctgtaactttcaggtagttaaccacaaggttagggcttaataaactgcccagctaccagtgaagattaccataggtgtctcctccttagtgatcaccatccacagtgccctgagttcaacctattgactactttgtccaggtattaaaccatatggtatcagtactaggctggaccatgacagcagtccaggcagcagtagcaccctggctggacccatcctgtctaccatgcctcatcaggaatgggaggtgcctctcttgaaatggtaatggctcagtgtttaggggcgcctcaggctgacccatggccttatcttgcatcaggactacaggtcccaagacttcttataattctgctgataaggggcttgtactcagggtactctgctgttctaagtaggagccccactttgctaaggtggatatctctgccatcccagtctggggttcattacccatgaacatacttgctccccaactattgggtaagttgtccacacaatgactgtagcccttcctgtcacactctcacaagcctgaagggtggcatatacagttgttaattccttctctatccatgaatagcagagctcacctccattccaaagttgggaccaaaagcctacttgtgttctacagtgctctctgcactgccataggccccagccaaaaccttctgtggtcacatgcacatcaagttcaaatgggtgccccaggtcaattacttgtagcacctgcacttgctgtatggcccatttggctgccagaaaagccatctcagcctcattgtcccaatcccaagtaattcctgtttttgtcaactgatacaatggttttgttttctgagccaaatggagcacaaatgctttccaatatcccaagaggctcacaaaagtctctagttgcctcattattgtggtctggggatatgcctgaattttattaatgatggcctctggtatggcgttcgtcttacccaaccagataactcccaaaactttggcagacaatccaggcctttggaccttgttttcattcacagccaaactgcatgctgccaaatgttgctgtaggaggggtgccgctatttctaaatctgcaagagaatcagaggttaacataatatcatccatataatggaaaaggtggaccccctttatgacatatggtgggtttatgcacacagccctgcagcaacaccgtgaaagtctattgtcgccctttccatgtgaagacaaactgttcctggctctctggtgtgatgtcaattgggaagaatgtatgggccaagtccatcacacagtggtactgtcccaattccatcatcaagtgatccatcaaatccgtgatagacagcacagctgcatgtgaagggggtgttactttatttagttctcgaacatccaccatcatcttccaagttccgtcaggctttctgactggccataccagagaattgtagggtttgtgcattccatgcactatctgcacctcctctaacatcttactagtctcagttatcgccatatggccacctggaaagtggtattgatgggtggaagtaacctgtcggggttgtggcaggacctggggccagtgatacgtatgtccacccgataatggctcaaccacatgtatttggagtctgaattctctgaccgtggcttgtaaaaccaagctgtgaaaaatatctaccctggaatgtattcaagtatggaggagatatacacagtttataagcatgcagccaagtgcctgaggccaaggtgcaaagatgcaggcttcactcccactgactggcctctgtctatgtatgcaaccttgcctggaaacttatccgggttcccatagatgaggctacaatctgtgccaatgtctaccagcagcagcacctgctgtacattggtgggagaccagtggactgccaattccacatgtggcctcctgttgtctggtgtccccccaagctgggcaccttgaccagtttcctaatcaaacacaaaacgctctataccttcacccatctgcaagtagtccttgagctggagcatctgggtgggacatggtcaagcagcatcatcccgcccgctgttgggcattttctggaattggtgattcagggacaattgcctccacaaagttaacagcacttcattgggttgcctctcagttttctctcggtcaaccccagccaaaatcaaaccaatccacatatgtgtatgagtcaccactggggcccttttgtcccatgagatggccccctgcagaaggagtaccttccccctttttatggcatagactcctctgcttccccgagggctgccatggcagtagtcacctcatgtatgcagcaccctgcacacagattgacagtggccagggagccaaaggcactcaggggtgcagagcacaacacaaggtccctcatgtgggaggtaaggtgttcatcatctggccctcgggtattcggatcaaacatagcctgctgcatacccatctcctgaattacctgcaccacatctgtttatgactgccatttactcacagtttctggtatttctctggcatagtcccacaccatttgcatggcctccatcagccattcaattatggtgtggttgccttgcccctgtgctaaccacttgctcacctgcaattgctgatggagggagggatgagtcataatggaggccaacttttccatctcagaggaggagcagacaatactgttggctccctcatcccaaaggcgaagcatctaggtgggtaggatttcccccaagcgctgccagcactgtttactttattcccacaactccgttggggtataggcagtgtatgacttgtgctccatcatggtaggaggtctctgagcccacccctggggcctcaatgacttcctggtgtattttctgatgagccactgggggagcccacaacagaggttcttcctcctcggtgtcagatcgggcaggggtctctgactggggtggcaggcccaagcctacactaatagcagcctctaattctcactccaacctgtgtacgtcggccttcaggctctctgcttgtgcctggaggtcccttacctgtgctgcatcctgcagggactgagcatgcacttcccatagcacagtcaaaaatgcccatccaattctgctgggaaaggcacactccttctcagtgctctgtgcttccaggtgcttcagtgccttatccatgcacacaggggacctgtccaccaccacccatgtctccaccagggcccatcttagcagcatggctgtcactgggtaccataacccatattggggccacacggctgacctaggatcatcaggggccaagggctcactcacctcggaatcctgctgactacaccaattgtcaagttccagttcccagactaagctggggtctgaggggagctggtgaacaggtggcaggcagctgaaaaacactcaagggaccacaggcagttgggacatggctttattctctccccctcctacagagtcagcagtgcagttatatttctcatagacaacagtagttcaaggccagatatgaactcaaacaggttacattaaatggctacataaatgtgattatatagtgcatgggattgtgtgcctgcactccaaacctgctgtgtcgtgctgtactggatgtctgccttggcctactcatgactaaagcacagccatattcattacaattactagggctttgtagtatactttgaggtcaggtagtgtgatgtttccagctttgccaattgtgctcatggttgctttggctattcagtattgtttgtggtcccatgtacattttagggttgctttttctatttctgtgaagaatgtaattggtattttgatagggactgcattccatccttgatcattttagatattttcatcattttaacaatattaattcttgcaatccacagatatgggatatctttccattttagggggtttgttcttcaatttcttttgtcagtataattttatttgtagagatccttcacttttttgtttatatttattcccaggtattttttttttcttgtagctattgtaaatggggttgctttcttgatttctttttcagattgtttgctgttggtgtacataaatgctactgagttttgtatttaatttttgtataataaaactgtactaattttgtttatcagctgtactagttttggggtggtctttaggtttttcttttttctttgtttttgagagggagtctcgctctgtcacccagcctggagtgcagtggcctgatctcggctcactgcaagctccacctcccgggttcacaccattctcctgcctcagcctcctgagtagctgggaccacaggtgcccatcaccatgcccagctaatttttgtattttttttagtagagacagggtttcaccatgttagccaggaaggtcttgatctcctgacctcgtgatccaccctcctcagcctcccaaagtgctgggattacaggcatgtgccactgcacccagccaggtttttcttaatataagattgtgccatctgtgaacaggagtattttgatttcttcattcccagtttggatgatctttatttctttctcaaacctaattgctctggctagtacttacctagtagtatgttgaataaaagtagtgaaagcggttaaccttgttgttccagatctcaaaggaaagggtttcaatttttctccatttagtatgacaatagctatgggtttgtcacgtaaggctttattgttttgaagtatgttccttctataccaagattgttgagagcttttatcctgaaagggtgtattatatcaaatacttttttagcatctatggaaataaacatttttttaaaaattctgttaatatgatgtatcacatttacagatttaaatatgttgaaccatctttgcatcactgggatgaatctcatttgatcatgatgaatgatctttttaatatgttattgaattatgtttgctagtattttgttgagaattttgcattttattcattatgaatattgacctgcactttccttttttgtgttgtccttgcatggatttggtatcagcataattctggcctcataaaatgagtttggaagtatttcatcctcttaaatattttttgaagagtttgagtagaattgttattggttcttctttaaaaatttggtagagttcagcagttctcattaagtcctgggtttttatatgggaggctttttattactgcttcaactgccttattcaatattggtctgttcagatgttctatttcctcatatttcaatcttggtaagttgtatgtacctatgaattttttctttgaatttttttgttgaaggttttctgatttgttggaatatagttgttataatatgctataatcatcctttgtattttgtgatgtcattaaatacaaagctgtaatgtctcctttttcattttttattttatttatttaggtcttcttttttttcttccttagtctacctaaagctttgtcaattttgattatctgtttttaaaaatcaacttttcattttgttgatcttttgtatgtttttagtctcgatttcatttatttattctctgaactttatgatttcttgcctcatactaattttgggtttggtttattcttgcctttccagtttctctacatgtatcattaggcagcttatttgaagctttaccacttttttttatgtagatgttcattgctataaattttccctttagtactgcttttgctgtatcccataggttttggtatgttgtttttacattttctcttgtttcttttttttttcaaattgtcctaactttttcattggcccattggttatttaagagcatgttgcttaattttcatatattcgtagagtttccaaggtttttcttattattgatttatgattttttccattgtggtcggaaaagatatttaatacttgactgttttaaatttgttgagacattgagacatgttttgtggcctaatatattatctaccctacaaagtattccatgtactgatgggaagaatgtgtattatgcagccgttggataaaatcttctttaaaagtcatttaggtccatttgctctataattttgtttaactccaatatttgttcattaattttctgtctggatgatctgtccattactggtagggggttattgatgtcttgtactattattttattgtggtgtatatgtccatttagatctactaatatttgtttaaatatgaggcactgttgtgttgattacctatatatttacaattgttatatcctcttgctgaattgacccttttataattacatagtgatcttctttgtgtctttttacagttttttacttgaagtctatttttatctgatataagtatagctattcctgctttttgtttgtttgtctccatttacttggaaacttttgccatttattcacttttatcctatttgtgtctttataggtgaagtgagtttcttgttagaagtatatagttatataattggatcttttaaaaaatatattcatctaccctctatcttttaattggagaattttccatttacattcaatgttactttttataggtaaggacttactactgccatttggttatttgttttctgatgttttgtaactcctcttggcatttcttccttcttaccatcttccgtttgggtttagtaatttttctctggtagtatgttttgattccttgctttttattttgtgtgtctcttataccatgaagcttataaaaaatcttatagctatataaagctcttttaaacaaacaacaattaactttgataacaaagaaaagatacagaaacaaagaaaactataaaacgatctttgaacttcatccccccagcatattgacctttttgttgtctcagtttggatctttttatatctcttaacaagttctcatagttattatttttaaaaatttgtgttttagtcttcatactatagatatgagtggttttcacattgcaatgacagtgttagagtattctgaatttgtctgtgtacttacttttatctgtgagtctatacattaagatgttgtttaactgcatattagtgtctttttcttttaaactgaaaaattcattttattatttcttttaagaaagggtctggtcttggtgaatttcctcagcttccgttttctgggaaaagctcctcattccttcaggtttgaaggatacttttactgagtatagtatgttttgtttagcaagttttttacttcagtactttttatatatcctttttttaacttcagtactttttatatatcattccattccacctggcctggttttcactgagaatcactgagatttcactgagaaatctgttttcagattgatcagagctcctttttatattatttggttattttctctttccactttaggattctctctttgccttgatatttcactgtttgactattatatgacctgggatagtatcatttgggttgtatttacttagtgatacttgacctttctgtacctggatatatctatttttctctgggtttgcaaagttttctttatttctgtgaatactctttcttctccttgctttctctcaaccccctcttgaaggaaaatgactcttacatttgctctttaaaggctattctctagatctcataggcgttctttgtttctttccattatttttctcctgtgactctattttcaagtagcttgtcttttagttcactgattctttcctctggttgatcagtcctgctgctgagactctctgatgcatttttcatctaattcaatgtattctttagttccaggatttctgtttgatatttttaatgactttaatctatttgttgaatttctgtaataaatttctgaattgcttttctgtgttttctgggagctcatcaaagagttttgttttttttttcttccagtaactcaactcataccatctcattagggtcaatcactagtttctttctttgtacatttgaggtggccacggttgtgttgtttcttatatatgtacatctatattcttgcattgaataattggttatttattgtagtctttgccttctggcttggttagatcttcctggattatatctgcttagaggtgtactgtatagtttacttgttgaattctcttaactttagattgtggccttcttattagcattacatgtcacctcaatcctaggtttgccagggctcttgcaaaagcttggggtgctgcttttctttaatgggatgggtttcccaaatggaatatcccagctatgtgaaaaggctgtctatgggttcatgccaagaggatccatggagtatgcctctcattgtatggtgctgctgaactgcctttctgttttagtatttctgtagagacagcctctaaatttttcacactatggttgcaagcccctctttgattcttggttctagctgtactctactttctttttttcctcctacaggctttcaaaatgcttcccaacacatcttgcattaagacaagaattaacttactgcagaggaatccaagataatagagaagctggctgcctactctgatctcatttttccagtgagacacatatgtgtgaggggaacttttctgcatagtgcttggcatcatgcatacagaaatgtgtttatcttagtgtctgttcacaatttatcatttgtttgtggccctatggattttcacagcctaagttttgagttttgggatattactggtgatagtcttggtgccaaacagttgtttcagttttaattttgtgaaggagagtgatgccaaattgttgctgctccatcattttggtgatatcacccacttttgttgctcttcctattaataaggaatcttaagagcacgctagaatattgaggaacaaagacaatgttaactgctaggcaatatagatttattggatgcccaataactaaataccttgaccccaatgggaatttgtagttcttattgtcagaaaaccactggtcctatggaaaactaagtatgagctgattccctccaaatcatgaggtgtgaggtgggggcaatcgtagctggctcattgtccaagaaatccagagtgaaatcctatgatcacttttagacaattctgtttattgacatatcattaatcattatagattcctatctcaatatgtcagtaaaattgctgtactgggactatataaactattattcaaatgtaagtatataatatactaatgacagcttgaatcaccttctacgatagctgaagtagatcatcataatcttaacaccacattttttttctatgcattgatctatacatgacaactctcatttccactgcaatttcaacatgagagaaaaagtaatgagacagagtagctgtgttctggttagaggcgcagacaaagcagtttcaagagactctttactatcatgggtagcaattaaatgtgcaatggtcaatatggtcagtaatgggggaaaaaagcacatggtgccagattgagccaaccattgtgtacaaccattgtaagaaagagaaatttatctatgtttttctgattcatgcattggtacacacatttacagaccagaatataactctagaaattggcagctattttaatgcttccaatggtctgtttttgttaaatgaaaaaggtaatgcaagaatctattttagttatttaaaataaattttcctcatatggaagttgaatgttttacagcaggatggtctgggaatgggcattttgcggcagtattgaattttcatatgttatagttatgtagcaagtgagttcatcatgtcaggagggagtataagttcatctccttattagtctatgtctgtaatctatacgactattaaagctaatatttctcttgactctgcaactaacccctgaagagaaaaagtcatctggccaaatcccaaaacactcctgaatgcattagggtagattatgaacatgtagatgaaatacaaggtttatgaatctcccctctgttgcctgaaccccctttcccttgccacgcttctttgcttttctgacagtattttattggctataaatgaaattcaaacagtgccccaaaacgaaactccttcgcaaaatctttcttgcagtgaaaataactgtatgcacagtaatttaatcctcttcttcaaaaattgatacatattacagtagtcctcccttatccacggtttcattctcagagttttagttacccatggccaactgcagttcaaatatattaaatggaaaattccagtaaaaacaattcataagttttaaatcctatgctgctctaagcacggtgatgaactctggtgtcatcttgctctgtcccatacagaccataaatcatccctttgttcagtgtatccacactgtacaggccacctgcctgttttcacttggtaagcatcttggttatcagatcaaaggaacgtagtatatatagggttctctactatccatggtttcagatccactgggggtcttggtatgtatcccccacagataacagttgactactgcattaaaattaatccactattaggtaataaaaacttggtgaagaggatcatgagatttaattgtcaggagactcccctgaagaagtgacatttcagctgaaacttgaatgacacttaggtattgatgttggagaagagtaatctagcacaataaaatataaagtgggaaggtggaggtaagtttagcatcagaaaatgtctgatgtggcttgaatgtggaatggacagtgaatgggataagaaggttgacatagcacagatcatggagagactcagggacttgtttggatttaattctgaaagtaactggaagccatcgggagatataggcagttgagtgatataatttaatttgtattttaaaagatcactttggcaggtttgtaaagaaaggattgtctgatgggcattaatggaagcagagaccactccaggaactctggaattagttcaattgatagcacaaaacaacagagaggtggttagcagccatgcagatggagagaactggcctgagttaggatattttggagacatacaaaatgattttgatactatttagcagctgcataatagcccattatatgaatgcgccatgacttatttaaacattggaagaggcgctttcaaatttaagcaatcaagtgtattctgagatctactattaagattcctgcttcccaaattgtcttcatttacatttacccagtaactatctatttaaaacgcataaggtggtaccctggctgtactaaagaataataaatagttccattcacccttgctttttaaactatgacccatttcagttcagttttaatttttgagtaagaattagtataatatatgaaaagcattctgtatgcagttccaatatatattcaagttaccatagaattgaacgttatcatttcatgggatttttgtttttagttttgagtagaacaggcttgaaaaaaatataagaatacctgtaggaatcagatgatatttgataattgaacagctctttggttttaattcaaaattaaactccgaagaataagaataacttaaataaaccaataaagtttggctatgcaattcagagctcaacttaaaaagttacgcatccagtaaatttttcagtaggctgttcatttttatgctaattattaagtttcattctattcattaaaatgttaaactttatcctgagtcacctaaatcttccatgagctctgcatgtagaaaataatttggcagatgcttatttggaggaaattgcttacttcttaatacaacttttttttgagagaggaaaatattagcaaaaaatttttatgtccctaaaaattcaaacattttgatcatgagtaggagcataaacagagtgtatcatatacagttggaataaaaccttagatgcatgcaactcaaatggaatgaatgattccaactcatatgcttgttaggattcaatcaactctcagtcattcactgagttgagttacaagtagaagagagtgggtaatgttaaagacacactgcacaattcttgtttataatatggctttaaaatctagttgggaagacaagaccacatgttggtgcttttgtgatttttgcatgctgttccttctgcatggaatgactttctttaacttcgtggccacacagttgctaattatctttcaatctgtcagtatcacatctgtgaaggttttctttctacattaaacagtttataataatcgttgttatgcttttttggattcacatgtctgcatctctaaacgagcgtgtgttccttcaggaaaatgactatgtcatgtccggagtgcttggtgtaatgtcttatacagtgttggaccatcattaatattgagtattgataatataaggcagtttgctgtgaattctaaatgtctagatctatcgagaagtgtttagggaaatttgtatctctcaagagaacaagatcaccagggcctctaatcctggtattagaattacaatcagggcaaatcctgaaccatttgaggcttgagaagagggaacagatgagggaggaaggatgggttggggaagtcttcaagagtttttcaactctactaatctttggttctacatttcaaagtttgaattttaaaatagctctattacctatataaccattactttgtggtctaaaagtaaaaccataaaatcagcttagcacaacagaatgtactggactgaggcattcacattcagtcaatttttcacagtataactcagaaagaggttaaaaagttctctttgctttttgagaacccattttgtagttcattgttgcagattgtctgatgttgactttcagaagtgaactgaaatgtatgagaaatctggaaatatggtaaagacaaggaatcaaagccaagaagcaaacagacacgcaggggaggatatttaccgcatcgtctcactgagcatacctggaaaactgagaagctggcttttgaatagtgcatatataatcagttctttggtctgtaaattcagtaatcatgaaaccccatgaattagtatcaacatagcagtacatgtcttcattaatattttgtatcattacctctgtagcctctctgaggaattcagggaattttatgggggaaaaaaaaccttaaaacttgaagcaactaaaatttatataaaaatcatacagaatgaatgaataaagtatattaaatatacaagctcttttcttagagacttagaatataaaatgaatacgaacccactttccccaataattagccttgatacacaagtaagcataagcacaatattttttcttgccaatttctacaatgacccaaaacctttaatgaataaaaaagatatatcctaactaattaaataattatagttgacaataactttattaggcaaaaaaatctactaattttcattgtctttttaaatattacagtattcgggcattgttatatatacattataaaatatatatctagatatctagatatattcatatatatatatatatatatatatcttgagataatatgaatgtaacatttcaaattaagatatacacctctgaagagaaaaatgacactcatcaccatggggaaagatagtaatagtagttaatcaacaaatgtgtgctgaattaaattgaatgaatgcaggatcctctaagtggttggtgaaactgttctggactctaagttcatttcctaagctagatactctatagatgacatatactgaacaatttctataatgcaactgcttcttcctaggtcgtctttttacagaatggaggaaatggccttttaattccacaatccactctggtagctataattatattgtttctttttataatgaagtagaaagatatagtacattacaaaaagaataaatttataatctaacaaactatgaactcttaagcaaccaactcttaactggtggaatctggaaagcgcttcttaaataaaaaagaaattctatcctggatgtctccagaaatgagttgtgttactctagcgccctcctacattaatgtaaaaagtagacaatgctgagctccgcagtttttgtgcagtttccagctttcaaagtaccagatagaactctgactccaacactttccatccttatattccccaaaatgtatatggcattttaattatccttcaaaaatcttgacttttctgacccttcatctcttcttagtagaggaacaagagttcaggaacaagtgtggagatgggggtggggtcaaagggaaagaaatgcaaaccagactcttacccaatgattacttcttaaataatatggtctgtaacagaggttgccaagcctttcctatatagaaccaaagagtaaatattttaagctctttaggatataaagtctctgtcacaactactcaactctgctaatgtatcataagagcagacacacacaatacataaatgaatgaatgtggctgtgtttccataaaactttacttactaaacaggtggtagtctgaatttggtctgcaggatatagtttgctgaccatggtttatagcataatctttgagtatagcatacaaaatatcattcagccgatttttttgtaccagaaatttccaaaatcaactgaataatttacttttttttcccttaaattactctacagtaatctctgtggaagaaggtgaactgcatttacaattgcttgaaatagtgagaaaagttacaaaaagaaactacaaatacaaaacaggcaatatctgataaaataaatacactctgtcactatgttaaacaccagaatttttgtatttctatagagaacaccccaactatcagacctttttgaagcattattcgcatttacattcaacaaatatttaacctaatccttataatcatccaccatttttcaaactttggaaatccagatttagaaagataaagcagacctcttaaataggaagtggcaaatctaagatctgaaccttgatcatctgcttccaaatcctgggctggttaagaaaaatattagatttaaaaaaatctaaaatacattcaaaggctttaattccgcctagtgtttttcagtgccagataattttgtaacaggcaattctcagtaattgtaaaacacacaaatgatgactttcactgtttttagtaataagagtaaatcaatgcaattctcagtcattttgcttaatggagcacattgaaaaacaaaagagctatactccctgtttttttctaatattttctgatgaatttcaatagctagactctcaccatactttaaagatcgtcattcttccttaaaagcaaaaggcaatttaatgagatacttgcagtagataaagttgccgtatttgatgtttccatgttttattttctgggagatgacacagaacaatgttgtctgagattgtgaatttccatacagagggatcattgaagcacccgtcgttcataaaacactctgtcatgctggagacaaaactatcaaattttattaaaacttagttatctcaagtcaagctttacatttccaaatagaaatagtgaactgcaatgtgtcagaactctaaatttcattaccacagcaggtgtcattatttggcacataggactagggtttgtgataactacatcatacaactccaaaggaaatagcagaaatgttctttgaaagcactcttctatgtctaagataataccatttttgagcagtccagcctaagaatgaaaaaatatatatagaaatactgaggtaaaggccatgatgattttcatattacccacaattaaagtttgaaattccaggaaagcatttttagatattatagtatcaggaaaatataaggaaagaaaattagctcaagatttccaatctgactttgtgctagcaaataatgttatgcaaaataatatctattattaatatataataatatctattatgttttaaaaaataaaataatatctattataattataatcccataattttttcttatctctggtaaaatatctgctctttatgttatctcaagtcaaattatacagtttagaaatgagtgagagatacttggaatcatctttcctcattcataggcatctcaaggaagaaatcataatagaatgatatctattattttattttgtagtgtttatttttattttataaaatttttccataatttattggggtaccggtagtatttgcttacatgagtaagttctttagtggtggtttgtgggatcctggcgcacccatcacctgagcagtatatactgcaccatctgtgttgtcctttatcccttgctcccttcccacgctttcccccaagtccccaaagtccattggttcattcttatgcttttttgtcctcatagcttagatagaatagccagatataaatttagatggctaaacatttatatatcatcagtaaaatttcggtccaattctcatttctaaaaattttggtactagagagcactctacttttatgattaaaaattttaagaatcttcctttaagacaaaatatgactccttttaatttttctccctggatccaatatccccttattgtataaaagagtgtccatttccttctcatggacaacctttaaaatatttaaataaaactaattttaaccgccaccaaccctcaatcatatcatgtccaaaataacctttccaacctccttaatctatttttttttacaataaggtttattatttccttttatcagtgcagttttggatgtgcaccatttaaaaaataaggtctttctttaaaaatgctcataaagtaaatagaataatacaaatatagtgtcaggaaggcaaattgtttctaatacgtcttttgacctaaatggtgaatgcctattgttaaagcttcagattattaaagtttcaacagcaaccctgtcgaactattggctaattccgataattttcaattaaatcaccaacattatttgtttttaatttgagttattatccagccaccagtctaattgatttcatatttgtgcaactgattttctaatagaaatatagtactttgttgttttctttttctattacatttaattttccttgttcctgtgcctttattcaagttgctgataaaaactctaatctgaaaagtccgagcaaaactctgtggcacattcccagtaagctaaattccagatgggcatcaagcattaatcaatatcccagggcatactattaaacctgttaaaactctaccaaactttttgccattctgctcacaagagtatcatgcgagtttgtcaaatgcctagttgaaacatagactcactatgtcgatggcccatatgaggcccataaagaaaattcagagctcttaaaaagttgctatgaatctgtaatcccataatttttccttatctctggtaaaatatctgctctttatcttacctcaagtcgtaccagagagtttagaaatgggtgagagacatcggggatcatcattcctcattcataggagtctcagggtagaaatcataatgaccatatttcatttttttttctatgtctgtgcccttgtgtgatagtagcatagttgcttgacagcatattgaagagtcttcattactcactgccattttctttcatgtcctagaagtgaaaaaatgttgtttggttccagttgaccacgattgtatctgatcttttcttctgttttatttgtttgtttcctaacagtttatgtttctcaacataaaatactatcgtcgtcatgccagactgctctctaggatcaccttgttttctcaccacaatgccttagaagggagcagagagctcagggtgtcactagtcagcttatatctcatctcatgttatttgaacaataggactctttaggagatataagaacattataaatacaaggtgcaaaatgtatgtaattatgacacctttttaaagtaaaccatagcaaatcacatgaaatagtgctttcttgatacaatattattatcgtttcttctacaaacattatttcagttaaggagagtgtgcaagggctctcctggctacctgagcaagcatttgaaagattcattatatttcctagggttaaaaactattttcctggagtttctaaaaatgagagcctgccataaaattgtgaagtttcatgggaaaagcaaagtaacttttaaacaactgaaatttttaactattttctagaataaaaagtatagaaggtcagtggatcacagctattgttttagctgaaaaaaaaacggaataagttgatcatggttaggtagattataattttattattacttggtaaaattgaattgtttgggccctggtaatcctcggctatttgtgtgtatagattaaagctcctggttctcacttaaccaaactgaaaagcactaattgtcagagaaagaaatgaagtttttttctagtgacttgttttcgaaacaacgccacttacatattttcatgttgtcacatttacatctgagaattattggtggaaaacacaaatggcataactattaaaaatgggtttctaatcataattcaacatgactttgcatcaaatagaaataccaaattgagaaaaggaaatgagtgtttgactaaataaatgtaatgaaatggtagtaaaagagtcaaaaattattctttgcattttctgtcttttcagtttatctatctatctatctatctatctatctatctatctatctatctctctatctatcatctatctatcatcttgatgtattgattcattgattgtggtaggcatgagcttattatgtaaaataagatatgtgcttcagtgacactgtttttgccaagaggtgttgctttgaggccttccatagcagcttcctgggcatctgggcattgatgggcttgcgaatgagctgagttggcagctgcggcactactggttgtagtcttgctagtatgctttcaactgtatccccttgggatatcagctcccttacctcatcagtgcagctctcacccatgataatgtttgtcataaatgtgacacaaatccagtccccatgctgtatctgcttatgttagccaatggagccacacagtggattagaataacgcacaaggacactggaggaagttgttcataagagacaaagagagcatatacagacagtggacatgaaacatttaattgagtgaagcttttttttctgatttgaaaataaatatatgttagggtaaaaaaaccaagcctgtaaaggaaaacagaaaaattggagttaataaagggacccacagcttcactactcaaagaaaactatcgctaaaatttgggttgcatgtaactctttctaatgtgcatatatgtgtatgaacaacatatttgatgatgtgcagtactttatttaaacttttgcctggtacattaggccattcttgcattgctataggaaattcctaagatcgagtaatttataaggaaatgtttaatttgcacacagttcttcatgctttacaggaagtgtggtgctgatatctgctaggcttctagggaggactcaggaagtttacatttatggtggaaggtgaaggaagggcagatgtgtcacatggcagaagcaggagcaagagtgagagtgaggacgtgccacacacatttcaatgactagatcttgtgagaactcactgtcacaaggacagcaccaaggggatggtgctcaaccattcctgagaaatcctcccccatgatccagtgacctccctccaggccccacctccaacactgaggattacaattcaacatgagatttgagtggggatgtacattcaaactgtgtcacctactattgtctgtttcgttcattccaattgtttgatctgataaataattctatagaagacagtgtaggctgaattgttcaaacattttgccatatttcaagttaagttcccagaagttgggtttattaaaatttaaatattttaagactcattacatatatacacaaactacatgataaaagagttatgtcagtttacgttgtgaccatgatacagtggatttaaaactttttattacatttctttttctttagtagagatgaagttttactatattgcccaggctggtctcaaattcctaggctcagtcagttctcccgcctcggcctcccaaagtgctgggattacaggccaccctgcctagccatgatatgatagtcttataataaaaaatccctctcacattttttttagaaaaaaaaatccctcctcttctttacaaaatatgtaatgatttgcctttattttacttgtccaatttctaacacagtccctattaagttagaaagctccacaattggaatcacataataaataatattaactaaatggcttaaaataacacaaggaaccccaagaagagagcttagattttatgtaagtattcagtagtcacctacttgtattccactaaattgtgaactccaaaaacagtgttttttatttaaagataaatttttattcaatacctgttttgtattaggcattttctcattttttgagaatgcaaaggaaagcaagatagaggatttcagctactatgcatgagacagcaaggcaaggggaccagttgaatatcaggctcaatgtcatatgtctggaatttatctttacacagatggtatttgtaagggtatatatagaccaaaaataaggtgagcttggaaattgatgatttcacattaattttctgcatgtcacatttgaggaatggattttactttaagaataaataatctcttgacagcctatgcatcagaatccatgtaggaaatagtgaattagtcatagttcaaagttgatcatctatttatttggatgttaatattaaatcataaaaatacaatattcgacaagtggataatgttattgctgggatgcttgaacaaaatgttcaattattttaaatgttatcaaatcatttaaaattgaaatttggaagttttatttccacaggagtaaaactgaatcatttaatgtgacaatgtccaggacagagtttcttaatcaaaaccctcgttagagaaatttaactccttatattacattttacggcttttgttttaattttatctaccactatagtcaatgataaaatgtgaataaatagaaagaaaaatattgtcattttattgtcttctttctattgatataattaccagagtcttctcaaagagggcattaaaaactctcttagggcactgaaagtcctttttactcggtttgaggtttcttaaaaggagtaaatgaaaaagtagggtagtggcttagagaaatccaccctggagaagacatgaacagaaaaataattacttataaatgggacaagttgatgtaaaatttgtaaagatgggttggagagttttggcaaaaatgtgagctctggaggaagcctgttgggttcaattcctgttctgtgcactgttctttcttttatattgttagttttctcaactgcaaagcagtgtaacacagtcgctatgattgctatgaaggttaaatgaaataagacgtgaagaccatttagcatacagtccaacaaatacaattgagatttataggctcagaagttaccattagtaatattcaagcacctggaaatctcacacttaatattaagaacaaataatgaaataggcctaaagactaagatgagttataattgtattatacttagtgcaataaattagacaaaccaggaatagagagattgttttactcttcaaagccttagaaagctatggctgtcacagaagctgttgaaattagtgaggatattatatgtcagtgggtaggagaggaaatgaaataagactggccacatagtcatcaatggtgtttagagtagccacattgtttcataagaacattcttgtcaacatatgagaactggagggtgaagattaaaaaaagagagagagacagtgatatgcaggatgagctcagttacaccgaatgctgactttatcacactgcagttacagaaaaggaagaaaaggccttagttaaaatataaataatatatcaagaaagcggaagcaaggttcagtgaaataaaacacaaaaatctaagaaaagattaaagggaagtatcttgatattgtgtatttttgaaagggctgggacaaaatgcattttggtgtacactgtaaagaaagataatgctaaaatcatagactaaataaatacatatgaaagtaaatttacacagaaaattagaagtatattttttgtttgttttcttatgcattttttatatggaccagcacagtctatagcatgtggtcccacttatgagaaacttcgtgtttatttgttcaatataaatgttttcaatttttttgtatgttaacaaagaaaaaatatatgaaagtaaaaggaagaaaagaaattactcaacataaattgggagatgattttttgtctctctgtgaagcagataaaatggtcagtatataacttcagtctctgtgtccagagcaggggttcctaacatgaggtcaatactcttgagattaaaatatttggtgtatgagatgatactctagggtgataattcagagctttcatctgattctcaagaacattgatgatccctttccttaaagctcagaaacaagcgatcgggagaaagataagtaaatgtgactaatgcatacatgaggcatgccatttgtatttatggattagcttttagtggtaatggtttagaggaaagcagtgctaagctcacatgggcaggaaagcaggcagcatactgaactggctaatattaaaatgtagggccgggtgcggtggctcatgtctgtaatcccagcactttgggagtctgaggcgggcagttcacgagatcaagagattgagaccatcctggccaacatggtgaaaccccgtctctactaaaaatacaaaaactagctgggcatagtagcacgtgcctgtaatcccagctactcaggaggctgaggcaggagaatttcttgaacccaggaggcagaggttgcagtgagccgagatcgtgccactgcactctagcctggtgacagaatgagactccgtctcaaaacaacaacaacaacaacaacaacaacaacaaatcagatacaaaggcatttctctgcaaaaggggaaattcctcttgtaaaacaaaaggaaactttataatgtactaaaaaatatggcaaagtgacagataaagaaagttgtcttccaaaataagcaatggggaaaggactccctattcaataaatggtgctgggataactggctagccatatgcagaaaattgaaactagaccctttcatttccccttattaaaaaatcaactcaagatggattaaagatgtaaatgtaaaatctaatactataaaagccctggaagataacctaggagataccattctggacataggacctggcaaagatttcatgatggtgacatcaaaagcaatgacagcaaaaacaaaaatggacaaattggacctaattaaactaaagatcttttattcaggggaaaaaaaaagagcaaagtaaacagacaatctacagaatgggagaaaatagttacaaactgtgcatccaacagcagtctaatatccgtaatctataaggggcttaaacaagtttacaggcaaaaaacaacctcattaaaaagtgggcaaaagacatgaacagaattttccaaagaaggcatacacgtggccaaaaggcaaatgaaaaatgctgaacatcactaatcattaaagaaatgcaaatcaaaactacaatgagataccatctcacatcagtcagaatggctattattaaaaagtcaaaaaataacagatgctggtgaggttgtagagaaaagggaatgcttatacactgctagtgggaatgcaaattagttcagctactgtagaaagtagtttgacggtttctcaaaaatttcaaaacagaattaccgttccatccagcaattccattattgcatgtatacccaaaggaatataagtcattctaccataaaggcacacgcacacatatgtgcgtcacaccactattcacactagcaaagacatggaatcaacctaaatgcccatcagcagtggactggataaagaaaatgtggtacacattttatacaccgtggaatactgtgcattcacaaaaaggaatgatcatgtcctttggagcaacaagctagaggccattgtcctaagcgaattgacacaggaacacaaaaccaaataccacatgttctcacttgtcagtgggagctaaacattgagtacatatgagcacaaaaaagggaatgacagagactgggggctacttgaggatggagggagggaggagcataaggatttaaaaactacctatttaggactatgcttattacctgattgacaaaataatctatacaccaaacccctgcgaacaaacaatttacatatgtaacaaacctgtacatgttcccctgaacctaaaataaaagttaaaaaataaagctgtcttccaaaggaaacctatggaagttctatacaaaggcaaagcatatatgaaatatatggtcttctaaatattcatgttaagataatcagtaaatgcctggaagacatagattggcttagaatgttataaaaatgctaataatttatagcttttgttttgttttgtattgaggcggagtctcgctcagttgcccaggctggagtgcaatggcatgatcaaggctgactgcaacctccgcctcccaggttcaagtgattctcctgcctcagcctcccaagtagcgggattacaggcacacacccccacgcccagctaatttttgtatttttagtagagacaggttttcaccatgttggccaggctggtttcgaactcctgacctcagatgatccacccgcttcagcctcccaaagtgctgggattagaggcatgagccaccatgccggccctatagcttgtttaaacaacataaacttcttgagcacatgggggaaagtacgtatgaagaagcagaaagagcactatttagttactgaagtgaaaaataatgaaatatcttggaatcaacttgaacaagatagggggaggtatgttgagaaagtattggcagtttccattaaaaaaagaaaaataaaaattacaatcttggcgataaagagctggaactagggaaaaatatttttaaaatttaaagaagtaatacaatatttacaattcaaaaaagtgaatatttacaatgaggagagaaatgaaaataaattatactttgattccttcttaacatgacaacaaaatctcaagattttcaaatgagaaaataggtaatttaggctttttttgcatggttcttcagaatttatgattgtagtattctacagaatatgctctcaaaatacagggatttcaataaattccatattgcatgattattataaaaatatggaaaagtgtgttgatgggggatgctaaagttctctgcttataattttatgcagcttattattagatttatccacagactagcttcaggctctgaacatttctaacttttttttctttccttcccactttcttctgaaacttggagtgttattgtataggacacaattttatgtgatatgactctcagaatatgacatctagcctcacaaccttatgtcacaacatggggtctgttggcacaacattctgtaagcgtatatttggaactcatttctatatcaaaatagctaacaatagcttaattctatatggaagtaactgcaaacaatttaacttcctcttactaaccgaaactaaatgtacccccacttaacattttgttactcagactctagaaatattatcagacactccaccaccacttgacacaaggaaaaggtcatagagggaattaagagcagaattggccaggcgtggtggatcaggcctgtaatcccagcactttgggaggccgaggcgggcggatcacaaggtcaggagttcgagaccagcctgaccaatgtgctgaaaccccatctctactaaaaaataaaaataaataaaaataaaaataaattagacaagtatggtggtgtgtgcctgtaatcccagctactcaggaggctgagggaggagaattgcttgaacccgggaggcagaggttgcagtgagcagagatcgcaccactgcactccagcttaggcgactgagggagagggagaccctgtctcaaaaaaaaaaaaaaaaaaaaaaaaaaaagctgaatcatacagccctctgaatcagttgcacttttctagaaattttgcaaaaattttatgaaaaacaaatgaccaagtgaacacctagtttcatacccaggactttaaaggtggtctatgcaagtgggaaatttgaagctcaaacattgtatatgcccacataaatctacctataggctaatgtctatttgtggataagggaatttagaaagactatccaaaaagttaaccatattatagaaaagatgaagataaagcaaccaagggaaaaacactggaaatataaacattatgagatgtaaagaaactttattttaacattagtcaatatgtccacttgtgtattgctgaagggagaactagagtcttaaagaaaaagtgattgttcctgatagaacaataatttattgcaaagtacacagtcttataaacactaccctttgctggaacatgataagatttgtgttcatggttcttcatattcactcttgctccagagtcaatcttgaaataaaaataagataattccagttcattttcagagtcctctcagtccatctgtgtcatttccctgtccctgaccccatctctggatcccattgctgttatgattccaagtggatgggagaccatcttcttggctttatgttgggcaagtttgcatgtaatattcagttttgtttgctctctctctactctgtttcaacccaagattgcaagctgtatttcttaacaattatttattaattatagataaaatactagatgttattggcaataacataagagtaacataaatattaaagttaagttagaaaagcattgaattaaaaatagtctatgtaaaattccaatcttgttaggaaaatcaggcctaaaacaaagttctacaaatgagtcctctgtcattttagatggtataagttaatttataatggaagtttgcattttatcagaggataatcaaatgactgacttgctgcatttgaaagccttctgatactaaaacagtctgtataggagaaaaatgggggaaagaaggacttcctggtgagagtaaaaatatagaattcaagcctacaaataaaattgaacttgatttttttctgtggatactttctcgtattctgggttaattttctttataatattttgaaaggaagtaaaatatgcagagtgccaaagacagcaacagaaacctcccatactcctgaggctttaggaacacctgtcatgaaagtgggtttggctgacgtaggaataacagtgatacaatatgagtgccttttatttttgacagtctctgcgtttatcaattgcaaatgtacggtgtatacagccagcaatttgtcaaagagtgttgtagaaatatgtctgacccacataaaaagaccctatgcgtagaaaagttttgtttatctgaactgtatgctcagtaatctaacggggaaataagaacaacaggtttctaatctttcttggccactgagaaaaggggcttcatatgttgtaaaatgcagttacatgctatctaaagtaataataaagattgttttcagtcctactcttaacttcctacaatttagacattaccagtagaattcttttctaaagttcctacgaagtcaatacctcctgtctgtctattgcatgctttacactcaggactagagtctaaatccaagctgagcaatttattgccattatgattttaggcaattagaattaaggttttcttccatagctcataaacaaaaatagtatcacttaatgattaggcataaaattgctgagatgtaatataagagaaatattttgcatgcatcctaaaattctatagttaatgtacacacacgctcatacacaattaggcgtgccatgtccatcttttctaataaaatgtagttttaatttttaaaaatgatacaatgtactttacctaacatgtatattttatatatatattatatatatatgatatatatcatatataatatattatattatatcatatataatatattatattatatcatatatcatatatatgatattatatcatatatcatatatatgatattatatcatatatattatatcatatatcatatatatgatattatatcatatatattatatattatattatataatgtatattatatatgatattatatcatatatattatatattatataatgcatattatatatgatattatataatgtatattatatatgatataatatatgatatatatattatatatgatataatatatgatatatatattatatacatggtcatggtaggttttcacgacaggcatgacactcaaatctcttaaaataatttttacttctttttaagtaatcaatcaacatttgtttatttaaactttaaactttctaattcgtattttttaaattaattgtaattgacaattgtataaatttatgggttgcaatgtgatttttttcaacttttgttttagatacaagggctacatattcatgtttgttacaagagtatatcgtgtgatgctgaggtttggggtacaattgaacctttcatccaggtagtgagtatggtacccaaaggatacttttctaaccctttccccctcccttgctgtccccacttgtagttcccattgtctattgttcccgtatttatgtccaaaaagtatgtgttaaaaaacggttcatctcacattgactgtattccctactttatgatcattcagtgtagatggatggagtttccttgatggtggcatttaattatgcttacaaagaaatgtgatgaaaattcaggttaaaagagaaaatatatgaaaggaattttcttcatcaggaacttcagcaaggtaagtattgtgctgcaacagcatgcaatcatccaatatccacgtttattttctcctttctccctcattctacaataatgagaaaaaagcagacacatgtgattcctaatccaatttaaagttttgccacctgatggtagattgttatttttgaaccacatttagcaaaggacagcaaattgcactcagaattacacaatattcactggaatctgtatctttcattctaagtcgtttttctttctgcaattgttcacttgttagaagcaatatctgccactacttatatacatagaagagagcagctgagagtaagcattagttccacatcattaatatgagtattaataataataaaggaaaccctttccaaatggggatttatgtttgagaattcagtattttagtccaaaggaagaaaaacaggaaagtttttgggcaggcttttctctacatttttaatgatgcattgggggagggtgaggcaataagagacacagagaagcaggtggaagggaagtaaggagggatgagaaaagcagagtactgactgttgactgctcactgctgcctcccccatgttccccccccaccaccatttttaaagactcatcatttgtagctttatggaaaagaaactaatgcatctagagcagaaaaaaataaataatgtacttgtatcacttgtttattgctgtgtgataaaacactccaagacatctctagtcacgttgcgtgaagggtcaaggacacacagggtcacattcattagacgctgtgattgtgaaaacgtaccacagataatatatttccccaaaatattaataaatgcaaaagagaatcatcaatatttttaatttgagaaaactctgtatttgcaaatagttcaaaagcatattttaatcaaataattatactagaacttaaccattaaaataatcccaaatatgaaattagctgtttttcaatagtgaatcttgtgtaaggtagaaagacatttatatttgaacggttaaaattattaccacaagtcccctaatgtttcataacctaaggcatggatttggggagaaaatcaacaatttatagtgctaggcaagccaacaatgatacagtagtaagttttgatagataagaaattttgttggattctgaaatatacatgacaatatctgtatcctatcaactttatgaatgtgtcctatttggagggagaaaaggtatttaggagataaatctgacacagaattactgtctattattataaatgttaaattaaaaaaagttttcaaaataagtatctgagaaaaatgaaattaatgcctattttaaaacattaaaatacctacattttaatctcctaaacatataatttctttctttattctggcaacatccttatttacttactaagtttgtatcaatgttaaagccttcaattaaaaaaaagtaaaattgtaaaaagagcctgtcatcatgcgagtcacagtctagtagagtcaggaaagtaaattagtaaaatatgtcacgtcagatggtgaacgccaaggagacaacacaagaaagggaggtgggaagctcttctggtggggaggccttgcgattttaagttgggtggtatgggaagatgtcactgagtagatggtatttaaataaaggactaaacaactgaaaaactaagccttattgttccctgggacagtgagcatttcaggcagagttggaagagcaaatgcaagtaagtgcctgaggtaggcattcattggccaggtttgagctataacaggccagtaagacttgggttgagttacgtgggggatattagcagcagatgacactggggagagagcaggcatagaggtaggtagattgaatgaaactacaatggctaggtaagtctttataagaattttggctgtcatgtgattgatgtgagacgctatggaagggatttgaacacaggaataacataatctgatttacatttgaaaaggattattctagtactatattgaaaatagatggtgagtcagaaaagaaaggaagaaatatccaagccagttaggaggctattagagtaatcatatgagagaccatggtagcctatgccacagtaatcgcaacaaaggtgatgagaagtaatctggttttggaaatatttacaaggtttggaaggaagagctaataggattatccagtatcttggatatgggctatattaatcaactttaatttatgtggccatgacaaacaacctcaagtctttccccaaatgtcagtaatttacaacaatgagcattgatttcttgctcaagttacataaagcagctgtgggtctggctctgctcacctgaaggtcagcctggagctgcttgacttgtgctcatgtttaccatgcatcctagaatccaggctgtaggagcagtttctatcacataaatgctctattcatggcacagggaggggtgccatagccacagtgggcaatcttcttaaaagtcctgtggagttaaggcataagtcacacctggttacattctgctgccccaagcaatgtggccaagcccatgtggctgggtggggacaaacacttctcctacgggaggtctctcaggtctctttatctgacagagaagggagcaagcatttggcaagcacaacacaatcttcaacattgcagacaacagaaatcaaggcttttctcctaacaaactagaaaaatgaagtcactgtccaccgagatgggaaagacaacaggtagaataagtttaaaagcagacaaaaaattgatgataatatgaaactgtgatgtgatattggaattattttaaacattatcataaaaatttattataaaatgtagaaaatctaagttatcaaaagtctgatcagttgtacaagtgacatgaaataaggtactaggtcattttcatttgaagtgaaataaccacccaattcagaacaattaacagggggtaatgaaaatacctgtattcatacacgtagcccattttaaagtcatataattattattcacagatcatcagctacatttaagggatggtgatattcaagctgtcttgtatttcacatctctaagtgtcataaatatttccctttactatagaaaaagcaaaccagtatcaaatcgacacagaatgattatcaacgtatatatcccttgtgtagatgtagtattctgcaacccctgtgtaagtcctttttcacaacgctatatcatgcttcttacagcacttaagctgctggtacatgggtttctgaagaatgaggaagggttaatcagcttttggcagagatcagcaaaatttgcaagcattttagcctctccatcaagactcataaaatattttggaaactacaggacaaaaaaccaacccatccaagcagaaaattaaaaagcaatctgccagttcaatggaattcaacctttgctaggctgcaaatgatggtaaaatggttaaatattcattcatgattacccagagacataaagctacggtagaaacatgaaaaaaaaaatacatagactatgggcaggtgggaaagaaaacaggactaaattgtgcatcttatggagcagtgctgtttgttttcttttaacctgatttctatcaagatgctgaagaactgtagatttagataagatgaggaagaagagggggatcatctctccaactcctggtttaaaagggacactcttttttctttttgcattgaatttttgcctaaaatttccttttattatagacgtgttctctttttcttgcttgagagtaaaatattccacaaagtcaccaatcatgaaagtcaagaaatgtttgttgtattgactgttaatttcctaaaagaaaaacaaaacaacagcaatagttgaataagggaagactgagtttattaagcctgtcatggtaaagaagagcacacctggacaaaggagtgccttgaaaagggaagtcagaggagggtgtttacacaggtgcagcttctgggctgagtgatttttaaggcgtcttgcaagacagagcactggataaggccaggcagagtttagaacttaatagctttggattggtgagcacagtgtggcaagagtgttaaagtgattacatgagcaaggtcttaatcttgacagctaagctgtttacttggttcatggccttatattccagaagcaagcagttaaattatctttattggattcagtattgtttaatatagggtcagagaatggtgtccgtttcaatgttctgttgagagtttacctatcttgtgaagttttgggagaaaacttcaaccaagtttagagatatctgctccatgtcccaaacttcccagataagggagattactctggtatcattctctgccagacatcacatcaagaaataacagaagctgaaactggaattacattataatccataaaaggctgataacagaaagaagtattacaatgaccctgtcttcttcagaagatccaataaaaaggctatgcaagactgcagaagttactacctctaatttcttggcttccatacatatcattttatttcttttctggcctatgagtcccaaaatgtggcatagatattgactccaaagagaggaagtgattaaaatctacccccattggttagaagctggccattaccaatactcctggtatagcataaaaatgcctcaaacaatacggcatgcagtactgctctttgagggctagtgccaattaagggaacttgcatacttctgtttcttttatttttaacttactgttagaaaaatgttaactaaatttttgaggggaaatgttgtcattacagaatgcgtgtttcattatgcatatcctattggtgaataatttgcaaatcctcatttgacctaaggagtgtttgattgtcaagctttatatccccaaattgccatcaagcagataacttgtctctatcatttttatttttgatagcaatttttctgactctaagaaacctataaagcataattgttctaaaatatctccactattaatccttttagtctcattttttcagaacatactgaaacagaaatagtctgtcacctctgcctccacctgcttttcttcttcctccttgtacttcagagctaaggaatgaatacagaatttattctctcaggagagtgaaacaattgatccagtaattgccatgtcaagggttttggtgagagaagtattctaaaatcacaatataatgcaagtctcataaaggatttcctaaacagtatgttgctctccctactgaataaaatatacctcatcctacatttcctccttgaggtctaataaggagagacctatctggtctatggatttaacactctaagataatttactttggacaaagatctttggagaagcttcattatattttgaagtcattaacatgactcaagaaagtccccaattaaatgaagatgagtcatatgacagtaggcaactgtagatagtctctgcccctacattttgcctctgtagaaatattctttacattcatgggcttccataggcctgatgttttcctatttttgttgttattctgcttcattactgcaaatgtcagacctttaagagtgaggttattaaacagcaaaacacagagcaataggcatttgtaaaagatatatatccagggaagatgctgctctcccactgccagccatacaagctgaggcttccttctcatcactgaagaagacaaggagacaagaagcacattatgtcataaaggcaataggaatcttgcaagtaaccttttcaccagaaaacctctcatttgccctgccttgcatgtactgttcttgaatgatttattgccaaaatattcttgaatttcccatattgttaatttaatgttcttagtaacaaaaactaaccgtgggattgatataacagaaaattccagtcacctcagggcagaaattattattttaatctagccatgaaaataaacattttttttcaggaaactcaagtccttaaaaatgaggtgaagtgtgtctaccacaaagtgtcggcaagccagggaaagtcaggcagggtgttcaaggaaattaaacacatccagcttcttttttctactgtcttcttgtttagttcttctaaaaatcagttttgatggggagctctggcaaatgtttgtgttccgttagtttaatgtgatagaggaaaaaacattctggctggcagctaggctataaggggagtgctgagatttgaaacagaaaccacaatttataaaacgactgcaataagacttgtaaaacacataaattatagcaaaccacacaagaatcacagatgatctaagaatatactctttaacaccagctcatttagatctacatgttccaaggtaagaacacaaataaactaatctggcagaaaccatctagacttgtgttctaaagacaactgttccagtaaatcctctttatttgaaaattcagaccaatccctgctaaggccatcttatcaggtaattttggcccctaaactctaaaggtatccttccctgactctctcctttagagacccccccttacttcctgtgatatgcattctccctgtcaagcattttaataagtctgactttaactgtaatggtgttggttgctcttagctggaaggctttaacttaaaataccaggaagattagagagataactataagtaaaaatcatctaggttatgataaataagctgttgaattacatgacttgtttctaggatttttctctaaacatgtattaagtcaaactttctccaatttggagtgaagttaatgatatcttttaaagcttctctatagaagcagagagtagaatggtgattaccaaaggctgggaagaggggatgggagttggggagatgttggtcaaaggatacaaaatttcagtcaaataagaagaataaattcaagaaatgtattgtaccacatgatgactatagttaataataatgtagtattcttgaaaatggttgagtagattttaaatgttcttgccacaaaaaatgataaaactatgtcagataatgcaatgttaattacccaaatgcaaccattgcactatacatatacatatataaacatcatattgcacttaataaattttttttatttaaataagtaaataattttttaagaaaaactctccaggtgattctaatgttcaaccaaatatgagaaagtataagttaaaatattaacacctttcaataaaacattttttaaattacatgatgaattacatatataaaatggataggtccatggtgagtgactttgacatacataaacctcagtcaaggtataccccatacccaagaacattccctcattcccctttccattcagccccctcccataagtaaggattgtttttctagcaccatagattagttttgcctgttcttgaccttcatgtgagtgaaatcacacaccagagcggttgttaaagatgactgacatgagatccaaaaatgtcaacctagaatgaaagggcttcagctttgagaagctcttcagatacatttcactgtaataccctaattttccacttgagatcaacaagatcacacagctagttgatggcatagttgtgaacaaattcattgtttcctaaaccctctttactgatattccttctgtcattcatcaacatgttgataagtagcaactaaactataaacttcaaaatatatctaaaacctcaatttttactgcttctcctttagttcaggcctgatgaactacttaactaaactttccagacaaacttccagactggtctctgtctttagattcttacttatttattcattcattaaaaaaccactccttgggaattcatagtctaatgaacctcattttgcagtccactcctgactttattacacagatctgattatgaagtcttcattggttttaattatcagggttacaaatatgtgggctgctgactaaaggcaatccacagagctgatttttccttctcataaaattagtttaaaaattaaattacttgctaataattaaaactgggacaattctgagtgataatttagtaccctgagttttcttgaaacataagaatgtctaataacacagagttctcacttttcttctgtaatcactggaaactgaggagtgaatatgttctttagtttattacagctgcaacaagtgactcactgtgtttctgacaatgtggccacatgcagccacacttcatttatctgtcaccttcttacctatttaggcattttacattttcaccctagttttctgagatgaagtctaaattctttgtccaggcaagtgaggcctttgcctttaacagcacactttccgctacatcttactgaattatatccagcctaaaacagttgttcttccctgagtaacaaaatatgaatgataacactattttgattggaaatctaacaattttgcttttcttctcttttttcccccatagaaataaggaatagttgtattttcccttacttcttgggatggcatcctcacccccatgaggaaagataactaggatctcagttgattaggctttaaagttaataggaaattagagtctatatttaaagaacaagaaaagcagggcctttatcacaagaagcagagtgccttgaaggagttgatattaagcaggttgtgtttcttttgcctgctgagccgggctctagtagaccaatagtgaaaatgtggttcttgctaaggaagattgcaaaccagtctcagagacggataagtcactagatagtgttgacagtataggaatcatcacagggtactcttgtagcataggagggagtagtatatactagaggacctgccatctggactagaggaagttatttctaagtgtctgaaacttaggcctgaagagctagtacatatatgagtaagcaaagcaaaaaggtgtttaggcaggggaaatctcaaagataaatggatagctcaccaattcaaggtatctttggggtagtttaccatagtcacagagaagctcaggtaggagggagtatggaaagtcaatgattaggggatttggagaaaaattgagtggaacagaggtagaggatgaaatcattagcccttgcattttattcagtgtaattttccttctttcctgagggagtgggagttatcaaaatattttttggagaagtgtaggatgacagaattgtaatatcagctaccgtgaactgttcgaagttctctttgtaacacaaaaaaacaaaaactgatttattcatagtttattttttaaaaatactttaaattctgggatacatgtgcagaacgtgcaggtttgttacataggtatacacttgtcacggtggttggctgcacccatcaacccatcatctacattaggtatttctcctaatgctatacctcccctagaccctcaccccccaacatgccctactgtgtgatgttcccctccgtctgtccatgtgttcttattgtccaactcccacttatgagtgagaacacgcggtgtttggttttctgttcctgtgttagtttgctgagaatgatggttgccagcttcatccatgtccctgtgatcattaaaaagtcaggaaacaacagatgctggaaaggatgtggagaaataggaatgcttttacactgctgggagtgtaaattagttcagccattgtggaaagacagtgtggcaattcctcaaggacctagaaccagaaataccatttgacccagcaatcccattactgggtatatacccaaaggattataaatcattctactataaagacacatgcacatgtacggttattgcagcactatttacaatattcagaggttttatggtaatattggtaaacaaatatagcaaatagattttaaaaatgaaaacaatggatcatgatatattccacctcatatgatcagaattcatttagaaatgggcttcagggggcttgtggcattcagagaaggctttatataagaaatggaacatcctcctaaaggaaacatgggtgttgaactacagtgagattgggggtaaaacatttcaagttgaaaagtttgaggccatggtatgtgtatttgtgtgtgtagcttagagggaagactgatgttgggagattctgaaatgtgactgatagctaataattttgaaattgacttggtagaaaatttctgactcttcttaagcaggagagtggcctaatgaaaataatgtttggattattgcgtgtggcattcaagttttctagaatgcaaagattggtattagcaagagctgttggatggatagcaagatacactaccaaataaataatttagaaaatttgaaggtacaaaacaccagtgtaaacaatgtttccagagttgaaacctgaagctcaggtctccaaatcactttccctgtaggaggagtgaggaaatcagttttccttgtaatagagctgcctccccttctattctttctacttggtaccatctaagttatacttggtctcagaaattatcataacaggttgtattactccattctcacactgctgtaagggcacacccaatagtgggtcatttataaaggaaagagatgtaatggactcacagttccacatgaggggaggcctcacaatcatggtagaaggtgaaggaggagcaaaagcacatcttacatggtggcagcaagcagaagtgctgagtgtaagtctcttataaaaccatcagacctcgtaagaactcactcactatcacaagaacagcggcactggggtaactgcacccgtgattcaattacctcccactgggtccctcccatgattatgggaactacaattcaagatgaaatttgggtggagacacagccaaaccatatgagatcattctaacagtaataggtatctctgttgatgtatccacctgaagaagagagggagacaggcaggggagtcgtttaggtcgtaagcacttagtgtgacttttcagccacggtgtaagttcgagtgtgtccaaaggtctgaaagcccaaatttcacaggtgtacagaatgtgtaggtttaccaggacttattctactcccaatggcatctttgttttgcataagagtctggtattcttataattcttttcttttctattattttgagactttaattaagccatagagtgtaactgtaaattcatgtgacctgaaactgtaatttttattatgtttcttcttaatttacacattggaagccattttgttttttaatttttattttttgattttattttattgtggtaagaacccttaagatctatcctcttaaatgtttaaatatataatgcagtagtgctgactacaggcacaatgttactccagacctccctgattttgcacaactgaaatttcatgcctgtttatttataacttaccatccctcttccctcagctcctggaaaccaccattatggtctttgatttggctattttaggtacctcctcccagagaaatcatgcaggatttgtctttctgtgactggcttatttcatttagtataatatcctcaagattcatccacattgcatattgcagaattttctttattttaaatccggatagtattccactgtctgtgtgcgctcatccattaatgaacacttaggttgttttcataccttgggtattgggaatgttgctgtgataaacgtggaagtgctaatatctcttcaagatcctggttttaattattttggataaatgctcacggtggaattactttatcatggttttttttttttaaaggaaccttaatacggtttccgtagcagctgcaccattttgcattcctaccaataccatgcatgggctccatatcctcacagacacttgctgcctactgcatttttttcaacttttattttaagttcaggggtacatgtgtaggtttgttacacaggtaaacttttgtcatgggggtttgtcatacagattatttcatcactcaggtattaaacctggtactcattagttattttccctgactctccctcctcccaccctccactctcttttgaaaggccccagtgtgtgttatttccctctatgtgtccacgtgttttcatcatttcactcccattcataagtgagaacatgtggtatttggttttccatttctgtgttaatttgctaaggataatggccaacgtctccatccacatccctgaaaagggtatgattttgttcttttttatggatgcatagtattccttggtgtatgtgtaccacattttctttatctggtctatcgcagatgggcatttaggttgattccaggtctttgcttttgtgaatagtgctgcaaagaatatacacttttgactcaacaatcccattactgggtatatacccaaaggaacataaatcattccattattaagacacatgtcttttgcttttttcataatcaccatcctgagagaaatgaggtggtgtctcattgtggttttgatgtgcatttccctgatgactagtgacgctaagcaatcttcataggcctttgggcccttgtgtgtcttctttggatgaaagtctggtcaagtccatagctcatttttgttgatgttattataaagttctgttatcattgttgtttttgttagtgagttggagtttcttatatattttggaaattaatcccttatcagatataagatttggaaatattttcccattctctaggttttttttttttttttcgttttgttaattgtttcctttgctgtacagaagctttttagtgtgatatattcccagttgtctatctttggttatgttgtctgtgctttaggtgtcagagtcatgaaattattgccaagacgaatgtcataaaagttttcccatatgttttcatctaggagttttctagtttcaggtcttaatttgggactttaattcattttgaattgatttttgtatgtgtagtataagagtccaatttcctttttttttttttgcatgtggatgttcagttttgtcaacaacatttgttaaagagactatctttacccaatttcctatctttggtatcaagccattttaacaagaattttaacactatacattttctgagagatgcatatgcttaggatgaacagtttaaattactaaattgatagcacatgccagattaagttctgttatgtctttactgtaattctttgatatttttaatatttcaagtacagatacattctaattttgatttaattctgccagagcaaaatgtatcttatttgtttatattgaatcaatattaaggaaatatttacacaaaaatatgatcatatattttaaatatctgtactgtaaggaaaatgcttttatatcttaaaagttattgaaaaccatgggtattattaggaaacattagtcattattttgattaatagtttaggctaagtcacttgaacccctgatggtgcctgtcagattgtggaatacacatatatctatttgcagcctctctgtcataagggctatgacaaaaattattatttaaaaactattttgagtttcacagaaggaggctataatttctataaattcatgtttatgtgactttgaagtagattcaaacaaatgttattaatatcaatttatcctgttaatctagggacacagcacactgatatttcccaagaaagagtaaaagattgaaaggacatcaataggtaaaaccatcatttgctgaaaactctttgccctgagaagcagaagcctgtcaaagtccaacacaaccatatatcaacctccctgtcaaggacatcacacctgcagtagaatcaacactgtaacaggttgaggatgaccttagtgttgtgctattgatttagtctccatgttgttattagtctgatattctaaggttcaatgaatttgatccacataaagtaagtatcaaaaagaaaagcgtggaacctaaaaagctccagtcaaaagcaatcacttccaggttttcaaacataaaaattaaagggattaaacttggattgattaaacttaggggaacgggactagtagatttgataattgtgttatttgaagatcaactgaatttttgcacaaaccttcatggccaatagaaatgagttgtgcccccatgtacctaagggtcaccgatctgcaacctacaagtagggtgacctgatttgcctgagactcttccggtgaccaaactcaactcatcattgacattaaaaggagagcttttaaaatatagatcctatgggcagcaattcagagttacagagtctaaccttatagcagtgaggtccattaatctgttttttttttttttttttttttttttttataaagtacccgagatggttttgataatatgggtgcttgggaaactctcctccgaaaaacatagagttcctgatttggaaatcttgctgcttaaataaaatatgtgtatatgtgcacacatgtgtggtgtctatttttccctttcctttttccaaaatgccaacaattatttccccctgtgtattatgactatagcttgtgcaattacaatgtttgtatgtatcacagttgattctaattaagtattaagacgttttatatactagaccaagaacttatttaagaacttattcctctctttttctgtttgcaatgatcagcatagagcctgtatatagaaggtattccataaataagctaattaataagacaagacacttggaaccattcagatttttaaacctgttccacaggacattgaagagaaatattcaggggatgcttcatgaatgaagtgacacctgaagagaatctggaatacactaaggcccagacagggaggagaggtttataagcaggagggaaaaaataagaataataccatgttgacaggcatgattgcgggaaaatttgtagatggtggaaagtgtgatttggtaacgtaaatattttagattcttcaccaaggggcaataagatggcagtagagtcttagtaaggcacatgtgatcataatgaatatgtttggagtcaagagaagctggtataaggaaattctggtggatgtttacaccatatagtacgaacgtcctgctcagagtcaaatgatttcagtttcaaaatgtgccatgttggtgtgctgcacccaccaactcgtcatttaacattaggtatatctcctaatgctgtcccttccccctccctccaccccacaacaggccccagtgtgtgatgttccccttcctgtgtccatgtgttcttattgttcaattcccacctatgagtgagaacatgtggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaacgtaccctaaaacttaaagtataattaaaaaaaagaataagaggccaaaagacactaaaaaaatgaatgaaagaaacccatgccttatctcttgttatataagtagtgttatttattttctggtctatgtatgatttataccgcaggaccacatttgtacagagtccagctcctgagcaagcttttgtggtgggcagcatatgaccataaacaaagcttatttttctccttcttcccatctcttttcttccctcttttccttctccttccatttctccccaccttttcagagaacgagactgcattgattagttctgagttattcagctcatatgatgtaatcattttaatgtatgtgatgagtaagatacaatctcctcaatttcaactacagattgctgacataatgaaaaaaatatatttatatatgtcactggaaatagataaaaaatgcaactgatataagctgggctcatgaagggtcctataatactctgtggaattcacaccattctaacagccatgaagaaatactgaagtattttaagcaaagttgcaactattattatatattcattatagctttatcatgcctaaatactattgtataaagttttcttcccacacgtcagaaacaataagattctgaaaaatattataataaagttattcttctgacaaatgaatcctagagaaaattccccacctgcaacagttccttcctcagttttctctgactcaatacaatttcattcttttcgttttgcagctcaaaaatcttggtgctatcattgtctcttctcagtttctctcttagacctaacgcattaacttcacactactttcaaaatatattctgggttcgatcacttctaaccaaccaaatttaagctaccattggatttttctcacctggattattacggcacacctttaaattcctgtttttgctcctacccacaatatggtagccagaaagatcctgttaatttaagtcagattacagcacttccctcctctaacgactttccttctttctttcctccccctaacgactttccttctctcttagagttaaaatcaaatgcacttattgtaatgtatgagacccctcttggtttgtgcccccattatctccctgccttcatctgttttgactcttcccctctgctctctcctttagtcacatggtccccttgctttatgaacatcctggcattctcccgacattgtacatacatgcaatgcactcagcctgaaaagtctttcctcagataaatgcatgtctgactccctaattcccttcactcccttcctatcttcattccaaaggccactttccagtaaaggcttactttgccgcactgtctaaaattttaccccttctctccaaaactttttcatattcccaattgtactatgttattaatttggtgcaaagtatttgtggtttttgataataattgtgaatattactttctctctactggagagaaagctctttgagacatgtattttagtctcttctgttcactgttatatcccctgatatgtcagtatctgatacataataggtactcagtaaacatttgtcaaatacatgaatatatgaaattatgacaatatttgaaataattctaattatatttgaaatgctagaacatatatttatgtctattcttgaatcataacatagaagaagtctatagaaaactccattcttttatttcttatataatctatatattggattgttcttttgagctctgagaatatcaaattaaaagtactgaagtaaatactaattagtttctatcggtacctttatttgttctgaatgtttctcacttgatgtttagtgttagatatataccaagacaaaattaaataaaatagataagtgtttttcctataattcatcctaattattcacatttaaaatttagaagggactttattagatgcactttttatctatttttagataggaaaggccaatttgcattctcttcaaggaaataattggtattcataaaagttggactaacaatttcatttacatttgaaagaaaattaaaattaatccaatgtaggatattatacaaagattactatgcaaatatatttttaaaagttgctatatcacatagtgaacatttcaatggaacattctaaaaatgttgaggttttgtttcttaaaaaaaaaatacattcatacgtaagtgtgagctcttctcacttccataatagaagtgagaattatgctgtctgcgtactcatgaccggcatagttttccacaagtgctggctttaataggtgaatataaaatgatgtgattttttcttttttactgacatgaacattattattgtgcctttggttgaaataaatacttgaaatgtttgaacacacacacagccccatataaaacagttaaaaagttgttcttttgggcattccatttgttggtcagatatctgtattaacaccgattcatatccctcaagctgatgagaatgcagtgtaactaacgttgaatctaaggccaaaaagtatctacaaacaactggagccttgctggaaccatttgaggccgccttctgacctcctgtctcggcatatagctctgccagtgctttaacttgaactagtgagatctgaagcccctaaaaaaatactcatttttatagcttctaacgacagtatttgtcttttgtgtggaaatcatttttcagcctcaaacccttagattgggttcatgtggatttcaaaataagttgtcttaaaaatattttgctccataataattaaaacccatatcaacacatttttggtaactatttttttgcaatccttcatattaagagaattgtaatactttttttaaaaaattatatgcttagccatttgtatgtctttcctctacaaattcctcaaaagtcccacatatttttttctgaaatctcctctattctctcttagtttgttgtgttatattgtacatggagatgaaggatggtataatgtttaaaagatttttggctttctgaggagtgtttgtttgacttatttgcttttctgcagagcagtggacacagctcacaggctggccgtgctaccagctcttgctattattcactgtaaactcggtgtgcagggtaccgaccacagacagctgcccaggcaggtggtgtgcactgcacagagtctccgaggtaaggcagcgtaagagccagcaagacctttttaacaaaataggcgttagccagggtgaaaatggggaaattgcacatatatagcacttgagtgtccataagttgcatttcacctccttttttctcactgaacctcataatcatcctgagatctacttacgtattatttgtcccattttccaaataaagaaaatggggtaaagagaggttaacttatttgccaaataagagatagtggatgaaatcttgatcctcttactacaggtttcttactcttccctcagcagctcagcctcctctattgctcagcaggcattgtggagtgaatggcacagacctctccattcataagtccctctttcccattttctttctccttcaaagagcactggtacagtcacctgaaaagctaaagatgcagtgtgacaactgctacatcagcaattccagacccaccttcccacaccatctcacccctaccttgaaaagaaacctttgctttagattaacattaattaagtcatgcattagactaacataagactttatctattatctatctaatctaatcttttattctatccatctatctaccatctattatgtatcatctatttactgaattatatatctaatcttctatctcatctatttatcgatttatccatctatatgtaatctactctgtatcatctgtctgtctatctatctatctatctatctatctatctatctatctatctatgcgatatctatcacttttcaacacctaattcacaaaaaagaagccatgagggagattgtagactgtaggagaggtacacttatatatgtaaacatttagagaacaataaaagactacaaaacaatattatgtttaatgaaattaccatccaaaaaacgtgtttgggtgagcaagtggtaccacatctgagggaaagttgattgtgtggtagaaaaacagagcctttggcatcagaaggactgagtacaaaccttggctctgccaattaatattgggtgacctggaagaacatgtctaacttctccaacatacacattttttttcttgtaaaagtgatggttatagactcttctaacagaagtgttacaaagattaagtgattaatgtctgtaaagctgaagctcagtgcctagcatacaatccactctcaaaaaagagagcaggtttccacacctgtaattcttaataaacttcattaaatagcaatgtctaattattttgttacatagcaatattttatcagcaacgtttattggattccaacaaatattctttcaacaaatacacaaagaaatggaatatttcatggttatacttttttctattgtataatgtcagtctttttttttctcaagtagtaattaaaacttgctttgaaaaatactagtgtaacctaaaactactgtattccttaaaagtacttagaataaggagagggcagcaaaacaccacaggaagtataggggattgcatcccagacagacatggtcttggcttctggatctgcctcttggtagctgtgtgactttggatgaattgcttaatctcaccttgttttaagtgagataaaatggggaaaataatatttacctcacagttctgataggaggggtaataacataacgcatgtaaatcatgcagaacagcgtattatgataggtgcctaataactgttaattccccttcttctctttgttttactttcttctacttttctgtccctaatattctgatcataacacctccaggaacaaaagaagaaagacagaaatactaggacagttaagaagatccagtgagaaaaactcatatagagaagacaagattattgaaaattctaatcatttcactgaaactgatgtttccttgaaacaaacattacccataagaatggctgccatggtttatttaggaaacaaagtgtaatatttacaggggcagagaggacagcataagaatgaaaagagttagtgaaatctgacctttggtgagctggcactatttagtaaatctcccttgccttggtgaaagggattggcttccagtacagttaattccacatggaagagaaatataggagctttagccctgagggatattgctctataagcccaggttcttttcagattattctggttgattaaacacacagagaaataacccttttaaagttgtacatatattaagaattggagtaggcatataagcatcaccttacaaccgacaaaacagatttccaagcaacatacaatttaaattaatgcagttgtacgtaataatgattattttccaaatgatctatttgattggtatacatgctttctgactcttctcccaacagtgccatcagctgtaagggaaggattgtggactaaactcactcccgatatttagattatgaaggcaaagaaactatggagaggataagacaggaatttttaaaaggagaggactaagaagacaggggcagtatgtactatattgttaccctcccaggctggaggtgtggaaaactattataaaccgctaatgatcatttttttggtgttcgttattagaaccaatggaaggaaacatagcaggtgaacctcactgtattctctaaggtctttccagaaaagttgtgcctttataattaattctattgtctattagagtatacagttaagtgcatataccaaacttctttggtaaaatgtatagaattaaagactttcagggctgataagaggcccagtaagtcatacaggttagaattctcagaaagttaaaagccttatgagaaatttccattggctcaaatcagatgagaataaaacttgatcctacgtgtcttaatattcagtctaggagacttgccagtacccagtgcttctttattgactgattaaccattttctaactcactaattaggcaaaccagaatatttgtatgctccctgtgtgtgattgtctaggttgcaaattgagctaatttaattttgttgtttacaattgatacatttatttttgatatcctttggtagccttttgttagaggtgagagttatagttttatttcctgatcacactatcatctcatgttaaaatgagggtaaaaacacaacaatcaaattctacaacattttcaaacacttattagcaatgaaacagaaaatgtaatacaatctaccctgtaagtttaattaagtctcaacctttgtgttttttagtactgtgacaaactccgggcatgacagtttcacttagacagacatgacagttttctgttagcaggacctggttaccttgtagctggaatcaggccaaagcatcttctggaagaggttgctcataggacttgtggacattcatagcctgaggcaccggggtgaagagtggaagtgacactctaggtgctgggacatgttgtgcacatgacagaggccccacgtggtatcttagcaagtccacatgttttatgtcactcatgaaacatttcagtaatgagaaatcattgcccctctgcatgatgataatgaaaattttgaaggttattaggaatcagcatagctgatggattataagaacgacatctggcatgtactttttttttaaccactttatttgggtatgattgacatataaaaactttacatatttaatgtatccaactcaacaaagttggagataagtatggacccttgaagccatcaccacaatctgtcataaccctatccatcaacttcaaaagtttccttcttcctttttatttatttattattattatgatttttttgggggggaaataagaacatttaatataagaggtacattcttagcaaatttttaagcacacagcaccgtattgttaactcaaggtggatactgtatctctaagacttattcatcttggaaaaccaaactttgtattctttaactaacactatcttctcccatatctctcctgatcccacccctggcaactaccattccactctctgcttctattaactacttcagattcatcacctaagtggtaccatgtagtatttgttccgtgtctggcttatttcacttagcacaatgtctacaagattcatctctgttgcctgagtgtgggattttgattggcatctcaaatcctgacaatttctgcagtatgtttattgtacgagtttttcaaagatttgccaactgtcccataaaactaatatgcatttaaaataaagtttttaaaaatataacaaacaacaaagtttgagttgggcaggaggaatatattttgagatctactgcacagcaggatgactatagtcaataataacatattgagtatttcaaaataactaagagagtaggtttcaaatacctgaccatcatttcacattgtgtgatatgtatatatacatacacacacacacacatatatatcacattgtaccccataaatgtatataatttatcaattaaaataatattaatttggccaggtgtggtggctcatgcctgtaatcccagcaccttgagaggccgaggtgggcagctcacgaattcaagagatagagactatcctggctaacgtggtgaaacctcgtctgtactaaaaatataaaaattaactgggtgtgttggcgtgtggctgtagtcccagctactcgggaggctgaggcaggagaatcacttgaacccgggagtgcggaggatgcagggagccgagatcacgccactgcactccagcctggcaacagagcaacactctgtctcaaataaataaataaataaaataaaaataaaaagaaacagaaaaatcgaattattttatttcctatgaataaggcatttataaattattgtggaaagtgcctgtataacagaatattttttgaatatcataagtttgatatttatttcaatcatattttggatagatttcagcccattgctaatcatccattctccttgttttatgcaatgtcaaagaccacttcattttgctttggataaataagttttatttgatgaatgctgttgtcatttaaattacatacaaaaaaaatgacacaattacattaaatacatggaaattaaatgcccgtctccttcctacacacccacacacatttacatatctatacctttgtcatgtcatctcttcccacaaattataattttagccattttttctgtatttaaaatgaataattatctttcaccagttaaaacacttttatttgcttgcagaaacgtaatcattttctaataaaatagtagcagacactgcagtaaattctagccagaatttggttattatattaatctcacttcccatcactgaattcctttgcagggtaattagattgctatctgattctatcttgagtccaccaagtcaaggtgcaggcaggtggaaagtgtgttaaataagtgtcctgcttgatgggttctttttaatgccgatgagtttgtgccagtacaaataaaattatataaattactgtcaatcattagaggtttaaaaaagccaggttatttattatgatggtgtatatacatatatgtttatatacatatatatgtgtgtatatatgtatgtgtatatgtgtgtgtatacacgtgtgtgtatatataaatatgtgtgttatatgtgtatatatatgtgtgtatgtgtgtgtgtatatatatatatttggctaagagtttcttataagcatttcatacatggctaattatttctccagctttactatgcacagctatcaacctaagccctactctagctgatcatccctaaattcccttcagaatcctgccatattagagtaggagaaagagatgatacttttgtgtcaagtgagtagagtgagaatatgtcagttttcatatttatagagtgacgtttgacatctttaaagagaagttcctgaccttccctttgtctttttctaaccaagaaaatgtcagccacttccattgcctatctccagccgcatctagtacttctctctattccaaagcttcaacatactcttctgtcattatctgatcatctattggtcttcctctttcatttcaattcaagggaccttgacttatttctcatggttgtcttatcagaacagttcctgatgaaattaatttactgaatgctggaacaattccagccttcattacataaggaattcagtgaaaccttccttaagctcacaactctagtgtcaattatatattataaacacacaatcacaaacatttttaaaaacatgtctgcattataatgtcaaaggtagaaagaaattgcccatcatcgtccaggttgtcttgaccatccttaagagtgccttctacatttcccttccatattttctttaatgatagaaaattgtgtagaagacaatagaagaggaactaccccctctaggtcaataagacttttcaaccacccccaaaggtaatatctaaattgtacaaccagaatttacctgactggccagcatatataaaaggggccattacaaaagtatggcacacaggtcagaatagagatattcttctgaaacaaattacaataaggtcgggtacagtggctcacacctgtaatcccaacactttggaaagccagtgcaggtgaatcacttgagcccaggagttccagaccagcctaggcaacataatgagaccctgtctctccattttttagaaaaaaaaattagcagggcgtggtggcacacacctatagtcctacctacttgggaggctgaggcgggagcgtcgcttgacctagggagttccatgctgaagtgagcagtgattgaaccactgcactcagactgggtgacagagccaaaccttgtctcaaaacaaaaaatgaagaaactccacaaaatcacaatgacctcctcctccacagtcaatgatactagtggtgaaaatgatatgaaattccggcaacttttaaaaataaaatttattcctacaaatttttgttgtcgttgtttattgtttttgagacagtttctggctatgttgcccaggtcataatacagtgatgcaatcatggctcactgcagcatcaacctccccgggctcaagtgatcctctcacttcagcctcctgagtagctggaaccacagtcacacaccaccatattcagctattttttatatttttttagagatggggtttcacaatgttgcccaggctggtctcaaattcctgggctcaagcaatcctcctgccttggcctcccaaactgctgggattacagcatgagccgctgcacccggcccaaaaacatttttgaatctccttaacttgtttctaaatcaccactcttatttccactgaccacttaaacagatgacttgaattagttataaaactgctctggctgtttaatagatttgatataaaatacttttacattataatagatttgttttagatatgagtttttctttttgggaaaatgatattaaaataaattttacttatatttttaaaaaaatttctcattttattgatagggtatgttttaaaaataagattctagtcttccattaattaaaacttgtgctaaaaaattaaaaaggttagcctttcaattttaaataccaaatatagaaaacatacatgttaatttacagaatgtgtacttgataaaccaaacttaaattgagcaaggaacaacatgacgcattttaaggcaaatacataataaatgctaaaatgttgtagcaatattctggctttaaagaaatattgattaaatttattaagactgggctttgtctcaacacttaatggcaactatgatttaaaattaattaaattatgtttaacgctactgtgcatgtccttgaaacctcagtcaaattatatggtcattagctttcatttttatgataatgaaacaaaaaatacagtttccaaaatatatttttcactaaatctatggctaaaattgaatttaaatttctaggtttttttatttaatcaaaaaggaattttacaattcaatcaattgattgaaactaaaacttcaaattagggaggatttaattcaagcctgctattgtatttattattatttaaatataacatgcagacgcctaaactacacagcagacactctattaggttttgtatatatagaatcacacacacatactcccctagtttgtgagaaagtgctctaatattacagacacagattaaagtttagagaaatcaacttgtccaaggttacatagctagttgcacacacagaattttaaatcattcttatgtgactctaaaagaaaatacggaagtgaactgattaactttgcagttaagtttgcaggaataccctgggcaacacagaccctctgtcacagccaaatgttttgtttcgttgttgttccttaaatatgaccaatgctgtcaattctgcaactatattcttgcatttcctcatggctggaaggtctcatttttttttctgtcctttagatattaatcatcctttaaggctaactgagagccacatattcaaagaagacttccaaaccattacactattgaactatcccagcttttacctttctcgtttgggaacttagagactcaacttatggtattattaatactgcctatcctcagaccccagagacaaaacatgctgtctactttctcagtatcctccagagagcatgttatagaaattgacacatagaaatgatctagtcaatatttatttactaccagttgctggtacctggaaacattcttagtagtcttggttttcctggagtcctaatatagtatagtacagccagagacctgtttggttcacagaatttaagtaaacttcttgatcttacggtgtctgctagcatcatgagaacaggcaatgcaatatcttaagaccagttaaaaggaattagttttgagaaaagcttatagaggttacaccactttgcccttcacagaatctttcatttcagccacaaacccacattatcaattccctttataagctgtggatgacttgtcaggaaagatagtaacagtcaaccaataaatggaacattgtctccctaattcattcagagatgtttgcccatggagatactacctggtgatcttgccttacaacatcttgggcccagagatattgctgagattcttgtatttcccctctcatgtccagcattaatgtataagtcaaatacccatattctgtaaattctacacatctaccagtaggcaaggctggagatccaagttcttattatttaatcaactaatcagaaaggaagttctggctgatatttagaagttctgttaacatttcatagaagtaaatgtacaatttcccagaagaaaagtatcttgggaacacagagaccatctacatggacaaaagtaggggctaataatgatatgttacctcttgatattttagagaggcaacattgcttagtgcataagagtcaagacctgtggttgaagtcctgttcaactctgtactctcaatattaccttaggcaaataattaatttctctacacctttatttccttatctgtatctatatctctgtcggttgagttacagagagggtagctatgaccattaaactagatattttctggcacagagtaagtacttaatatacaaattttatatatgtttcatatatcatatataattatatattagagttgtatattatataacaaatatacattatataatgtagtttgcaaataaatattatataatgcaacatgtaatattatatagtatatataatatataaatgtagcatattatttaaaaattaaaaatatgtataaacatatatttagaatagcttacttcaattttatttgaggaactcattttttggctgtccacaacataaggagtaatggattattggtagattttcacagtctgattgtcttttattagatttagatcttctttctttccttctcatttctaactttattcagtttatagtacttagtagtttacaaaatatgtttacatatatcattgaatttgatactcctaagaaccccataagcaaagtatgatctcttattatacatattctatagataagaaactgagcatctagaagttaagtgactgctcaagatcacgtggctaggagtttacccaaagcctaaacttaggtcttctgatttctaatctagtgtttctcctactataatatttcagtctgctttttcctttcactctaaggcttattattttcactaaattcaaattgccttttctgctttgttaaatactagagttagacatttgtaaagttaaacacacacacacatacacacacacacacacgacattaagggcaagatatatacttccaaggtttctgagaggtacagcttatacaaggaaaatcttttgtaagaaattgtatagatctacttattcatgtgctgagtacacattttcaattttgactattggtataatttagagaaattcaattaaaaagaaaaaaataagtactcctctttaggcatttattctgttcacctgaaagtatattcatagccattttttttttgttaatgttaaataacagatccctttccagggatcctttccagggatccgttaagtgcagtccatgttagagttaatgaaatagtaccacagtttcagagataataaatatatgggggtaaggaactcacattgctacgcttttttattctgtttgaagtgatttgctttttgaaaaattgaaaatcagtggaaagctagtgaataagactgattagatgcagaaaaccacttgtgttctacaggtaaattagaaagtttgttgctacaaaaaacatcccttcgaaatgtaggcatacacaatgatttttaaagttgttagaagaagtctgcacatgagctgttcattttctatttagaataaacgatgtgagtggttttgactcctttctcccagtggcccatgccatacttcaaatatgaaaggaaataaaactgcaagctttaaggaaaagataaactctcatgcctgctatatttgcagagtaatcaaggattatggtatatttatcccatttcctcactcctcccttcttgttatttcagtcttcctcatcaaaacacttacttttcactgaatcctccaaattagcttctcatgcatattcaccggcagatcacacagtgactctgtaatggctgcagcctctttgcaattgaggcacagtgggccagacccccaccaggcaggttgcctgttgctggtgtaggctctgggaggtgaacatcagctttgttattccagctgggtgctgcagtccttgaactagcagctttagtcttccttaagatagcatcgtcgttttaatgagagtgaatgcatagcaataaatgctatccaagtcacaactggaattctcctaaggggagatgacctttcatatttttaatgaagatttatctttcaatttccatgaagcaagtggctaggtattttgttatttcatacgaaaataaaaggcatctcatagtaattttttctttgaaaattatttctcaaatttttagacttttagtggaagcgcttttatcttggaagattccactaaaaaagtagaatatttaccactttgggaggctgaggcgggcggatcacgaggtcaggctgaccagcatggtgaaaccccgtctctactaaaattacaaaacaaattagctgggcgtggtggcaggcgcctgtagtcccagctactggggaggctgaggcaggagaattgcttgaacccgggaggcggaggttgcagtgggccgagatcgcaccactgcactccagcctgggcgacagagcaagactccgtctcaaaaataaaaataaaaataaaaattaaaattaaaattaaaaaaaaggaaaagtagactatttacaagatttacaagtaacctagttggattataacccttcctcctgcaaatttatttttctatgatcctagaaaggtcttcatagtataaggattcttttggacttttgtgttggagataacagctaaaagaaaaatatccatcctctgacacacatacatacctcattgtatttatttacttatttattttttattttttaatgaacttatggcttctactttcatagcaactgactagaactacacaggaaactatagacagcaaccttagttatttcctggtttaagtgatgggatgtaatcatactgtatagttgtgaatagataataaaattgcatgacaaaaatgaaattgagaacagacttctgccacccttctgtaataaacagtataggaacaacactagacactagaatgataagaatgtgtcaggaatagcccaatacaggaattcattttttgtctgccttggcatactgcattctttatcaacaaaagttatttttaaaatgtcacataataataatatatgttgtccctttttttaatcttaaaggatcacatgttaaataaaaggaacaattagtagactatatgaataccttcaaagcaattttctaaaacaataaatgtagtcagatttgaaaatcaatcaatttaattatatttgaaattatgatagtaaaaatctatatagtcttaattattagattatagtttacctatcttcattgcatttgatgaaaaactttaaagtagaattatactttgatataatttagttttacttaaatttgttgttgcactaaattatcaagctatattttctttcctggttattctaagtagtgtcaagcacatatcagaaaacccactaaattggtactttaacttttaaaaacagtcttattagtgccatgtggtttaaaacttagcttaattcaaacagatataattttaacttaaaactttttttgggggacggagtctcgctcagtctcccaggctggagtgcagtggcgcgatctcggctcactgcaagctccgcctcccgggttcaggccattctcctgcctcagcctcctgagtagctgggactacaggcgcccgccaccacgcctggctaatattttgtatttttagtagagacggggtttcactgtgttagccaggatggtgtctcgaaaaacattttttatatattaaagtgtttttcaaatttgacaatgtagaaaactataatattttatttcaagaaatgtgtataccttaatccaattagcacctagattctgacctatgttggcacatagtatgatcagccagggcaccagcatcttgattacagaggtgattggatagatccacccatgtcaagcagacccaaatgttttcttttgacttcgggctttccaaaagatacagtagagataacagaaggattgatgaaaggctgaaaccacactatgaacagcatacgtaatctactattaaaagttcctaattagggtagcaacaaaaactttagtcagatctggataaggcagtatctctggctgtgttcttgtctgtttctcctcatcctttttctgttattctcttaatttcctgcagagaggtagacattttagtccacctattttgttaatacaaaggagcagtttctttatattgtcgttaatttactgatcgtataggattatcaacctctttcattgcttaatgttcaaattttaaaaacactttttcataaactatgcttgcttctattgctctaacaatatttgttcctatgttctactctaaattatgcaggtttaaaatctttctcttattttgctgcattcttgtgaagtctgcatacagattcttgattcaaaaaatcatggtttctgtacctcttcctcaggagaggttttacagattctactgatttttggtagacagaaaccaacttttaaccagtgtactacttggaaaaactctttccaaatactgtagaggaaagatgttgggctttgaagccaaacagacttgtgtttgaaacctggttcccatgtttccagctgtatgacaatagcaatttacttcctaaacttaatggagtaatatcgtattaatatttatcccaaggtgtgactgtttggattaaatgagattatctatgggtgtcccaaagtcacgcaaatcacaagttcccatcttgttttttctctgtggttacttctttttattttttttatttttaattatttatttatttatttactttttgagaaggagtctcgctctgtcgcccaggctggagtgcagtggcgcaatcttggctcaccgcaagggctgcctcccgggttcacgccattctcctgcctcagcctcccaagtagctgggactacaggcgcccaccaccacgcccggctaattttttgtatttttagtacagacggggtttcaccgcgttagccaggatggtctcgatctcctcctgacttcgtgatccgccctcctcggcctcccaaagtgttgggattacaggcgtgagccgccgcgcccggcctctctgtggttacttctaatgttggaagtcatcacagtgaaattctttgtgctatcttcaccatgggaatctttctgtttattccatgcccaattacatatatttcacatttcaaactttatcttgagtgaaaagaaagaaggactagctcctgatatattcctcatggatattctcataaaaatttgagtgtttcttttccagtaaagtaagttaatcctttccaacgctctgattattagctcagcacctctatggtattatagttctttttgaaaaatactgcaataattttcattttcataaattcagtggaaactgagttgctccaggtagggtagcccaaagctgactgacaacttcaaagctcacagacaagggcaaaaagcatgtgtgctgctccttgtgaataatactacaggaaaaaaaggcaaaattcctattcaggtaggtagatggtcaaaagagtttcctacaagacagtgtcacgtgcaattttatctacattgttataacttccctacctgacaagacagtgtcaagatttgttaatgagatggcctcacaagtgtatatttaaatattttatgaaaagccattgtagctttctatggatctgacagtagttaaatgcatgagctcccaaggcctatttcaggggctacgtgtatatatctttttccttccaaagacagatgaaggtgtgcaagtcactctactgatttgcaaggacaagaaatgtgctttttctctaattcattctgatattagctattggagttctctttgccctatttcagcactgtttgtacataaatacaccttattactacagaaaaaaattccatgatgaaacctgaagtgctttaatgcactggtctgtagacacagcccatttttttttttctctttacctttgattatcaaggagtaatttgctcaccagcaaacactggataatgtaatatataactttctctaacagaacagaatacagtgagtaggcatttttgaacggtctgttttgatattttggtcccactattctaaattttggggatgcttgtgcggaggtaatgcttaatctggtatcaaataattgctatctgcatctgtgctcattaaatatcattttttaatccagaattttttcctgtactaaggacaaaatgaatattaggccttagacatttttatgtgacatctaaaaattgaagcaggtatatctctaagtaaactaataatggttgatgattttcataataaatgtgcacatttaacattttcctcttcaaattctaaaggttggaaagtgaaggtgaaatcctatatgaaattgtctatatatgctataggttataaatccagattatcattttagattctgtatgttgacatgacatgtaagaactgatgttgtatgaagagtaataataatgatattagaacaaaatgtaatttcctatcagcaatgattagtatttaataataaaatatattaataattaaacattttgaatatagccaaaactttgaaataagaaatgaaacacttaggtaataaatgagaatttagtcacaaaatactgaagtaatattttagctaacttattagcatttagccaaataataagaaaatacttaggttccacttacctaaaaataaatctagtgatgtttccagatgtttagaaaatcattttctttaattaagagatagatacatttctgtgttgtaataaagaatgcaaggagatattttcttataaacctgaaaaagatgtcttctgaatattctggaatctgttttgactcatcggctctattagactttttagttaagtgtctgtttttaagaagatataattcatggtgtactcaaaataatactgttggcagactgtatatgagctgtggaaaggattgcaaactgtaatgggaagtattataataggggatctccactctgctcagatacagggaacatttgataaaatatttcttgaatgaatgattattttacataattattatctagtataatgctatgttttcagataaaaatattttatgtgaaaatatttttatcagaggtcaactttaacgccaccaaaaaattgaataaacatttttgttttgctttcatttcaggtactagaaaattaccttgcatatcattaatagtttataggacttttatttgggaggtagttttcaaaaagttatgatttttgtctagctctgagctctataccagcctctccatcccatgcaattttcatatgtcaacctattaattttgaaacaaaacaaagatgcattgaaatatttctaaatgtccattctacatcgagttctgcaggcgatagtgttgttgcataggcatttaaacatttaaaaacttttcttttctttctttttttttttttttgagacgcagtctcaatctgtggcccaggctggaatgcagtggcatgacctcggctcactgcaacctccgactcccaggttcaagtgattctcccatctcaggttcccgagtagctgggattacaggcgcccgccaccacacccagctaattttttgtatttttagtagagacagggtttcaccgttttggccatcccgacctcagatgatccccccacctcggcctcccgaagtgccgggattacaggtgtgagccaccgcacctggccaaaaatcttttcaataaaacgtgagttctgtgggttgcttggaaaaatatattctagggttctttgaatttaaagacactaagtactctattgcagtcttgaatattaaaactcaaattcacattcacattttaaggtttatgaaaagtcaaaaagtccagaggattatttagtctagacctcttaacctagagctgccaaaacgtatttgagcagaaaatctgttttctctatatttctgttgtcttttttttttttttttttttgtaatccctaaaaacatccaaggaaaggacattgaaaatccctgggaaagaaagcaatgcctcctgagtttgaagactgggtctcctatcttttttctttacagtctcagacttagggatgtctttctttggataaactatttacttccttcattttctttacttgatctttcataatgggttacattgctattaaccaaaactatgaaacatgaataaagctgagaaaaccatcagtcaagtaacaggaaagtgcgcatatttgcccatactatggacatcccaatgttcccagcgggcaggggacaaggaggacatgaacatattctccaaagccaggggagtttcaataacatttttaaagtaatatgttgccattatggttgtcaaaactataatggcactatgttagataaaacagtatgaaaagcaatatcataaaaaagtagataaaggatggcatgattttatgtgttgaattccccaagatatagtacatttgtttttttccttgtgaccttggacaaaagtaacgatattctataaaaatgtggtttgtataactggagttagtgtcaggggtaaaatgaaagttggaacaagcagaaaaagaactatgtatggaaaagaaagaaaggattgtttaacaaactggtgatatgggtttctgtgaaacttgtgtagataagctggaaaaagatgaatgatggaggagcacccaacaaatattaatatataatgtcaacttaggggtaaatatcaagtgttatgcgtctctttgggtccttcgatttctccatttcgtacagtgctttagaaaaagacacacagatgtgctctcctaagttttttgtttggttggtcctttttattttttgagacagagtctcgctctgtctccaggctggagtgcagtggcacaatctcggctcactgcagcctctgcctcccaggttcaagtgattctcctgcctcagcctcccaagtagctgggactaccagtgcacgccaccatgcctagctaagttttgtatttttagtagagacagggtttcaccacgttggccaggatggtcttgatctcctgacctcgtgatctgcctgcctcgaccttccaaagtgctagcattacaggtgggagccactgcgcctggccttttgttgtttttggttttggtgattggacaaagaactctggagagctggagggatgacagaaacattgcctgacagaattatgacccaaagcacaactcaagcatatcaagcgctctgagaaattttaaaatatcatattgaatagtgtttaaatgtgctgtcctacatttgattggaaaaggacacctgcataaagacctaagaatgatttagcggcagtgcacacaaagaggagtcagttatttttacttatcaagcttgcaacagcacagtgtgaggattttgcgttcctgagcctttagtgtcaaattttttgtgtgtaaatccaggctctgacattagctatgtgttcttggtcagtttcctaagtaagtgtttgtcaattaaatcttttcttcatagggtttttcttattttgttaaataggattgttaagtggattaaatgagataggtgtaaaaaaatgcatgttatattatctggcacataaaaaatgtggtttatttcaataacattagatgttattatgttgtcttaattgtttgtatctggaaactttgtttctggatacgccatttaacaagaaatagaggctcactggaacatgctaagaggaaggaagagatacctgtcctatgaggcgtgcttgacaggattcgagtctggagataaagaccatgtctaaatgtcattccaatcctgggattccatgattttagagtatttctccttaatcccttcacttctctgttctttaaaacaaaacaaaacaaaacaaaaataacacgcatttttcttcatagaattctgtgatgagttgtattggtttttgttttgttttattaccatacacacacgttcacgcacacatagagcaaaattatctaacaattccatttttgacataaagttaaattgttttaagtcaggcatgcaatattaattaataccaactggttcatacatacaaaacaattaggccaggtgtggtggctcaagcctataatcccagcactttgggaggctgaggtgggtgaataatgaggtcaagagatcaagaccattctggccaacatggtgagactccgtctctactaaaaatgcaacaattagctgggagttctcgtgcgtgcctgtagtcctagctactcgggaggctgaggcaggagaattgcttgaacctgggaggcggaggttgctgtgagccaagatcgcaccactgcactccagcctggtgacagagcgagactccatctcaaaaaacaaacaaacaaacaagcaaacccaaaaatacaacacagtttcttataaaatgtatgtgaaaacagaatctaattttgtctctctttttctttcttactttcttcttcattttttgaaaggagtgggaacagtagataatgacctactgattgacacaattgctagacttttatccccactaccagaggtggctacccgtgggctccaaatcctattctgaagcatcaggttgccaagcaagtttgcacactgcctttctttcttcctttttccccctcttgtttcccctcatacatttttgtgtcagagattgataagttttgacaaaaggctagtggcttacattaaaaagttagaaccccaaaagccttagcctatacaataactgttcatttaagctctagtgatacatttacaccctggtatgtcagaagaacttttttttctgtcgcccagggtggagtgcagtggtgtgatctcagctcactgcaacctctgcctcctgggttcaagcaattctcctgcctcagcctcctgagtagctgagattacaggcgtgcaccaccacgcccggctaatttttgtattcttagtagagacagggtttcatcatattggccaggctggtctcaaactcttgaccttgtgatccacccgcctcagcctcccaaagtgctgggattacaggcttgagccaccatgcccagcctagaggaattttttaaaaagctaacactttttagtaaatatttacttgtaattaattgtaattattggggaatagatttttaaaaattaaatacttagggctgatccaatcattacatttgtatatttaagtacatcccatttaaacttgtctattactatattaaagttattaaagcaagtgaaacaggagtggtgacttttctttgagggaattttaatactggtggaaaaggccagattgccaacttttaaaactgaaatatgttgtcagtgggaacaaagtttgaaagaaatgtaacacaattttattaccaatgtctctaaggcgataaaatctttctaaacttggtagaaaaatataagaatgcaacttcctagcagccacatggcagttaattttggcaatctgttttgggccattgtaacccacaaatatcaataataactgaaatggcttaaatcttgtctaccgaaaggcttacgaaaaaggaaaagaaaggagagagggagtgaatatgggaggaggtgaagatacaccttaatggtgattcaaggctgcagcatattctgtgtacaaataaataggcttcaacacctgctgatgtgctggcatctggcctgaaagcaaccaacatctgtttgtaattttcagtgggagcccatgacagtgaagaactgtatactgtcactgaatatatggccttgttaacatactaaaaggatccagaagtgagatcatgaatggataatttgggacatgtgactcccatgtgatacggtgataagatttgttgggttttctttaaaggttgccattagagttttatcctgaaccattatttaatagactttaaacgttggaaagtgctttctagaggaaagcttattttaaaagagaattttcccaaccagcttacatcttccacacttttaggggatatgtgttttattggggtagatatggacattgtacaacagctcaaatttatgtaacccccagtgcccttgggagagcccatggagaagaacccagagtgtgagcaggagtcacagtggggttggctttgagcctcaaggcaggtcagaggggtacttcaggagtcctcctcccctgtctctaaaaacgctggagttcttgtgcttcttgattatggctccaattgtgatattttaggcagtaactcaccgttttgtcacctttcctctgatacaagtgctgatcaagttggtaaactcccaggtcagaaaattggggaagactttcctacatttctgttgagggaaatgaggaactgaggccttagaatttctctttaccatttcctcataatcaggaaagttctagagatgattttgtaaaatagtacattcatatctatctcgatggatcatgaccatttttctagtttcacggattcagtgaatgaattctctgttgtaattatttttaggtgtaacactatatgtagatgattgataaaatgcctaactcctaagagtggtgagggctccaccataataactacacatgatacatcattacaatcaggctttcattcagaatttctaaatttaagaaatattacctattatttgataatcttatcacctgccatcattcatttttgcaaatttgaaattttgtatctaacttagattgctgaattagattagcctaatataataaattcttattacattatttttatttaatatttaaagtgaagactatggaaggaatttagtaatgcttttgctagttaaaaacagtatttagttaataaagataaaaacaaaaatattgttctgcacaggggtaaagaggtaggtatctgtgacttctcttttattggcagttaagtttttgcctaagtgctgagactagatttagagcttccttctacagagatttgcctacgtttacaaacatacacattcctttaaaaatatgtgctgcatttcctcaaaaatctaatttttattttttaagaagttcaaaatttaaagcacttctactgtgactgtagaacaaaatagtggtaataattatcaagaatccaacatgtagatttaaacaagctatcacagttttcatctaattagacttttaaattttttttgtttcgtgattaattttaaaatacgtattcagggaatcaagaaaattttcaacttaaaaaaagtggatttctctgtgaataacatacaaaaaaagcttagtataaaaataaaactcttgaatatctacataaaggccataaacaagatcaatatttgtaaagcaatttcctttgctcattaaaaatgcacaaatttaaacacattaatatttaatttcatttttaattataaagaatacaagtaaaaatcaagcatgttcatttttgatggcttttgaaaagtgaagagtttgaaaaaaagaaagtgaaaaaaagtgaagagtttgaaaagtcagtcattttgttttcattttttgactcaggattgcttgggagagataaggacatgtgtatagatacagagacctgggtatggtaagtagtgggagtagaaacccaggtcaaagttgttgcagcatagaagtcatcatccaactagtctccatagacaatcattttaattttctatgcctggttattaattattctaataaaattagttatttgttcctaatttctttaatactgactacttttcacagttttaaagtatcgctaagttatttttgcccattaaataatatttctaagttataatatattttccaagtaccagaaagtaaacccaacaacgtgaaattaaactgtgtaatcttaattgagtgagatggtagttttgcctggagccactagtaaatctgtacttctccaagtgttaattagtgagtctgtattcaattttgctcagagaacatttgaagcactcaatatttaatttcttattatacaatgtctgttgctagaatcttgtacctgcgtcttagacacatgcatgttgttcatcctcagctccagaaaaacacaaccttaactaacatacataagaatattatatgctgtttatttttcaaatgaggtagttaattgttttaagttagattgtgctattttgaaaagaagggattccgtaagaggttacagtacattcagagtacttaaaatttatttctactatattttcttgaataattactataagttggcattttctatgtgctgtcttttataaatatctcccaaacttcattttatctctgctttataaatgagaaaattaaagattcaaagaagtgaatctgttcaacatcatctaacctgtaagttctaagctccaggatatgaacttcaaaacttatactccttaccacatgttatgcacttataactgtgggtttgttactcgctgtagacagttagtaaatgtgaattaagtcagattttttttaaatccctgctccattaactcccctttcaattatttctattttcaatagtatgcttcctattattttccagatgaaaaagtcctttaaatattttttaacaatgtaaaacagatgggcaattccttgagacttgggtctccaaaattgtagctgacgtattttactttgtgtttatttatttgtctactaaatatgtttttgctgggaaaaaaggtctgtccatagtgatataaaatcactctccctagatgatttcattacatatttgatccaacagagaaatttcgggtcttgatacatttcacttgggaaggtacatagccaatatctgattccctctcaattttttttgttgttgttaaatattttctaaacaagtatttttttaattaagtctcaaacagctacttctcaaaattccattcctttctgagctctatagaggaaagatatgataggatctataaacctaaataagcaaacagccattagaaatcttaaagatggattgtattgatgataatatagacacctatacaccacgctccattgactaatgagaatgttataataggaagtgcctcagacctctttgtgtgccaaaatgccagcccactgagaagttaacgttatggtcaatagtgtttgcaaccctccagaaagctccgtaaattgaacagactgttaaccttcacttaagctttcacatcagtctaacgggtgctctgtttgctgctgactgcccgctagagactcactcattgaaagatatgtagttcatcattcatcatttcacaaatttggttccaggaaaagactaaaaattaccctaggcacaagctgtttaatttccaccccctcacatgaatctaacaaacaaccaaaaatacaaacgacattgagtagaaaataagatgtaagttttggtgcctcagtgtcatataatgtaaaggtatttatgtgaaaataacagcttgccttgaagtttcttagtgtacataatattgcagagaataacccctttcacttttaacccacgttctcttaaacctctttctgatcctatttcctgactcttacttgctgcttgtagaagctcatgattctacaattttagatccaaccaaggcagcaagctcaaaattcacccccaaacacactctttcccctcacctaaccaattatatttcctatgcttaaggcatgtattttcagtaagcagttaaaaagacagcatgacttttttattaaaccctaaataatcatatatagcttttctggtttattaatgtatagaataattctgcagtggtagaaatttaacaggggaattttatccataactatcaatttcatactttacctagataaccagaattatgtgacttgtttgttgaaagtaacatgcgttgtatgacttgtttgttttttattgaagtttgcatctcaaatgataatttaaagtttttgttagtgaaagtagggcagtgaccacacctttatataactattattaccttgattaattgctacattgtaaaagaaaatattttctacaattacagaatcctcagaacaactctgaaaacaaatgaggtattatccccaattaaaaaaaaaaaaaagattcaagagatttagtaagtacttcggcaagatctaaatatatggaagcaaattagaaacaaaccacatttttctgagctcaaagcccaaactattttctgcctatttcattatttcttctttcctggcccacactcctgtaagtgtatgtttcgtcttaatatatgatgtttgctttattaagtgcttgtaatgaagaatgcttgtcaattgagatcatatttaggaaatgttagaattgctgatttgttttgtgataaatattattaaaatgtaagctcaaggtaagctggatattttgtacgttttcatcaaagctttatccccattacctaggtcagtctgtgcctggaaaatagcagtgggtagttaataaatgctgaataaatgggatgtttagatacatttggccaagcgacactctcacctcaaatttgtgtgaaaaatcaccccaagaaataaaaggcaattagagacaattgaaaaattaattcagctgatagaaccacttgtcaaatattacataattcagaacaatatgactgaatcatgatgaaggctaaaattctgggtcttaagcaactttaaacctttcaaggaaaggctgattgacaaacacaccttctgtgtttaatcaatgccacaaaacatacggacccaagaattggtggaaatctagactcatcttcagaatggtaaattattcttgagttataaggcctccattgcctaagtgactaaaatgtatgtttccagaaagatttagcattttcctacaggttattatatgcaagaaatgcctttctccaacaggtgatagaaaggtcagaatcagccatctcctaagatactttattttattttgttatattgcaataatatgcaatgcttcagtgttataccaatgaaataaaatgataaattataatagcagtagctgagctttccaagattatacaaattaggtttagaattgaaattttatgaaaacaataatattttaactgcggatagaatattgaaagtgacctatgctgagagaaaaaggagaaaatttaggttacaaaaatatcagatgcattaatccaacataattttgtaaaatggttatcaaaggtcaacactcaatgtaatgtattataataaacaagaaaatgatggccatttttagcaaaaaaaaaaaggattatttgaataatccaattttattttacttagagacatttttcatataaaattagaatgaaatttatgttttaagctactttaatcatacatttttgttgttgaacaggatgctaaggtacagaggaaatcatgcttccaagttgattgccaaataatagtagcattgtctaaactcaactagaaattttgtcaatgcttttttttcttattgcccaaaatgatgcagtgagaattgataagataaggatattctgaccacgaggagtttacaatctagaaatgtggtcatatgcataaatagctgtaatacaataatgactatggcaacagtgaagaacaaaagagtgatctggcaataagaaaaaataagatttctgttccctctaaagaagccctttctagaactctagtgaaagttaatgggtaatcaatctaccatcacaagttaatgggtaatcaatctaccatcacagaaaaagtctagtctggagtgggtgacttcaagaaaaggtttccccatagcaaaatcaagtgtaactttccaaaggctttgagattatattttcacatctgtttttgtcgtttgcatgcatatagaatcacacatttatctctttctgttactgtgctatattacacaaaaacaactggttgggttttctcaagaggatattttggggtgacctgagttaaaatagaggttatatcatcatttaaattcactttgggcagccttagaagacaccccaaagacataggctatcatcctagagaatgctataactgctgataataagggacgtgccatagatattaagatgctaccgggagggaaaataaacagtgatttataacgcaagccctgatttgaaagtcacaaggtcagacacttggaattgcaggtgttgatttgtgatcaagaggtttttcacatggacaactctagaaagccttatgcagagtgagtaacagcacaaaggtactactagaatattggcaaaaattaacccaagcaatgcagagaccagatcactctgaatgtgtttctattttcatagatttcacctagtatatttaggttaaagaataaggcacaatgaaccttccctatctctaaaaaggaaaagaaattttttttgctttcattatcacttttctaaatactgagcagctcgttagtatcctcactctgatctataaatataaatataatattaatatatttatgatattaagtataaatattaaatatagccgtattaatatatctataatatttaatatataatactcattaatagataacgaggcaacactatggcattttgttccctatgttttaatatcttggagatggttatcttgtagtatgttgcagaaatgcgttatccccatgagagcctttggaatgtgatgacaaccatagtgtgggagccgacagagtcactgcttaggtgggaaatgtctaatagaaagaaaagaaaacttagaacatagctttgaggatcttgtattgaaggatggagaagacagcaatctgagaaagtgaccaaaaatatccaggagaaatactgggaggagtgtagggtcctggaagtgaaggaaagagaacgtctcatgaaagaaagggaagcgaggcacagtggatggaggcagctgttggaaacaccacttgaattacttgattgtagttcaatcagttttcaaaccccagtgagggaaaacctgagatgtctgtgggttgaggagggaatgaagttgagcatgagaatctgaagggagaaggaaggcaacgacggctcacagattcctcatcaccaaaggaggggaggtggatcagggaaggtttgggcttagctttttaacacaccattgcagctatttttaagacaaatgtaagaaactcagaacaagagatcgcttataaaataattgaaaaaatacatagtttaaatcagttcttataaaacattgaggtgacaagattaatataggtcttgttacatttttatttttccattgttaagtgtaatgcaatttatataaatatcagtttcctttagcattacttttgcatgaccttagctctatgctttattcatatatgctatttcatataaatgatataaccctttgaaattcaatttagaaaaataccctaaagatattgtgagccatatttatacacagttgtataacactctccttgtactagagctggttttacataacgatttgggattgagttccttttttatgaatgcatttttgaatgccacttctcttgtaggcaagtgtatgggtattgtatatttgtccctgatgtagattataaatctagatttataaggcatcattaggcctagcagcccaagttttcatatctatttcttcaagacaaaatatttcaacattactaataaatcatgaaaagtactaacataaggagactgaaataatttgttaaatgttatttttcaaagtaaaacaatttcactcctaggctttagagtcaggaaaacaaacaaacaaacaacaaacattgtttaaaattatgggttcttccatgttacactgatactaccatatgacaccccgagcttcagttttcttatctgtataatgtggacaatcatcattgcaccgaaagaattcagtcaatgctaatagagtgcctagcgcataggaaaactgtcagaagggtacctttagctgcaagtaatggaaaccccacttaagtctagcttaaacaactaggaaatttatttgctgacataatttggaacatgagctggggaaacagtcatgattgatttaaggagtccactttcctttccacagtggtgcattcctttatttgcttgttgtctttggggtaccccttttatgttggctagttacagaaatctacattcacatcctcgcactacatcattcatcagaagagagtgcattatttccataagctctcttgttgtagtaaggaagctttttcttccagaagccggccctgcccctacatttcccctgtgtctcagtggcctgaccgtgctcacttctgaagcaatcctaatggctaggagaaagccaagggcctattggccaatgttcttaaaccaattattgcaaaggttatgggattatccttagggtcacttttggggttgtaggctgggtcagattcttatgtatcactgtatgaagaagggaatgatactcaaaaatattagagttaaattttgaataatagtagggcactgatgaggcatcaaagtgacacctatatttaacctgtttggggccctattccttcacaccaaagaaggaaaccaaagcataagtcccatctgagccaattcagttcatgcgttgaatcacaatatgttggtggtcctaaaattattggcccaaagttgagtatcttggtgttttgttttgttttgttttgttttgttttgttttgttttttcggagtcccactctatcgccagactggagtgcagtggcacgatctcggctcactgcaacctctgactccctggttcaagccattttcctgcctcagtctcccgagtagctgggattacaggcacatgccaccacacctggctaatttttgtatttttagtagagaccaggtttcaccatgttgtccaggagggtttcgatctcctgacctcgtgatccacccacctccgcctcccaaagtgctgggattacaggtgtgagctaccgcacccggcctaaacctgagtatctttgctctctatcattcccattttcagcacccgagccttaaataaggtaatggaataaaatgaaaaacttgtgcaaatgctttacaacatagttaggtaagtttatctgaaaagataaactaatttcctatatatgactttgttacattattctcctatgagtgtcaagttattttaagaattcagagttacctattaaaaataaaattgacgagttatcaaaataggcctagaaatttagaacatggctaaaactcatctgtacgaaagaaggaaggaaggaaggaaagaaagaagaaagaaagaaaaagaaagaaggaaagaaagaaaggaaagaaagaaagggaaagaaggggagggaaggaaggaaggagggagggagggaaggaatgagagagagagagaaagaagagagaaaaacaaagaattggggtggtcgtgtgcacctatagtcccagctactcaggaggctgaagtaggaggattacttgtgcttgagaggtggaggttgcagtgaaccatgatgatgccactgaactccagcctgggtgacaaagtgaggccctgtctcaaaaaaacaacaacaacaaaacaaaacaaacaaaagaaaacaaagcaaaattacaagctgtaatttcacacctgtggtatattttattttgcttaaacaatatgctttaataaatatatattgaaatgacagaaaaataatattttaaaatgtatctgggtctacacattaagatttagtttgcagtattccaaacatcatttaatggaattaaataaaatttccaaatttataaactaaagaagtgctgctttcttatgaattcccactctaaattcattaatttaagatacatgtggcctttctttgtaactttaatatttaaggaaaattcagaatacttagcctcatccttaatcaaagtgtaataaattacaaaccccaccaaaatctctacctactgaaaacttctaaaggtaggagagagtatagagcctacagctgactccctacaatattctacatagcaaagtgaattaatattaggcttaacataaagcatctgttttctaccattgacatttacacacacatacacacacactcccccacacatatagagtttgttagggttcaccaaaggtaattaaccatcagatgtatattaatcacacacacataaacatgcacacatatgtattaactaacacacacacatttacaacaaaatagtagacagaaaaccattataagtgcagtttggtaactttaaggacctttgatgagaaatttcaaagttggtgacagttcatatgaggaagggtttttcctctgacaatcagatgagctaattaatcagcatttgacccggctggatcttagccagcctaactgttaatgagtgtgcactgttttgccagcaagagcacagtctcttcaaaaaataattgtcagggtcatttttgctatgaacaaaatcttattttgaaatgtgctagacttttttaaagcaacaataagaatgacacgatcattcttaaatatttcttattaaatattatggtaccaccaaacatgagcattgttttatttttttttttttaacaaactcattgctcttcatttatagttttacattttaaagtcatatgatgagaactatttcttccagtttgctttctgctgccaccagacttgataccacaaaaggtgtctgggtgcatgcctgtgatgatattgccaggccgttcctttcttggggcctgtgtatacatgggcctgcctttttattagcacctattataatatatggccattaattattagctgtacatattttctactagactgtcagctccttggaggtacaaaacttatttttctcatttgtacagcctctccgatatcttttatcaacttcatgtaatcctgatagctcagtgaggaactgaggagtggggtcccctaagaaggacataagtctaatttttaaagactaggtgtagggctgcagcttggctctcagctgtgtatgattccaaacaccgaagtatctccacgtcatcaccttttaatcacattttagtgtgatttataagcacatatttggaataccaccacaaacacacacatacaaatgtcattgttatttatatgcacgtatgatggtaatatatatgtctgcaagtttgtgtgtgtttgattaatatacatctggtgattaattttctttttcatttttttttgagacggaattttgccctaatcagccaggctagagtgcaatgtcatgatctcagctcactgcaacctccacctcccatgttcaagcgattctcctgcctcagcctcctgagtagcctccggattacaggtgcacgccaccatgcctggctaatttttatgtttagtagagatgggggtttcaccatgttggccaggctagtcttgaactcctgacctcaggtgatctgcccacctcagcctcctaaagtgctgggattacaggtgtgagccactgcgcccggcctgatgattaattttcaaacaaaccgtgtgtgtatgtgtgtgtgtgtgtgtgtgtgtgtgtaaatgtcaatggtattagaaaatagatgctttacattaagcctgctatggattcacgttgccatatagaatattgtagggagtcagctgtaggctctatactctctcccaccttcagaagttttcagtaggtagagattttggtgtggtttgtaatttattacactttgattaaggatgaggttaagtattctgaattttcttcaactttaaagtacaaagcccacatatatcttaaattaatgaatttagagtgggaattcataagagagcagcacttcttctttagtttataaatttggaaattgtaattaattccattacatgatctttggaatactgaaaactaaatcttcatgtgtagactgagatacaactttttaaaatatttttctgtcatttcaaaatatatttattaaattaaaatacagtctttaaacaaaacaaaatataccacaggtgtgaaattacagcttattatatgtatttttttttttttaaatttactctgtcaatcaggctgaggtgcagtggcattatcactgctcattgcagtctcgacctccccaagctcaggtgatcttcgtaccttagcctcctgagtagctgggactacgagtgtatgccaccacacctggctattttttaaaaatgttggtagaggtaggattttgccctgttgcccaggctggtttccaacttgtgggctcaagctatcggccggcctgtgcctcccaaaatgctggggttacaggtgtgagccactgtgcctggcccacatatgaaattttgaaccaacaatcttctgagctctttttatagaaattgatgtaagatcacaattatttagtgatctgatatattttagctgctgtctataatatttggaaaggatctgcaatattaaactgctttacatttcagttataaaaaaaaagttaaaatttcatgtcactataattattacaggtcacctcattcactgtctttccttttccttagcatccttagatagccacagaacatttccttaaacatttcttgttacttatttcacatactcacaagttcccccattccatttctagaaagcttttggaatgttttataaaacagtatgagcattattgctgtaagaatgctattgaaagtggagtgtaggtaggcttactatacaaagtggagtgtaggtaggcttactataaaaaacaaggtatactaaaacactcactgctataaaaaacaagcctcaaagacacatgcacatgtacgtttattgcagcactattcacaatagcaaagacttggaaccaacccaaatgcccatcagtaatagactggataaagaaaatgtggcacgtgtacaccatggaatactatgcagccataaaaaaggatgagttcatgtcctttgcagggacatggaagaagctgcaaactatcattctcagcaaactaacacaggaacagaaaactaaacactgcatgttctcactcataactgggagttgaacagtgagaacacatggacacagggaggggaacatcacacattggggcctgttggggtttgggggataggggagggatagtattaggagaaatacctaatgcagatgatggattgatgagtgcagcaaaccaccatggcacgtgtatacttatgtaacaaacctgcacgttctgcacatgtatcccagaatgtagagtataaaaaaaaaagcccccaaatatataatggaatgttgcaatgtaagtttatgtgttattcaagtgagattaaaaatgtgtgttcctggtttgcagaaggcaccctccacatgatagaggaagcagagttttcctttggttcctctgcatccacatagtataccaggaagagaaagaatagaatagagcacaaaagagattttcatgagcttttgtagaaaaagcctgagcccctttcactcacattactttggccagaactcagtcttctgactctgtctacggaggaatgaattttagctgtgtgccaggaggaaagaagaacaggttcatattagctttccggcttcgttgtcttctcacattttgttcccaccacattgacttttctgtttgttcgtttgttttgttttgtttccagaaggcactacagggtcatgccacaagttgtttcttctacaaggaatgcggaatgcttcccactttatgcaggttacccagctgacttctatttttcatttaaaactcaattcaaatatttagttatcaggaatgtctgctctaatatgatacatattattattcataacacacaatttcaacatcagtgagaatttttttgatgaatgtttatctcccgaagtagactgcaagtttttaatgacaatgatcatgcctgtccaccctccattattacacagctcctatcaaagtcaatagaatatgaaattatgtttttaattaatgaaagaaaactccaccctccaactcttaatgacagtacaggttgagcatacctaatccaaaaatctgaaattcaaaatgcttccaaatccaaaactatttgagtgccaccatgacatcacaagtggaaaattccacactggaccttgtgtgataggccgaagttaaaacacagatgcacaacacaccatttattcagcatccccaaagacaaagagattctctcagcctccctgagctgtgatatgtttctgtgcatgcccaggtttccccatgcaatcacgcccacaaatggtatcacacagcatggtaggcagagactgaaagcttgccattcttgattgttgctgttctttaacagctgatacaggtattctggtgatgctactgtgttagtcagttatcctggacacattgttttttcttatattaatggtatgttagatttttttactgttaagttctgacatgtgactaagcataagaaaatgcttgcttattggtagcatataaattcagagtcaggaatgatagtgagagaaaacaaccacagagaaaacagtccacaggtgtggctgagatagtgatgcctctgctttctgatggtgcaatgtatacaagctttgtttcatgcacaaattatttaaagtgttacataaaattaccttcaggctgtgtgtatatggtatatataaagcataaatgatttctatgtttatacttgaattcaatccccaagatatttaattatgtatatacaaatattccaaaatctgaaacactttttgtcccaagcatttcggatgagggatactcagcctgtactcccatacaatgaggccttaaccacagaagaaaacaataggttcttcaaagaaattggttgtgacatttaaagggtcaaaatgggtggtaaatgtggaataataattgagaaatgtaaaataattgagaaaatagccaagaatacctgagtatgaaaatagatgtgaaattttagcagtctatcaataaaatcttgatcaaacaccacttattcagctgccatatatgagtgtcaatgaggagactgtagagcagttagcatgatttttacattcagtttattaggtagaagaaaccctgcatccattgtcaacattcattctgaatgcaatgtcactatctattttattggcttctttttcccaatgcaatatttgtgatgaagtgttccccaagttatgcttttatcttctttgtgtccatctaattctttgtgggtgatgtccactactctgacagcatcacctatcataaaatgctctggatctataattccagtcctgcctgagtcctgtttctgcattttctttgctgatctttactcaaagatgctctgaattcctctgaaacttaacctgcctcaaattaaatttaggataagacttctccttttcaatatccttctcctccagtattctctgtgttaattcagagtatcaccatccatcagttatcaaagccaaaagagtcatttttcatttcctctgacccatttgccatgaccaagagaagaaagagcttcagctcctgagcctaggatgtctgtttttgccaattatgccaatccaaatccggctgtcatgaaacctggatggaaaaaacaaagccagtgccagctctgttcagtaggatggaaaatctctgtggcttggtagcctcccaggttcctacagagaaggttcattctgagatgaggatctctgtggcatatggtcttcaggaggagaatatctatgagaaaagagtctccctaaaccagaaaaatgagaaatgcaaagaagatctggacaaggcagtggtggaagtgtcccctttagatatttggttagtgctggcattactgcctgtggaccagatggtcccaaagttactacacactgcactgtatgcctgcctgctttcctgcctgctccagagtctactgagaagctgtattatttgtggatgtatgtgacacagtctctgcactgtagttataagccatgtgtcgctccaattcctaagaatccagtcattccagagattactcctcatacatgaaaatcctccagattcctactttctgataaagaaatattattgtgaacagatcagaaccaatgtaggaattcaacctcaagttcaaaaaaatcatcttctagatcaaaatgaggaaagactgcaatttaccattcaaggcaaaaatatccatatattgtaccagacacctattaacttcaataaggatggtcccaggttcaagagtgaggagaagagacccacagccagtgaatgaaacatggggtttatttgatggggacatacgggacagtccagtggtggcaggctggacagaaccgctacagcttgcaaactgcatgcagtttatgtagcattttcacttagcaccctctccttagcaacctccaggttaacaattcatttcttaagttgttattgctttcaggtatgtctgccatacagggtcgttctcggggtatgcttaagttattgctgtcaggtacatctctcataaaccatagtaatccagaccaagactgctcccttccacaggccaaaacctccaacttcatctttctctgtcccttgcaggggtatagttaccctgtttactatgtttattattattattattaatattattattattatttatccctgactggtgataccctgaaagtcttcccacctgagagcttggttattgcttccaaccccgggtgaacccctaagctagaccagtccgttagtgaccagattccagtgaagaagggggcagttggcttgcatatatggttcatgttgaaccagcccttcatgttcctggagctcccactaaggggatggagaagggatcaggaaagagggttgaatgaagaagagaaacacgtataaatgtaaaaacatgcatctgagaaaagaatcttagccccgttcttaaattcagaactctatttttgtgcttttaaacctgtcagtcctcagcgtcactccctccaccactgccatctcagccctgaagcttcctggtttcttcacagaacaaagatcagtacttggaatgtggcaagtactcattaaatgttttggattgtgcaaaacagtcacaatcaattggtacctctctattaatgctcccccacctctgtatctctgctcatgctatttctcatttgcaatgctcatccctccttatttctcctttgaagttttattaatctcaactgaaaaaaggttttcttcttgaccaaactccaatcaggcttccctgaactctttttcaactaggcctgacttttagacgcctgtgtttgtgtgcattgtctaattgcagtaagaatcttgcagagttggtttaattttagcaagactcttgcagagttagtttagccaggttctcccatgcttcatatctgatcaccatcaatatctaattgggttccccaccctccactatcctccaggtgatgtgaagggaatgatatctgatgaccctggcctgtcttcagcaagaatcctcataggttagtttaaacagaattcctccttacttctaatgtttcttctaagtaattttccatccactgactcacatcgtgctttttggctgtaattccccctcattcatgctgtatcaggaattgaacccagttctgttctgaggtcccttttaccctattgcaataatactgaatagaatctgtttctattgccttaactaccgtccagttctaatgttatttgatacaataatccatcttgtcatgttccatatgtagccttccaggcttttccagatgagcctggcttggtaatcattatctcttctaggatcttacagctctatttggtgtttgcacgtctattactttattctataactgattttcttactagtgtttacacacacacacacacacacacacttttcataaatgtgactccctataacccaatatacattttggtatatttggatcattgagtaaatacattaaactttttgttttcttttttgtctcaaaaacttacaaatcatctggcttttaggaggtgatttgtacacaaattacataaaaagtgaatttctttcatggtgttaactgttgagaaaatcttacgccaaccttttcaggagccatggtggttccgagatgctttaaaaataaattaccaatcctctgtaattttgcgtcctctcatctcacctactcataataaatgaagagaagatatgtcatgcctcacaggcaatcatatactgataaatatttaatgactggctctcaaaaaatattaaaaataccaatttgtagtgtttgctgatttttatgatataaatacacccaccatgacagatgcctaattaccaacatgacaacgctgaccctggagttaggaagaggtgtgtagtgacacatcatcatatctttaccatccatatatgatagctgtgaataaactcgaggacataagtcatagtaaaatccaatttttaatgatggatatgtttaaccactggcttgaaacttcctgatatttaattataagctctcaaccactgtgtgggttggctccagcacatcagaaaaatggattgcagcatattcagattatataatcactctcagtagcataacaaggatattacttggcataaaaatttcataaattgattatagacccgtgttatcaagaaacatactctatatattatttcatcactagtgttccttgaaactgaattttacaaggttctaacattgtcacatgcctcaaatcatcctccaaagatactaataatctagttattgagttatataaatgtataaggaaggtacgtgggaaaaatatataatagtatgaatacatggaattatgttgatcatgaccattattccttaagaggaatattatattttcagaaagatttgaagaacttaaagcttatacctccagtggcccactaattcacagtctaaaatgacagaacatgataaatttcaatatcttatacaatttctcatagcctctggcaggagcaattcttgaaacagtaggtggaaatatactcattaagctgcaaaattgcctatattcaggacacctgccaagcaagcattccctaaattaccacctgttaccataacatcaaagacatccaaaatacttgcttactaaatctagtctccctaagtatatataattttcctataatgctgcttgatggtagagcagtatcttaatttcatatacataaatcaaagttgtttctggacagctagggctcgaacctggttttcaacagctattcctgaggtatagttgatctttagtgttctatttgatgttgagttatagtcacactttttaacttgtccaggtgtaaatggtagttgctgaggcctttatataaagcaaatttactatcactgatacatgaaagaaaatcattttactgatattgtagcactgaaagttgtcaatggattatctaagatgattagaagctgtggataaattagtagtaggccaatatattttgcttgagatcatgtgtcaatatagcagcatgctccggagcagacatctataactaataatcatataaattctgctatatatgtctatagtcagtctatccacatagattttcagtcactgttacattcagtaaatagaatgtaacaatatcatgtggaaacttggttagataattctgcaagacatatcaaatggatgagtgataagaggaaaccaactgctttatgacaagctgaggtggagtgaattggtacaaggacacccagaagcacaatgtcaggtgatgaaaaggctgtgtaataatgagaggaaacagtaataggagaagaggaaataattagcaatcagaaacatcgtgattagaagagtgcataggttatgagctgatgaggctaagccctaaacaccaccactttttaataaatgtgcctacattattacccaaaaagagttctttcaaagaatttttggccacattcacccccccagcctccaagaaagagagagatagaagggagacagagagagagagagagagagagagagagagagagagagagagagaaattgttgaggggctaatgtgagccatggtggttttattcatcactataacagtagtttagagactacaggttcaggggccagacagcatggattcgaaagtgagcaatatcatttcttttgtgaccttaggcaagtgacttaaactctttatatctctgtttcctcatttgtgaaatgctgattgaaatgatatcatatttcataaggacattgtgagggttaaatggaataatgcaaagaaagcccttggcactgcctactgtgatgaaactgttccaaaaagtcagctattattttcatccccactgcctaatatgtagggtgtcagtaaccgtaaataaatgttgaggttgaatgaattcacattaccatccaagatactttcaaaaataaccaggaaaaaaggcatacatccctttagaggaagatgaagaaaaatgttattgcagcacgggagagcactgtattcttattaaggagtttatgttctggatagaacttcataggaggcatggcattgatcatcactggtcttttatcatcattatcattatagtttggtggccgttgttggcataaatcaaaatcatagaattgtagatttggatgagagtgtaaaggttatttagtgtgctttactataatacgatcatctgctataatatccgtgagcatgtcacctctggtcacgtatccacagagaataatctcattgttggctttagaaataaaataaatacctgagagtccataatggcaattttaaaaaaatgaatacattgagcataaccacaagcataaattatatggcttaattattttgacacgcacacacatacacaggcacatgtataagttttatatatagaagtatatataaatgtaatatttgccctttcttggtgctttacataatactcatgcactgtttcactaatcctttgtcttcccagaaccttagttatatttagcaatgttatttcacaatttacaaaagaaacacaacttattttgactccgacattatggacatttctggggatactgctttttggattgagttctaaagttggacataaataattagatcaacattgtggagaaaatatactataatttaaattttacgttgttatttttattaatgtgggtacaataaaataataaacatgacagcattaattaaactatgaaatagcatctcacaaaattgctaaaattataacaatcagcaaaatcctctctactccgaacctcttctcctagagtcacatgcatcttttggctcctgtttctcctctgaagaacactgcagccttacaaggtcataactgtttcacctcctttaaacttccaggcatacgcatgctcctctcttcagtcacactcacttggataaacctcagctcacaccaaatccagtccctgcctactctgtttaatcatggaggcaactaagtcaggctggagaaaaacatgcaactttgatgacttgtctcactgtgtttcacgaccattgaattaaatgggctgtttctgctgtctgggcaccatcccattcataaactccagatgtcaacacagcaattgtctcttcttttttctgtttctcgattttacctttctactctatcacttccatcgtcataataacatgctgttatttttcctttcaaataagaataaaaaaaaggaatctcgatctgacaggctagttgagttcctgcctatttctctgcacgtcttttggtagatctcctggagagttattttttatactcactgtctgtactgtttcctgctgcaattatgttttgaacacctcaagtttagcttttgtgctcactactctatcaaaatatgtcttgtcagtgttaccaatggttttcacatggctcagtccaacagtcaattcacattcctcatttatggacctatcagaaacatttaacacagttgtcctttttttctggaatacttttgcttggcctctggaaccccttccctatccacttctttactgtctcattggctggaacttcttttcctctaaaaattagagcgcctcagattttctttctcaaacttctctatgtaaatcactctttaggtgatctcactcagcatcatggctctaaatattatttatattctgaggaaaaaaatacatagatacctttactcagaactgtttcccaaactccacattttcaaatccagacttcattttctccacttcagtgatgtaaattctcaaatggagaatgcactaaatgcactaaaaatgaaaatccttccaattccccaaaagcctctttgttccagttccccatctcattaactgacaattccaaccttttagctttggtcaaaaatattggagtcagtcatttttttcccttcactccttactttccctgtcatataaaaaataactaatcaaaatatatgttgtctctgccttcaagatatgtctagaatctaattacttttgcactaccaccattgggcaagccattttctcttacctaaattattgcaataacttgctacctgttttctcttcttctgccttgaacccatgaataatctatgctcaatctactagctaaaataatcattcaatattagagacacattgtgtctcttctctactcaaagccctctaattgttttctgtcaaagccctccaattattttctgtctcactcataataaaagccacaggttatacaatgcctcctataagtctaacatggtctgggatcccgtatttcctctctgatctcattgtgttctactcttcttcttgctaggcatattctacctgtgcctagaactatccactttccttcctccttttatgtctatacctaaatatatccaccaatcaggccatttccctgatcatcttatagataaaaatctgaactccctttttccccgccgcccataattcttctcctccttatattatgctttaatgtattccagcgctcacaacacttggcttaccatcagctttttggttgcttgtgtgagccctctcacacaaagtttagatagctatagagacagagagccagaaagacgacagacagagatagatagatagatagatagatagatagatagatagatctctagttttatgtactactgcatcgtttgtgcttacaatgcctagaatataagacactaaattttttgaatgaaatacttaagaaattaattatgtactctatgcttttgatggcattctgtaaaactatgtgtaaaatgttgatttatagagatttatatttcccgttaatttccgttatgctttctgaaacatgtttctctggggagtgaaatgaccttaaacatacttaagggttagtctaacatttatctttgagagcattttctcttcggaagctggccacctagacacattaatttttcccacacaatactggttaaagaggtatttcagtggctagcgatcctcaaccattcgtaagcaacactccataatagtcagttttcaggagcaggaaaatgaaggctaatcctagggcacccatgatacctggctgtgctaagtagcaaaattacgggcattttcttttcattacaactcacgtactgcaaatatgttatctgcattttgacattaaattatattgccacataaaatatgtttaaataatcttatttttgttctcattagtacccaacttaaaaatacttacaaaatagttaataataaatactttaaaaagacgttttaaaataaataaaaataaacactttaaaatcgctcacaaagcactactttcatttccgatgcattttttctccattttttgcacacataatcatattctaaaaggtgaggtggaaagagttactggtcctaaaatatctgtttgtaatgttttgattatacttgtgctttgggtgtgtacacgtttacatatatgcatatatgtgtgtttgtatccaggcatgcgtatgtattctgtacctttttagtacttgtattgttgcatcgctgaatacacaatataatttttacttatcctttttatgacccatttgacctccatgagaaaacatgtggcatattcccttattcatctatgcatttccaaaacctagcttagtacttgacatataatagctggtcagtaaatttgctttattttatactgaaatatattgctctaagccagattttcacaaattgttatgagagatatagtaattctgcaatatgtgagtaataatattctagggtttcacatacagaataatctgaataatgaactccctcttgggatgctgtaatgttcattaacataattatactctctaagaaactaaaaattaccaacaaaaggcaatcgttttaacactgcttaagatataaacaactaattttcccatttccttttttaaatatatctcccctgatatcttaattttagaagcagattgcattatgataaatacttacagagtgactagaatattgtttggcatagatctaggttgataatgacattaatgaactttgcaaaccgagttcaattccagaaatgggtactgtacttttctgagaaattgctatctcatgtggcagataacttatatatatgaaaaagtatagtaagaaatttgaggaattttgacttaaatgtgtgaagaatttttataattgctgtgcctacagtgaaaatggctattttgtcacctaaacagtcagggagaacttggaaatgtgaaagtccttaaaattctactgcttactgtagtctcagtatgaaataatgtaattatgtttacttgtaagttatcctatggttgcagataggaagactcgatactataaatatgtcaattcttcctatatcaatccatatttatgttaatataaaagtaaaaaataagccaacagtgtgtttgaacaaaataagcttattttagagtttatatgataaaagaagtatgcaaaaaaatctgcgaaattatgttgaagaaaaacaacatgggagagctagctctataagatattaaaacatataaagtctcaataaatagaacagtatgatactggttcaaagaaacaaaacaggaatatgtgcaaatacataggaaaaattattatacataggaaatggtatgaatgcaaaaaaagtagaagaattaagttgactccatataccatttcttatacaggcaaaattccaagaaaataaaagatctaaatgaactaaagtggtagcaattagaagagtgaatataattttaaagaaagtaaaaaaaataaataaataaagattgaacccaaatggatgtacaaagcattcaaaacaagaatccacaaaaacttgtaggtaaagacaaatgttttattttgggaataatgcagaaaatggtatcaaaattgacttgagttaaataatcaatttgaagttgtggaaacctgaggatgtcatatgctcagtatgaaaactgggtttgatgttagggaaagatgtatgttaatttgcacggagacccttaagattatatgcggctatagagggaaatgtggctatgatcttaaggatgagtttttggcggcatccactgaaaagatgtaaaaagtaggagagtaacttgagtgcatagactaggcatgtcaagacctcaagggaagaggtagtttgaagaatttattaggtgatcaacagcatctaatgttgcaataggtgtttattcatacagagtaagataagagatagaaagacagcaaaggaaagaacatgcagggatattgcttctaagttttccactatgactttcaatgatcttcaatttccatttccacaaagaatgtttacttgatatttaaaaggaaattaattgtaggcatctcttatttcctttgtattttaatgagtcatcatttcaaaacttttgtcacatgtcagtgttaaatatgacataactacgttgcccttgatactagttaaaattaaattttttactgattggaaaatacacatagtgatttatttcagagggtaaaaaatattatactaaagtctattaagaatcagttgtgctaggagtctccttcaatgtgtttcaaatatttggtgtgttccaaattaagacagagtggagaacgaaaactttcaagtttgaaacaccaaagattgtataggatgggggagaccaaatactattaaaattcaccagggtcattctatcttggaggtctcttaggaatccatgttccatctcttccgttattcccagataacagcatgattttgccattgtcttcaatttccagatgcattagaagtgtggcaagatacaattagagtgtgtaacttaaatgctagtaagacctattcaagcaagcatagggctctgcacttacagaaatgtacaagtaaatctaatttactaaaatatatttagtacatgtaaatttaaaatattgcgatagctgggcgaggtggctcacgcctgtaatcccagcactttgggagaccaaggcgggcggatcatgaggtcaggagatcgagaccatcctggctaacagggtgaaaccccgtctctactaaaaatacaaaacattagccgggcgtggtggcgggcgcctgtagtcccagctactcgaaaggctgaggcaggagaatggtgtgaacccaggaggcggaacttgcagtgagccgagaccgcgccactgcactccagcctgggggacagagtgagactctgtctcaaaaaaaaaaaagatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaaccctaagccaaaagaacaaagctggaggaatcacactacctgacttcaaactatactacaaggctacagtaaccaaaacagcatggtactggtaccaaaacagagatatagatcaatggaacagaacacagccctcagaaataatgccacataactacaactatctgatctttgacaaacctgagaaaaacaagcaatggggaaaggattccctatttaataaatggtgctgggaaaactggctagccatatgtaggaagctgaaactggatccctcccttacaccttatacaaaaatcaattcaagatggattaaagatttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcccaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagataccatctcacagcagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcattattcacaatagcaaagacttggaaccaacccaaatgtccaacaatgatagactggatgaagaaaatgtggcacatatacaccatggaatactatgcagccataaaaaatgatgagttcatgtcctttgtagggacatggatgaaattggaaatcatcattctcagtaaactatcgcagggacaaaaaaccaaacacctcatattctcactcataggtgggaattgaacaatgagatcacatggacacaggaaggggactatcacactctggggactgttgtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaaaaaacaacaaaaaaaaaaagaaaaaaaaatactgcaatatcttcccgccttttacactgttttttaataattattttatatcctttctaaactgaaagttccatggacatagagactatgtcttgtttctttattgtattcatttcactgtatggctagaaactagggctggccattttgtgtattattgtacttgttccatatctcatattatcagatgattgatattattatcatcattgttttcattttaccaatgaggaaatggattcagagattaaacaccttgctctggatcaaacataactcttactctggaagccaaattcttagccacctcatggtgttgccctagtacctcaactgtattaatgcacttagtatagtcatgttatgcagaaaaaaggactctaagatggtggagggtctcagagccaagttatgtcactaatgaactacagatattcaatgtaaattcaggaagaaataagagaggtatgtaaactctcatgaatatttgaggtttgccatatcatggatgataataatcatgctgaagtattatttctgttagtattattattttaattattagcatttgaatccacaaaaagaagatagaatgaagtgtggtagatgtaacacattttaattcaatagtgagcatagttgaataactggcatagtgatacgactgatatgattcatctttactgctggtgactaggcagatagtagatgattatctgtctcgaatgctgttgaaaagtctaaaagtgctgagctaacttcttccaagtgttatgaatctatggaatttagtatagtgctcaacatttatcatgttgagaataagatttccattgacttgagaaaagtaaaacataatctataaggcaggaatatcagctgttgttattccctaaggtcaacttaaatgtaaacctctgatttacatagaacattaatatgtatgtatacatttttagaagcagatttgattgcagtcataaatttgctaaagtcctaaatgcattgttggcatccaaccatttactgttttggcataattattaatatacttactattattctgcctatgaatgtgaatgagtgtgatatcagaataattagaatgagtcatattataaatcctctgtccaactttgaattatattgtatgtatgcttgagcattatagatgtaaaaagtgacatgagttctacatggaatataatacaagtattacatcaagacattttcatgtagattattttagtagtcgtagaattttactacattgaaggaattgatattatgacatttttgataggcaaaccaagagtgaccctttcaaattgtacaatgtcaacttctatgaagaaagataattgaatattgttatttgttatttagaagattgaaaaatttcagtcatattgtcatagtctgttgattgattaagcctagccataagtctataacattcatttttatgttttgtctcttttgtatggttatgtggaatcgatgctattactttgacctccaatatttaattcaacaagcagaaatataaccttttcacttgacaaaacccacttattttgcttgagaaattataaaacaaaaccagcaggtgcctgagattcagtacttgaaattatcatttaaagcaaagtgtcttgtatggtttcaacattgttcactccattttctggcagctgacactcatttactctcaacaagtgaataagcagtcggtgagtgtccctgatgtcaaggagctgtcataatttccatggagttagctctgtttggcattacagaaattcactgtgatcctgctgacaactcttttgtatagtcataaagtatacagcagaacagtttgtcccagggctaaggtcaggctttttattttgctattatgagaaatcaataaatacacaatactatttatcttatttattctaaggaaggaggagaccaaggcatattttcctccttctaattcaaaatatttctaacattattattagattagtactgatgggtcagtcagtactacaggaaaacaaaatatgtagaaacagtgatagtctgtcaaagtttcgagctaatttcaaacagattgggtaacgtttgaatcttctatggaagcattccccaatgtttaatcttcaagatatctctgaatttatcttcatcagatgttggatatgtcccatgtgtccaatgatcacacttctgcttgacttccagccccagcccttgctcctctacctggagttgcttccacttcacacacgaatgggcatttaggctgccataacccaaactcaacgagcctaaaactagatgggccatcttttgtttttctttttaaaatttatgtttttattattattttttgagacagggtctttttctgtcacccagactggagtacagtggtgcaatcatggctcactgcattctcaatctcctgggctcaagcatttctcccacctaagcctgccaagtagctgggattacaggtgcatgcatcatatctcgctaattttttaaaatttttatagagttgggggtctcactatgttacctaggctggtctcgaatgcctgggctcaagcgatcctcctgcctctgccgcccaaagtgctgtgattacaaacatgagccaccgggcctggccttcaccatctttcttcttaaatcacttattaacttgggatttgtcacaattttatcatccaaacctaaaattttccctcatgtgcttccaaaatcttctgaatttacatattctcttaatattctccttcaagtttaccatgcctcagtccctttacttgctttaatggtatttattcctttcttcattttgtaaaaaggacacattcatttaaaggaagcagaaaatgcagaaagattaaaaggacataaaaaccccttgcaatgttatctatatttaagcattattaatatttggagctaaacttcatgttctccatcttttaatgttaaactaaacaaatactttataaagtatttcttgatcatggcagcaggatgcattctctttttcttgctgcctgtcaatatcacttgagtggcatatacagtcctattgaagatattcgtgcaaatatattgttcctttttccaggtttaaaactctttaaggccaaggcacatgcttatacatttctttgtttaagacagatctggtacagtgtataatgttaattcaatatttgttgaatgaatatgcttaataattcagatctatttgaattatcaccgtgaataaacaagtttaattctcttctatagaatgaaaatatgtgtgagtaagctggttaggaggaagtgaaattttttattcagttaataatgacaatacagattacatgcttcagtgaagcaaattcctttgtataaagtacaatacattgttgggttcacaattgcagagtcataagaaaatgtatttctcctcatatttctctcttacagaatgtaccattcaaaataattgatgtaagtataaagaattgtctttttgtgctactaaaatttccactacttattttcatttgtcttcccagcacttcttctgatcaattgtatatttttaaggcttttggtattcattgttgatattccatttcattttatatgttctatctctaacaatttcatcttttttgggggatgatctcccttttttctgtgtataattttaaatttcaaatttcactgtctcagcaacatgtagtgtacatacctcttactttctcctaaactagtcagattgcatcctattttttgcagaaataattcaaagtttttcctctttataaataaaattatttccaagttagggaaataaagacagaaatccagccatactaaataagtagtactatagaactgctttcccaagaccatgcatacttggagacactcaaggattatggcatttgtcagtccattttattactaggtctcaaaaatctcatttactatttcctacttcaaatgacccaagtttcttcacattgatcatctaagttttgcattctttggttagagtttcatcaaaaagcacctagtgttgcactcacatgcatcttattctgatgatcaggtggtattgttttgtcttcttctgtagtgagcattatcggtatttgcacccaccccatagctgcagtagtatttattcacatttctaattttaggattgtggaatttttttccatcacaaacaaataggattttatatttttcttccacatagtccaagggtcattctgaaaacaggatttctcatgtgtcaccccaatactgcactgttatagtattctgctgtgaatactgtgactactaattcactatatctacatttgaaaattgaaacatcagtctgtttgctgttcattttgtgacaaacttaaaacacttgagctttttgaaggtcttggtacatgaatttttatcatatacctaaaaacactcagatactactgctgagagattttgggccatggtagaggtgtttgtccaaaaatagaaaaaagtaattggttaagaaatatatacaagtaaacagaattatttctaggtaagttttattctactcaataatacaaaatgcactttgcatggcattgttgtgagatgtccattataggccttcctacatttgattagaaaaagttatcataattctagatagtataggaatcagctggagatttcttaggtctaactccagaccagtggttcacaaagcatgcttataagaccagaaacatcatcacctgagtacatggtagataagtaaataatggtctgcaccccagacacagcgaatcagaaactctgagggcagagctctgcaagctgtgattgaacaagtctcccaggtgagttccatgaacactaaaggctgaaactcggcgagaaccattgtttttaaccaattaaaatacaatcttcaggtgagtcatatacactgccaaaattgagaaagcttgagaatcaccgaataataataatcatcattttcaggtggtacttggtaaatttacaaacatgtaaacctgtgggatttgcctagccagtcacacatttattaggattattctcgtgtagtcgtctcctaggagagagcagagccctgggtgataggaaaggcttgaaacatgagcagcacccaaacagagtagttttggaagacttgacatggcaggaaaaaggtgcacatttgacaggtaaggagaacctgcatgttcggaacctaaatattactggctttgttgactttgtgtttgtgtgtgcaaatttggagtgcaatgggataatgctaaaaatgtggcaagaatgaaaatactagagcataatgtaggtagataatattaaggtcagaataaaggaaaaatatagggaattcagcattagtgaaagtagttaatttaatattctactatcatctcaaaatatgacaatattttaaatcccatttttgagacatgattgcactttcttcttaatagctcctcctctaataatcttgatttatatctatgcaaatctagacttctaatggttccggttgttttaaacatgtaatctggtctctgaactcaagtagttattctagatttagaaacagtgctagtcatctgttagcactttaacacgtaaacctatcctgaattggaatatgttttgaaaatgttccatccccagagtaattttgttcttgccttgagcccctggtgccccaatgctgtttatacattaatttagtctcttatatgcttaagaagaaagtatatgaatgcaaatgagaaagtcccaacctctgggatttgaatctgaaatttaaaacaagctaaaagagcatcagaaatggaagcaggattaccaataacatttatgatttaatgatttcaggaagcattaaaatgatagttgtgtatttataagcaaagccgtttatgtattttgcttttacttatttcatttttgagataaggcctcgctctgtcgccaaggctggggtgcagtggtgcaatcacagctcactcagcctctgcttcccttgctcagcttcctgagtagctagggctacaggcgaaccccattaggcccagctaatttttgctttatttttttgtcgatacagagtctcactatgttgcccagtctattctcaagcccctgggctcaaggaatcttcccccttcagcttcccaaagtgctgggattataggcgcgagccaccgcacctggtctattttgcttttaaagttaataaactactagtgttttagttggaaaaaaaattctctcatgttatttgtagaaatgctgtagaagaaaaaaatacataatattatataaaatttgctgccttttcacatgtgaaagtatttgaggtctaaaatcaggtatatctgagggcaaaaaggcaaagattcatggtcattgaaacaggaatcttaagagactgtatctacaaagaacatttcttgtatatgttgtagacactttagcagtaaaattttctattttgttctctgtctcttcagtgagaggtacccttattaaaactctgcaagggaatatataatttaaattacatattttggtataactttaggcaagctttatagtagtaatgcttttcacatgtattgtgccttcagactatcttgatattcaagtagatcagcttagcctggaaatccagtggaaatatggattgtccacaggccaaacagaaagtcttcttttgcaaaatcacatgcagacttttcaatattgaaaggatttgttcaaacttccagttctctgatgatatatacataacatataaaaggttatccttgtccatcgatgagtcaaggggataaatgtgtaactaacactatctacaataaaaatatttttgttacatcagattacagccccaagctttatttaaattgacaacaataggactcatgtaatagtgtcgtgaggattaaattagatttagaatctaaaaagtaaaaagagcctagaataatccctagtagatacgacaaacatttaataaaaatagttattactgttaacagatatgtgatttatattagtaatgtaaaatagcatactctctcatactcacatggaccttttttcttgttccatgcaatatgttaacagcaaaactagtttacaggtgagaatgacaagaagatgtgaaagattatttcagctttccctttctttaaaaagctagcatttcaagacataatttttttaaaaatgaaaattctaaattgttacttactttaaaagtatttaaaagagattctgccaatggtttaatataagaacaaaaaggagtatttttcaggaaatcaagccagagattatgagtatccattcttgttggcagaccttatttgcttattttaaaggcagtgagcaaaagatgtagaactccaagagacagacgttgattagaagtttttctttaagatgtcatttttattttctgaaaaagcatttatttttaaaacttggcacggattattaagacgggtacagcttaaatttcccattaaaaaatcatatgtcattcccaaacctgttcatatacacagagaaaaatacttaggtatgtactcattactttggcctttccttaatctgaaaaatttttttataaaactgagtatttttgtgatgttgctccatcagctcatttaaaaactactatatgatcttgttcaatgttgtttaatcttaggaccactttgtttcacttatagctctaacatctgtcttttttttttttttttgccacaaactcttttgtttctgtgtttagtagctatccatgctttttgtcctcccactcactaccaattgctctcaatatgatgacaatttaagagaattgtagcaagctaattgtcttccttatattttccctatctatagatttgtttactcaaggagctctatgagaagtgtcaggcatttgcagagacaaattgtcttggttgcatccaccactgttaaaacctccaatgtcacagggagacttgtctgtaatttctagagtcactactggaagtctttttatgaacacaggtcatcattgtggccacacaaaggctctggcactaaagaactctgatagacaatctataagaatgaagcttacattttggctaacagtcctttaatttcttatctccaaattttaagaaaattaagtcttcatgatttattcatcatacataacattttgttcatttgactttcatggtgatttttgattatagtaaaatccaacattcctatagaaatataattcaattaacatgtgttctaaaatattctaccatctacattattgagtaaacaaagataaatacattttatttaatccagtgtgtcgaaagagtaaaaaaagataaaattaatttattttatttaatccaaaaatatgatttttacatctgttcaatatgagaactataggtaggatgttggacatattttttaaattaacgattccagtgtgaagtgtattttatacttgcaacacagcttagtttgaactagctacatttcaaatgcttgatagtaacagtgacctatgactaccatattggacaccgtgggaatcaattccaaaataaaaagtataaattacatgatctttaagtgttctttcagcttttctttcacagttttctgttgagtgatttctatacctctaaactacgtgttccaagaaacaagtagaaagtgaatatatccttgaaatatttagcagtaaataaaaataagtaatttattatttcttatcattgactgttttgggaaggaattcactaagtagaccctttatcatattatcatcaaggaatactacttatttcttggttactactatctctttgatacatttaaatacattattaagcttttattatgacccgtgagtcctatttaatttttaagcaatgcatttgtagaattcctctggttttactagagttaaccttttattttctgctaatgacttaaaactcctcttagaaatgtatttaaatgctcacgtgtacaaaagggaaattgactaataactgattaagttatgcacaatattttatgtgtaagctttatttttataaatcgtgtttatggtcttcctaaataagcagttaaggaaatacatataaatgttagtaaactatcaattatactgatactatacatgaattagacaaagttaaaaaatttagaaaatttttcaacctggcatataacatgtgtccaccttgaatataacaaatccagagacacaagaaaaagccaaatacagagaatatgattctttggttatgagcatgaagcggtgctgcagtgtttggggaaaagggccacaatcatgtctgctggggattcaccctgtaattatatcaccatccagctgaatgcaaacctgcagggaaaatggttaaggtagtcttgtcaaatgttgtgcttgcaatctgtttctctgcatgctgacaagaaggcaataaagtcaaagacaactacacaactaatgtatactggagaagaaaactaggctcagttgcaatgtactgtaacaattttgaagttatatagtaccactaacttgagtgacctagaaaaattgaagttcaagatggtagcattatataaaccagtgaatcgtgtcattaccgtatggatacaaaagtggattatttattttaaatattctattcagttatctgcgtatatctatcctgcatatatccatatttcacagactgcaagaatacatataataaaagaaggcaaaaaaaagcttttgaaaaaagaaaatatactgggaaatgtaattttaattctgtaaattgtaaaatactaatcttggtgatttgggggaaggagagctgatggaaatgaccaacaaaagttgaccctttgctaaataatgaaattgtatcctctgcctagcttacttgatctcttttagtcagcacagctgtgtgctattaatattttctcttataaggaccctgagcctgaaaaaaattaagttgcacagtacacaatcattaaactaaaaagctagatctatctaactgcaaagctcacattgtttacaagttacttgaaagtctagaaaattcagttctgagtcttgccagttatgtccccaaacaggaatttgacccattggactcccttgtgaatcactagattaaccaatgtgcttattagagcccttcagaagggccaagacatttcttcctgtgaaataaatatggaaacaagatattaaatatcttctgtgtttcagaggaaaagtcatgctcagatattaaatacatacaaaaatgtagcaatgaaataattggttgcaggtgctgttggtgactcacccatatctcatcaacacacatcactcttgtgcattccaactggaagcacctgagactctttctgaaggcttttctggccaaggtgtctggctcaactgaagggcaaatggaaatgcatgcattcatatcacctgggagcagccctgaatcaatgactggcagctttgtggatcaatatcctagttcctttgttccttggtggggagaaacctgagacacagtatacattgcttctcaaagttgagcagtggtgttgggttccaaagatcttcatgtgctacggtggtagtctgctcaacatctcaacatcgtactgattccttgtccccttgggatcataccagtgcttcccttggaacatctctccccacataatattaatactcacgtatttgctcaagttcttctgggagaatttaatgtaatctgtaattccagtgctggaagttagaattttagtatgacaatggtaatcctttaaactttcacaaaacaccactgctccatttgtttttttcctattgcagtaaaatatagaaagagaatctagaaggaagagcacaaagtctataaaaataagaggggatgagagagaaacaggaaagagaaatgaaacgggagttgagaaaaggagggaatcacaactcgggagcagaaatgagtaaaatgtgagcaaagcaaaggatcacggtgaggggaacattttccagaggattcttttgaaacgacttgctggaaatttggaaaatgagcaacagtaatgtcaaatactatagctctttgaaagagagagatgaatgaataaataaaaaatatttatttgttcaggcggaagaatctggacaaataagtgaaatttgcagtgaggatgatgattgttcaatatgaggatggcctttctaaccgaaaccatcttctagggtaaagctacctcttcgtcacttaaccccagcttcaatgaagttgttcagatggttggtgtttctgagatttggtttattactcattatccaataaacctgtgaatttatagtcaaaaaaaagctgatggtgggcagacattgcttaatgatcagctagtatctgcatacctgcttaataccctgtaacatgattttgtctgaaaacacctagtttcccagactagcgtctcttctaatgtcaactttcccactgcactgccaacgcaggcccattcattcaaaatttaagagacatttgtagcattccttttctgtatcgggtttgctcaatctcactgagaggagtcgagatctctacacaattatctcttataatgaaacatgcattgatgagattagatacagtttattccatagaaaaaaaacctaaagttgctgtaaaatgtgtttagttattgtgaatcctttctagttggttataattacgtgattggatgtaatagaaaaagtgtgtattccaggaaacctggtttttttgtttgtttgtttgttttgagacggagtctcgctctgtcgcccaggctggagtgcagtggcgcgatctccgctcgctgcaagttctgcctcccgggttcacgccattctcctgcctcagcctcccgagtagctgggatggaaacctgtatttttgtcttatcttgaactatacctaacaggttaaccttggaaagtcatctagctctggaggaccaaagtttctttgtctataacatgagcttgaacaaaatctccaaattccactacctttggttcatgaatagactacaaagatgtgattcaaatgtgttggaactgaatgcaaaaatttgtgagcctgtgcatttttctgcgagagggaacatagttttaatcaaattctcagactgttatttgaaacattttaagaaatgctgaattgtactaccttgaagatcttactttttctgaaatactttgattcataattctatgactcattacctctttggcaatttcgaatagccatttctaggaaataaacttcttccttaaataaatatcaaagttacactgatcttaaaataatggtttatctagccatgaagtatttcacatctaaaagaaccgtttacgtttttggccaattaaaattgatacatcaaatgttagaaaaaactgaaactgtgggctgaattacacaataaaatttcaagaaatgtagaattttgaaacagtaatagtgactaaagtgaaacaaaatatttttttaaaatatctcataaaagtcaagtctgaaacgtaaaatttctcaggtcctgcataatgtaaaacggcttaataaaagcagcaaatataaaatgactatgataaaatactcaaaaaatggatgttgtcttttgtgagtgtactgcctcaattcatatgtatatgcctgatttaaaataatatatatttggattttattggtgtgatggttttatttggtttgcttttcttgtataatccttagggttaattttttaaaaaaagtaaagaaaaataaagaaaattggagtaataaaaaccctttaggaagtagtttgttagatattcatcattccttgaatcttcaaattcactgctcagcgtggggtagacatcctgcctcactgaacgttcaattactttatgggctacagctcagaaggcgaatcacctttttcataagctgcttgttgagagaagcttgaaaaggatgatattgtgtggaggttcaatacctttgaatctcatagtaaaattacaaaattattgttgatttacataagcatgttatttatctcaaactactcaccagttaagttgagactcattaattgtacattttagggtattatttcatgagattaatgaaattagcgattacaatacgttttatttttaggatgctttcaaattatttacaacctatctgtattacactacaatcatgtctaagagaggaatattgccataattttggggaagactgttcctatgatgatgaatgagtgtatttttcaaaatccaaaggacaattgactgatttctaaaattcaatcctagggtaacaaagaaactctgcacttataagcattgcatatttgttttaaattataagagcagaatgttagttcatttaatgagtatatatatttgactttaatcttgttttgttgaaaataatgcataaacgttaatggaaaataactgaaaccaaagaagggaaaggtagttgtgtcaaacaccatataaaaagataaatatggctgggcatggtggctcacgcctgtaatcccagcactttgggaggccgagacaggcggataacctgaggtcaggagttcaagaccagcctggccaacatggtgaaaccctgtccctactaaagatacaaaaattagccgggcgtggtggtgggggcctataatcccagctactcgggaggctgaggtaggagaatcgcttgaacccaggagggaggcagaggttgcagtgagccaagattgtgacattgcactccagcctggaggacaagagtgagacttcatctcaaaaaaaaaaaaaagtgaaatttctaaaataataaaaaagtcactttaaaaaatcttaaaatatgaaaatgacatgaaatttatagaagtgttgttcatttttatatgtaagcagagaatagtgtgtaatatttaaattctttccctaattttttaatattctttacaacatttgttaaatataaggtatattaaacccaaatggtgaattaaactcaaactcaagacactacatgaagaaaaatattccatcttcattatcactatccattttctgtaacattcagagtagttgaaaacttactttactaaagagaggtgggagagggttaaaatttgttattaatattaactgcctatatgagttttgtgttcctttaactttgttgaatttaattattcaagtaaaagtagtctattcaatcattaattgtatgcaattctattatgttataaactagagtatttgaattcctaattcttccctctgaaaatagtaatataagaattttatatgacataatttgataaggatctgtgactataataaattataaatccaggtgtctattcagttttagacttctgacctcaagcgtgtgaaacaagtgggtatgtaaggagagatcacatcattcacggcatttgcattttatatgtcctcaaaagttttcttctaaaactgactgttttgctaattttgtagtaattttattctagatttgttcagttttgataggttttctccattcactgccaacatccatttgagtattcgaatactatgtagatgtatttttagtaaaatatgtttcatttttataattggatccacacagtgctggagaattctacgtgttaaagatgtataaaaataaaacttatttaaaaattaaatgtaaacttacgttctcacaacagagtaactagtatttcaaaaatgttcatatagccttgcaaatagttgaaaatatatatttagaatttagacatttttattcatcttaacagttctgttcactgggatgcttttccacaatactcttaagtcattgttgtaactgaaaatgatcaagagtaatcatttagcgaagactttgagttgtctccataaaagaacttaagcagggagaatgatactccctgcatttttcctgcagatgacattgcatataaatgacacctgccgaatcatgccaagacatacaatctcatcgtgaccatggaagctcatggctaacggtgctgcctgctagttgatccaaaaagttgggttcctgccagagatgtagagcaatgcagtacattgataattactagctagctctttcacctctcttcccataaatgttaatgatagccttgaaatcccaaagcatttctttaacatttctattctttttgtgcaaaattgtgactgagggaggttaatcagtattgccaaggagactaatggtggaagtttctgctatgactcttatctccagttcataaaatacagagaatgttttttagatatataacacctttagccttttttaagtccttaaagttggatcccttatatcccacatgtattatgcaacatttagctgtgaatatgcaggagatattagacttgacataacagaaaacaatgtttgatgatccagtgagagtacatatgagagaattttgaaaatggtaggactgttcattattattaatgttgttgctatgtgtgctcaccccctccaagtcctttctgcttttttactttctttcttgtaattaaattgaataattttaaaaatattttgaaaccaagtaattctaaatatcatgtggcaagagaagaggaaataaagtgaccttttaacaattgggaattataaaatttgtaatatttatcttctccattaattatatcatcttatggttttctttcttatagagctttcctcatttagctacattgaaccgggacatatccatatatcgatctcaactttagccgaattttcttagcaaatgccgagctagagcgaaatttaagaaggcatagtgataaggaaccgtatccctacccccattttgttatatgctaacataaggtcttgctgcctcatttttaaataaacatttttattttagaatacatttagatttacagaaaagttggggagagaatatagagttcacattcccgttatcaccgacaaccagtttcccctattaactttttaccttaatgtgctaacatttgtcataattagtgagccaatatgcatatattaagcctaatgttcattgagattttcttaggttttacctttagtccttggctttcttttttggttccagaatccaatctagctcaccatattacatttggtcattatgcctccttaggattctcttggctatgactgtttctcagactttacttacttataatgactttgacagttttgaggagtactagtcaggtattttgcagaatgttcatcaactgggattgacctaatgtttttctcatgattagactggcattataggttttagagaagaagatcacagatgtgtcattctcaccacattctatctaggatacacactagcaacacgacttgtcactgttgatgttgatcttgattacctggctaaagtaggatttgttagttttctctactgcagtgcagactctttccatactgtagtattgggaaggaagtccctatgtgcagttcacatgtaaggctattatgtctgcctctttgagggcacagtgttgacataaattattctacatgggccatgtataaaattttattattcctccccatttattcaatcatttacattattatggacacatgaaatttgattttatcataatttggattatattctaatagtaccttgtttctctttttaatcaaataatttcagctctggccactggaaactctttcagttgccctgtgtcctttgacacacctgcatcactacagagtttttgaaaagcatttctttattttctggcattacaacttgcatcactgttatgtatgtgtatatatatatatacacacacgtatatatatatacacacacgtatatatatacacatatatacatatatatacacacatatacacgtgtgtgtgtatatatatatgtgtgtgtatatctatctatctatctatctatctatctatctatctatatatatatatgttttagcttgtatattttttgctccagtcttagaatcaaccttctaaggaatcctggtttttgttgttgttgggtaatggtacttaccagaaaccagtatctggatgctatgtatgctcattgatagtggaatataattgtgcaaggggatatatgtgtttctactaagccatgtatatatgcatatctataaatttctatatctgtgtcttcatatctgtttgtatgtatattcatctgtatgtatatttaacttaatgtgtgttcatattgatgtatccaactataatcaactataatcaattaccatgtcaatcattctaaccttctccccttgctatttgtaacttcccaccccaatagtaataaacgtggatcccaggctgggcgcagtggctcatgcctgtaatcctagcactttgggaggccgaggcaggcggatcacctgaggtcaggagttcgagaccagcctgaccaatatggtgaaaccctgtctctactaaaattacaaaaattagccgggcatggtggcctgtacctgtagtcccagctactcaggaggctgagacaggagaattgcttgaactcggccagcggaggttgcagtgagctgagatcatgccattgcactctagcctggacaacagagcgagactccatctcaaaaaaaaaaaagaaaaaagaaaaaagaaaaaaaaaaacctgtatcctaccattgccatcaatttaattacttgttaaattcttgttatcatgtatgggagtttcagaattgttagtggtagccccctggagaataactttgtcaaacagagaacaggatttatgtgcaatgactctagtcttgcaaactctatttccaaagttgcctaggttagcatcacccctctcccctgccaccacataagtgaggttttgttacattttcatatggttagattatttttttcacattctgccttctgacatgtgatcctgacttcctgcatacgttttaaagcgtttttcatatattaaggttttctcttctgtatagttctatgggttttgacaattgcataatatatattcaccattatggtatcatatagaatagttccaatgccctaaaaaaatgccctgtgctttgcccactcaactctctctacagaaaaccctgcaactaataggtgtaccctctctgtagttttgtctgttccagaatgtcatataaatataatgataaaatacttaactttcacagataggcttctttcacttagtaatatgtatttaacattcattcttgtctttgcatggcttttagcttatatttttaagttcattatatagttgtatcacagtttatccattcacctactgacattttggttgtttccagtttttgcaaattacaaatgaagctgttattaatgttcatgggctgtgtgtgtgtacataagttttcaattcagttgagtaaatacctagcattttaattgtgggtcttatagtgagaccatatttaactttttaagaaactgctaaattgtcttgcaaggtggttgtgggaatgcaaaacggcacagctactttataagacaaattgaatgtaagttcttgttactttgtgttctcactgagaataatattcttagttttgtggatgttcgccattctagtagttccgtagtgccaccacatagttgttttaatgtgctctaacttaatggcaaatatgttgtgtattgttaatatatgtttacttgtcatctctatatcatttttgataccgtgtctttttgattatttaataaatagcccaatttagtaattgggctattttcttaaggctgggtttcaagagttctttatttaatttggatatatgtaccttatagaatatgtcttgcaaatattttctcccaggccatgctttgtctgttaattcttttaagtgtcttttgaagagcaaatattttaaactttaataacgtccaagatcaattttttatggataaaggcttgtgtgtacctaaaaacttttctctaaatccaagagaaaatccattttattctaagtatagttttttaaattttacatttagaactatgatccattttgagttaattcttgcacaagacatatagttggtgtctgttatttttattttaatatgtgaatgctcagcattattactttttttatcaacatttcaacaaagcagaaagattatcctctcttcatttcaaatgcctttgttaaatattaattttgtttgtgtgggtttattttactggttttctactctcttccattttctattcctctgccaatccctcatagttttgatgactgtagctttatttgtcttggaatacagtagcatgagtccttcagtttgttcttttttcagtattgtagctatttcatgtctctttccttgccatataagttttagacatggtttgttaatatcagtaagatagcttgctgagagtttgattgggattgtgttgaatctataggtcagtgtagaaagaattgacatttagaagtattgagtcttccaagtcataaacctggaagatatttccaacaccctcttctttttaccctgagaaataacaaaatagtgatatttttaacatgttttcctcattaaatatgtcttataaattatgtaggtccagaagacaaaaaagaaaaataatctccatccaacaaacagcatagattaagattaaatagatatacaagtatctgggtcttgccaattaggttttcaagtgcattcatacaagaaatttactggaacacattttgatatatattaattataaggctgctttaatattatagatggcatagaaattaaaattcattgtgcagaagattgacacatatggtcagagaggaaaggagactcagggagcagcacattattaattagaagatgggggaggataaacataagactctctggagaaaaaattaaggacatgagacaagaaataacctgaatctgttttgaagggatagagatgcataaaaggactggggtattagaaaagactactttgaaaaaaatgagagttttgagttatgagaccagaaatgaatggcttagaaaggcatcctcttctacccacaaattatacttgaaaaataataatcaaaatatcatatgttttaaaaataaaacacaggcttattatttgaatctcaaaatttattttcaaattaacaaactagtatttgtctgtgagttacaaattctatacatttgaccaagttccatttacagagtgaaggcagattttcttcttaataaaagacgcattttaagaattctgaaatgtaattgaaagaaaagactggcaaagacatatgaggacacaaatattccaaacaattatttggttgttaacatgccaacaaaaggttggttttcaaaagaccatgtttttttaatttcagaaaaatacggtttcagtaattctcataagtaattcagcgatgagctatcagctaccggtaatgaattctcctacaaaggaataatttattcccagtgtactcacacaagctgggatgttaccaggaacttgaagctgtaaaagaaccctatcttattagctacaatgcctcactcataatacatacctcatgagttacatattaaatgatcagaggttatttatcttcatacactagtttggaaatggatgaatcatttctcatttcttctgaaagacatacattgtgcttttgctcaaatttcaatttcagagcttcaaacttgtgatacttatctaaatgaaggattagactcacatttgcacacacacaaagcacaaaacaagtgaactaccatatctaaaggcaatagatattacaatgaaacacattaacaataatgtttacttttctaaaaatgttcagttatatattaaagcaaaatggtatttcaccctaattctatgcaaatgtttttgttaaggcattcagttgcttaattaatggtattgaattttaaaaaatctattggtttgcaaatcaggttcttacgcttgtatctatcattctgttctgagagggttgatttatgggtacctataaataaaacagaaatctaaaaaatttagtgagtggagcccagcatgcttcaaaatggaagttgaaacaccaccgtatactatgatcaaatatgttgacttagagttactaattttactttaggcttgataagaaaggattgtgtgtaatctgaatacttactggtagtgagcatatgattgtgtgcctgtaaatacagaatatcattgataatggaaactcaatgtatccaatgcttagttatttacacaaaatacatcaactcatcatgaattaaagactagatcaaagtcataaaaagtaaaaagatacaaaagaaaaatgcatttttcttagataatatcttcattaaaataatagttaaaaattagtggggcttaaatttattgctgtgtattggggcttgtggtgttctttatgtgtacttcaccccatttaacctgaataacaacatgctagttataacctcatagctttaaaatggaggccattctgaaggcctaacttcattgggtcatctctaatataacattgcttcttttgtaattccagcctcatttttctttatttctgtattagcccattttcacatttctgataaagacatacccaagactgggaagaaaaagaggtttaatggatttacagttccagatggctggggaggcctcacaatcatgacagaaggccaggaggagcaagtcacatcttacatggatggcagcaggcaaagggagagcttgtacagggaaactcccatgttttaaaccatcagatcttgtgagactcattcactctcatgagaacagtacaggagagaccagccccataattcagtcacctcccaccatcttccttccacgacatgtgagaattgtgggagttaaaattcaagatgagatttgggtggggacacagccaaaccatatgactttcctaaactgactgcttgatatttgtatgcattatgtatgaaaatacgtattacttcatgtaaaatgaaagctgtttgattatgctaaagaaaacaattttgtactgtatctagaaaagaaaatgtttaattggtcagcattaaaagaatgagtaaaatcccaaatcaaagtttagaatatactaaatgtaataattacctccttatatcattctcttgtaatgtctagttcttcaaaaagctttataggaaatggacgtaggtactattgagagtagaattttaattttaactcagggaacttaaaacttttatgtaatgaccttcacagtatacattttgcaacctgttattttagggcattatcaatttctcagatcaaagtttgaattacagttataatattctgttcaccaacttccttatttaggtacaaaaggtttaaaagatctaaaatataaatgcatgaaaatttagaaaactgtttttctcctcaaggaagcaccaaaatggaaaaaataatgacactggttactactttcttcttttatataactcagttggttttaagtttcagcttcaattcctcagttttgttctatttggtttgggaaagtggtacattatgtatatacaaatttatgtgtgtttgccaatgagtgtgtggtcacgtatatctttgtgatttattatagtataattttacccagtttttccaaagatatatttaatagtactaaatagaaaatctatgatatccatacttgttcatatgggatatctttttccacttcctttaagcaggaagtaatttcttagactgaaatgagctttagaccattcctatcacctcagcatgcagacaatattggtccctcaagggaagataagttgctgataaatctgtagtataacattagagaactcaagagccacagtatcagattgtcccaacaaaattttagagcaccttgtttatcatatgcggaatctatgaaagctaatctaagagtagatagtagaatagtggttaccaggagctagagtagttgatcaaatgatataatattttaattaaatagagatgtttaagagatctattatacaccatggtgactatagttaacaatacattattgacaaatgctgagagtggatgtaaagtattgtcaatacaaaaataattatgtcaggtaatgcatatgttaaatagctgaatttagtcattcagaatgtttatatacttcaaaatataatgtggcatatagtaaatacatacaattttatgtcaattttaaaaaataaaaaaatgaaaaaagaaaactatgaacccttgagcactttagagagagtagaactttcctgttacattcataggatagtatttagagactgtacttcgatcaagtatatgagcacagaaggacctagtattaagagccccggagcaaaatagtcatctcacagaaactagatcaaagtgttaagaatcatttaagcagctacaaatacttcctgaaccatattttgcccacattacttgacggttattctttatgaattaatatggaaacttaaataacctactgcacactctatataacttattgtaaagaagtaagcatgtaaagtcatacgggctcaaactttcacgtacctgtgagatagtgttccactttatctaccaaaataatctttatttatgataatggttgatttcccttatcttttaggtcacaatacatgcttttgactaatgttatctgcttccatactcaacataattcagaaatgttcttcctaaaaaataacatgctgaatgtcatatgctccaaattgtgtgtaactttaaacaagttggcagagggctgcctcctacaagtctgtcccctggcagttacccctctcactcctcatcagccacacacatagaattacatactatttagaaacgggctaatgtaggcatgagaaatgtaatgtctttgtcataatatttgtcactacttttaataataacccttctaaaacttgtgcaggaagttaatacttttctttaaataaggtttattaaaatccattaaaaatgctataactttatcaaaaatatatcattttttaaaaatgtagaacagagcagttgaatagtttctctaggtgtcaaatttcaacaatatttgttattgccactatataaaatcttctaaataacagaatattttataccaaggaattatggcatatgatttcctgaaaatgaaattttccttgatgatttaacatttccaacaaccctgataatcatcatcaaatatatatttgttaggttattactagttactagaactataaactaggccgtatatttaaaaaacaattttcttcttgcagattatatgttacatggaaaatcccaaaactttatggcacactgtgcatgagtaataacaacaagaagaaactggaggcttatgttttgagactggttcacacagaaactgcaaataatagttaacatagggaatacggtgatgatgagttcattagggagaaataaatattgtattgcattagccttcatattttaggatggggtatacactggatagttaagaaattttattttataaaataaatttgaccatataatgcatagaatatggtgttcttttttttttaagttctggggtacatgtgcagaatgtgcagctttgttacctaggtggtttgctgcacctatcaacccgtcatctaggttttaagccctgtgtgcattaggtatttgtcctaatgctctccctcccctagcccctcattcctagacaggccccagcatatgatgttcccctacctgtgtccatgtgttctcattgttcaactcccactaatgagtgagaacatgtggtgtttggttttctgttcctgtgttagttttctgagaatgatggcttccagcttcatccatgtccctgcaaaggacatgaactcatccttttttacggctgcatagtattccatggtgcatatgtgccaccttttctttatccagtctatcattgatgggaatttgggttggttccaagtctttgctattgcaaatagcgctgtgataaacatgtgtgtgcatgtgtctttatagtagaatgatttataatcctttgggtatatacccagttatgatgctggaacaaatggtatttctggttttagattttgaggaatcaccacactgtcttccacaatggttgaactgatttacacccccactaacatggtaaaagcgttcctgtttctccacagcctcaacaacatctgttttttcctgactttttaataattgccattctgactggcatgagatcgtatctcactgtggtattaattttcatttctctaatgaccagtgatgatgagcaaaaatcacaagcattcccatgtaccaacaatagacaagcagagagccaaatcatgagtgatcacaattgctacaaagagaataaaatacctaggaatacaacttaaaagggatgtgaaagacctcttcaaggagtattacaaaccactgctcaaggaaataagagagaacacaaacaaatggaaaaaaaatccatgctcatagataggaagaatcaatattgtgaaaatggccatactgcccaaagtaatttacaggttcaatgttattcccatcaagctaccattgacttttttcacagaattagaaaaaaaactactttaaatttcatatggacaaaaaaagagcccatgtacccaagacaatcctaagcaaaaagaacaaagctggaggcatcatgctacctgacttcaaactacactacaaggctacagcaaccaatacagcatggtactggtaccaaaacagaaatatagaccaatggaacaggactgtgttcttaaaatatgaatttttcgactgcatttgaaaggaaaacaaatatttgaaatggtcaattgaaatcgaccacattgaaataatttaaagagggtgaaattaatatattcaaaaataaattctgccagaatcatagatgtttgggacccatttcatgtctgggcacctgttattatgggcatgcctcctacactgaactaaaatttacatccctgaaactccaaggctttcggttctgtcccaaggtaaatctacatcctcttccatgtgagagccttctgagtatttgatgaataccagtaagacaaatgaccccaggttcttcacttgttctttacaagagaagttttctggtctcttctgaattctggttagtcttctctaggttgcaaagatctttcgtaaagcaagagttctgaaaagatcaaattttatgtgtgataaaatggcacgctattggaccatactgagtctgctgtttaattttcaaccaattcttaaattatttccacagtgaactacatactggctggtatttttttaagaatctctcacttacatacaaactcactttaccaatctccaagttttaatgtcagtcaatactctcttttgttgttgttctcccaaatacaaatgttcaaaatcttactaatgtaactttcttcagtgcctgctcaaaggctcagaaatcactttttaaaatttactttttaagataaaaattgattaaaagtatatcatttactccaaccattcatatgatgtaattactatgtgttagagactttattagcaagagcatattctgcaaacaaggtagtctgggctttggtctcacaggagtgatgatggacatgtcactatgcgtctgtatgctttagtttcatcaaatgaaaatttagagagtttggttgtgtgaggaggaatgggtttgactgaatcaggaaaccttagtggattcttagtgattgtatttttcattggtaaattcccatgacctattcccaaagctattccagggattttaggatttgatataaaaaactacaattttcatttcatgtgaatatatttttgttattttacagtaagaaaatgttcatgttaaaactatatgagcaacataggacagcaaatgaatttttagtactaaatataaaatgcctcaaatatactggcatccaataataagattttaaaatatcagattttaaaatcgatttagacttaagtaacattggccatgtgttcaaaagatgggattttaatatacagactattgagatctaatacactatgaatatccaatgaatattttcaagttaattattcaaaaatcaacattttctgaacaaaaaaatgaaaaagataagttcttaaccataacgtagagtaacatttacaatccaaaaccttttgatctgaaatatcaaagattataaaaaatattagcctatatttgtagaggacataaactttttaaatataatttaagaatataaatttataaacaatcatgtagtcataaggaatttaaaattataatctatgaatactcatcaaaaatcacattagaatttataaagatcctgaatttatagtaaaagatttattgcttccatgaattagcaatttggctgagctaatttgtaaatgatgtggtcgcttgaaagactatacacaaaagaaaattggtaagcaaaaaaaaaaatacaaaatatcggaagaattactgaattgagagaatgaatgctctccacaatcaatgtcattaaaaaagcaactttctgaaataaaagagaactgtctacttttttctttgtcccttttttagtaagcagtttgcctctggtttaacaatatgaacatacttcctttcccagctggaggcatccgatcctgggaatattgatgtatgtacaccccgtagattatacttttcagactagatggatttctaaattcaagatctaccaaatacttccacaattctaattaaaataagaagtttgggagtcagaaaccttttgccctagaggcttgccccaccatgtattaattttcaccattattccatttaactggggttactcatttttatttcctaaaaaattctatatctggaaagaggtaccattctacagcatttctggcaaatcataaattaacctacagtaaatgacattaaggagatagctttgttctgtaaatggataggataccatatggctttgatgttagtgtgaagttaatcacaagctccataacaggccatgacatcatttcataataaattgcatgaacaaatgctgccgttatctgaacagcatgtgaattttggtacctataatctttagggaaaaatgaatataaaatattgagttaaaaaatagatataaggatggtaccatagcgtctccactaaaaatacaaaaaactagccgggcatgatggtgggcgcctgtagtcccagctacctcgggaggctgaggcaggagaatggcgtgaacccgggagacggagtctgcagtgagcttagatcgtgccactgcactccagcctgggcaacagagcgagactgcatctagagaaaaaaaaaaaaaaaaaaaaaaaacagaaacgtctaagttgcaggaagtcagtaggtgtacttttggagtcatcttaaaaagagacgatagacatttcttccatttctccctttgctgccatctggcaggcagcctacaatgtgattgatccagtaggaagagtaccctatgggccaatctatgagccctgctagctaccctggaaagaggctgaggtgccttttttcaagaccccaacactagctccacaccacccaaccacatcgtttaaatttcagttattttctggtacacactggtacacatttgccaattatgtacaaagactgtcaatgaaatcagctgttcactatgagattacagtgtggctattcttttgtaacaaagtacttgattatctagagtattttacttcaaaatatttctgaaaaccatacttccctgtgccgaatcctcagtcagaagagagctgacaatcaatacagaagtaacatattgttggaaagaataattagaacattaatgaaaactgatctcattcatttttcttaaaaatggaggaaataatgttttctgatttctctccatcattccaagtgcaaggtaccacgtaatttatatgtaattcaaacatcaatagagagattttttttatattgattgctcccactttagtagtgctctataaacaaataaagaaattaactgattttacccctgatcagatgatctttctttggagatgtgacatttaatctgattattcatgaatatgttaatgagagagttatcacatgccagtcattagacactgaatattaaaatgcaaccagtcatgcagtgttgatgacaagcttccttttccaatttgcaaggaaagaataagcaaacaagatgagtctaatctctgggttttgttactttttgtaaaatcttcagtggcacttatatgtgtcaagaaaaaaataatttcttaaaatcgcaaactcagggactgcaatgttttttgtcactcattccaattaaaccaatggcacttaaatttaacaggaatgagactttaataattaatagagtacagttgtgtgtttctaatatgcaagcaattccaagttgataaacagctttggattaccaaagtttactggtaaagctactgttaggaacttaaactagtcatgtattttctgtaagaaattactttgcaaagaatggtaggaaatcagagatttaatctcactccaccaagaccctctgagggcaaagaaaatgtgcgtccaggaataagcacaaggcctcaaacatagcacacacaaaataaagattagatgaaggaagaaaggaatgaaaaatacctggatgtgctatactagtagtgtataaaaatctaatcattatttaaactttgtttctatgtgaaaacttaatggaagattccatattggctctaagaaacacagcagctctcttcctacctgtctgccttagtaaccagcagtgagtgacacttttctcttacaaccagccagtggcctcaggatgctatgctagtaacaggagagcatgaaactcctgaagtgtcaggggctgtcatggctttgtgtggacattcttaggtgaggtacagcgatgacacatcgtagagaagaggaggtggggtagtcaatcgcctcagacactaaaccataaaacatctctgaaagtgtaaagcaaagaagaaaattgtattcatcagaattcttcttaaaagagaatactgggtgtattacaaggacctcttggttaagctgcatggggtagactgtaagaggcttttgtctgttccactcacagcaaagcccgtatgctccaggaattgttagtaattgctgtgtttgtttggtgaagtggatgatataagaagcagggagtgctgccttccggagtcctccttttctgcctttgttctcatccaggtgccaggactcatctctaaaaaaaaaaacagttgagaaaatatttagagtatcagtttgaaggggtttcaaattactctgctaagagcaccgaaatgcctgtctctagccaggagtcaataaatggggcaggaaaaaggagggactgttccagtggcaagtgaatggagccgcctaaagtattgcttgctcactttagcaaactgccttatagtattaaacagtacattatgagactgttttcaccaaacatcttgaacaacagacaggtgcatttttcctgttattaaaatgtgggtcataaaggcaaagctacagagacggaaaacagatcagtgaattccaggacacaaaagtaggggagaggtggactacagcggtgcccacaggaattctgggcagggcaggggggcggggggtgatgggattgtgctttatcttgaatgtgctggtgattaccaaacatatgcatttgtcaaaacttatggaactgtatgctaatcacagtgaattttatggcatgtaagttatattttaacttacgaatttttaaaaggcattatattattactctgaagattcagataaacatacacacacatatgaaattcaggaggtgttactagaaaaaaagcccagtttctccttatctaaaaaaattgccgaaatgggctatgattttttcaatatcttttccaatttttgcctcttataattctgtgtttaaataactaaagaaatctgaaattacttagcaactttgtactagcaatggtcattattttacaacctatgctcagatactaattaccttctcataattgtccagtatgcaactgagaaggtcaaccactaaaatcattttaatttcccttcagcttcactgattatttgtagagagcatttcgtttctaggtcaaatcgtcttaatacacacagatcactctggttgagccaaaccagattttcttcaaaagctctgacattgagaccctgctctggcatttcatttgtttgtatagaaaatgttaggcgtctctttgccaagtctaagctgtgattccaaaatcccctcataaccttgcttttcaactgtattccaaacatatataaaactgaaattgaccctacagtcattgccagaggcatacatagagagaaatgtacaatcacagtgtcattggacacacgcatataaattgcgtatctctaaacttcgcaaatctaatatggtattcacaatttgggcaataatgtcagcaacaaatttaattaaataaaaaccttgagagaaatagtggtttatttctgaaaaccaaatattgaaattttgctgagtggcttactttaaatgatcagaggaatgcttcataaattcttgcagtagcatcgtaagactttatgaccatagattctctgatacatttattgggacaccttgtaaaatagtgaagttgcagaaacacaaaggcatagtttttaatttcacatttttcaatacatattacacatgaaaactaaagttttaattaaacaaaggaagtcttaagtttgcattttatacattgattgacaagatatctcttaacataacatgcatagccaagttccttgtgtcacttgctttgcttttttcattcttccttaatttttactaggattttattttctatttctttttcaacaggaagctctgaagccaccacctagttcacttcaatagttatgtgcttttctacgtttcaccacaattttctcagtagttcagacgtatcactcttgctcgatattgattgagttatataatcactattagcaaatgctctttgatttgatcctttctaatgtgtattttctcagggacaggaccagttttgaagttgaacacacactggtgtgtaatgtgcatgtacagagtgcctctgaactatgcagagtaggaattgattcctaaaccccacataaatgtaactcagactggtttagaaaggctattggatttgaaatggcaaaatactaagatatgggaaaaaataagataccagtttaattttaaaatcagtattaatcatgtttaccttattcttgattttttaaaggaacaaaaaccaacatatatgttatttgatttgtacaaatttgtattattctatataacatccatatatattgtccataaccatgtgatcacatagtgtgtctataaggaccttgtatctagtcatatgtgcacctgttgcagtaacccatgctgtgtaggcaggttctatgacaattcaaatcagttctagtgataaatcaaacctgttggttgcttttattgaatgttgttctatttctgtctgtaagcgtatagccaggttaagagaaactgactgaactaaaggggcgcttatgactattccctaatgatatcacatccaaaacaatgaactgacagtgacttaaattattaagcattaggagaaatccctgtatccctgcagtgttcagttccttgaggctctgacaaatgacctccagtttgttggacaaagtaggcgggatatgaaggcagctcttatacacatactttattttggctggggcaagtatcactggatatctcatttggtagcatattaaaatatgcagatcttcatggatcagacaatattattaaaacagtttaatacagtcaggtgtttcttttttttttttttttttttttctttgagatggagtctcactctgttgcccaggctggagtacagtggttcgatttcggctcactgcaagttcctcctcccgggttcacgccattctcctgcctcagcctcccgagtagctgggactacaggcacccgccaccacacctggctaatttttttgtatttttagtagagacggggtttcaccgtgttagccaggatggtcttgatctcctgacctcgtgatccacccgcctcggcctcccaaagtgttgggattacaggcttgagccaccgcgcccggccaggtgtttcttaacgatgggaatgttgtgagaaatgtgattctaggtgattttgtcattgtacaaaaatcacagagtgtaattccaaaacctagatggcggatcctactatacacctaaggctgtatggtataacctatggttccaaggctacaaacctatataacatacagctgtactaatgctgtaggcaattgtaacactatggtaagtatttgtgtgtcaaaacttatctaaaatagaaaaggtacagtaaaaatatggtaggattatcttatgaaaccaccattgcatatgtgaagcatagttgactgaaacatcattaggcagcgtaggctgtatgcctcaggtgccaattatgtgattccatctgatagcaactatatgaatattatatatttgagactaaaaggctaacataccaatttattttgtatgcagcttttaaaattcatgctatttttacttgtaaaagttctgttcactactttaaaagctgaagcacattaccggaaaaagcatgatgtgacatcgttctctactataaagaaaacacctgataaccaataactttcaaggaacacacaccccatgccacatcctatgcattctaaccattttacaagcattatctcatctcatggaatccccacaagtatcatgtaagatagattctctgattattcccattttatgggggaggaaaccgtacttcagaaggttaaataaaacttgcttgagtgtaaaatatattttcttacctctcactaccatttactatgatacatttactaaggatttattaccctctgaacaggagccttgtgatctcacatttcccaacccctcctccagggagtggagttgatctgagtattcagaagtaaaaatgacagtagttagcaattgctgagaattgtccatgtgccaggcactgtggtcaacacttacaggtattatctcatataataatcagaatctatcaaagacataggtcaattattatcacagttttagtagacaaggacactgaaacttataaaggttaaaagtctttgtccacatcacagctaagaagtggcagagtccgaagaagagggaaggcagtctgactgcatggcctgttctagtaactattatgaaatagccaacggcacccaagacttagtagcttttgaagcttcaccattgaggatgtgcatttttaaagatggggtcagagtataaggaagtcttcctggtcctccttaagttccacggcagggtgcctgcctgtgtactctacctacctgttctaattctggggattatcaggagaagaaacaagaaagctataaaagccttagcttctcatgaaatatcttagcaaaacatttttatgtgaaaaatgtatgccaccttttatgtttatggccttgttttattattttcttcttttggaatatttctttctggagtttacaaaggaattatactgaacgctgatgtgaatcccaaaggaaagatacgtttcttctctaatgttctcaaatgtcaggaaatcatttagagagtgaatgtctttggtggctggttctaatttgcactgttgtttgataatgtgcacactggagatcaattgtctgaagatctccttagggctagaaggtcatctttggtgaattagcctgatgcctcattaaagatatgtcaattctcctttttccttgcaatgtgtagagtatgctctctaagtggagtggcaaaatgtacatgaggagggaaatttagcaaattagtttaatgagaattattgtgtttatttggagacttcgatttgattgaaagaggattttactattgggcttcctttttggcgaaggttatccgtagcacctactgtaattgcttcctgtaaaagagtcagtatccatgcagttgcactaatgtgctcttgtttggtgcatttttctcttctttaatataaagcatcttgactgcgaaaattttaaactccagtgtttgaaggatgaattgatgttgattttctgcaaaggaaaataataaatagacttggagaaaggaaaaggaaacaaatctcactgttagaggtaatgtggaaagaataataaacaaatgtaaggaagacaacatctgcgaacagggtctatctattaatgcttgttagggagaaaatgcctaaaatgtgaataagtaaaagcctaacaagaaataaggtatagcagccttccaatagtttgcaattgaaaagagacaaacttgtccaggcacggtggctcgtgcctataatcccagcactttgggaggctgaggtgggcggatcacaaggtcaggagatcgaggccatcctggctaacactgtgaaaccccgtctttactaaaaatacaaaaaaattagccaggcatggtggcgggggcctgtagtcccagctacttgggaggctgaggcaggagaatggcgtgaacccagaggcggagcttgcagtgagccgagatcgcaccactgcactccagcctgaggaacagagcgagactccgtctcaaaaaaataaataaaaatacataaataaattaaaaagagacgaacttcttccagaagcagaaaatcaaatacttgggcaggtttctaataatttataagagaagaacatattttatgttaattataatgtaggccatattttataagaagtagctggacagttaattctgtttcagttctttttcctctttggatttctttgcttctaatttatttttctgtttctatgattatttctctcagcttcaatctttagctctttctactctttaatctctggttatgtggggtaatggaaggcaggtgctggtgtgacagtggcccagtatcatgacattctgatagattgtattccctttgatctctacttaagagtttcatgcaggtgtttcggaggagagagaaaaaaatgtttttcctgacatttttgtcactgcagagagaattacagttttacaactatcatagagattcagaacagatgaatatatgtctatcagtgagcatattaaaacctaatattttgtgggtttgttgttattatttgcaaacttggcacagtaattgtgaagacaaaaattgttcttcaggctttgtgagtcagattaaaaaaagttttaaaattagcactagtttgtaaatgagaacattcaagaaaagaacatgaaacaaaatatatgaccttaaattatgtataattgaagagaacttttaggttggtgaagctatacttactgttttttaaagaaaaaagcttatcataacttatttaaaagacaaattttgttttgttttgttttggttttttatttttttattttttatttttattttttaattttattattatactttaagttttagggtacatgtgcacaatgtgcaggttagttacatatgtatacatgtgccatgctggtgcactgcacccattaactcatcatttagcattaggtatatctcctaaagctatccctcccccctccccccaccccacaacagtccacagagtgtgatgttccccttcctgtgtccatgtgttctcattcttcaattcccacctatgagtgagaatatgcagtgtttggttttttgttcttgcgatagtttactgagaatgatgatttccaatttcatccatgtccctacaaaggacatgaactcatcatttcttatggctgcatggtattccatggtgtatacgtgccacattttcttcatccagtctatcattgttggacatttgggttggttccaagtctttgctattgtgaatagtgccgcaataaacatacgtgtgcatgtgtctttataacagcatgatttatagtcctttgggtatatacccagtaatgggatggctgggtcaaatggtatttctagttctagatctctgaggaattgccacactgacttccacaatggttgaactagtttgcagtcccaccaacagtgtaaaagtgttcctatttctccacatcctctccagcacctgttgtttcctgactttttaatgattgccattctaactggtgtgagatggtatctcgttgtggttttgatttgcatttctctgatggccagtgatgaagagcattgtttcatgtgttttttggctgcataaatgtcttcttttgagaagtgtctgttcatgtcctttgcccactttttgatggggttttttgtttttttcttgtaaatttgtttgagttcattgtagattctggatattagccctttgtcagatgagtaggttgggaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtcttgaatccatcttgaattaatttttgtataaggtgtaaggaagggatccagtttcagctttctacatatggctagccagttttcccagcaccatttattaaatagggaatcctttccccattgtttgtttttctcaggtttgtcaaagatcagatagttgtagatatgcagcgttatttctgagggctgtgttctgttccattgatctatatctctgttttggtaccagtaccatgctgttttggttactgtagccttgtagtatagtttgaagtcaggtagcgtgatgcctccagctttgttcttttggcttagggttgacttggcgatgcaggctctttttttggttccatatgaactttaaaatagttttttccaattctgtgaagaaagtcattggtagcttgatggggatggcattgaatctataaattaccttgggcagtatggccattttcatgatattgattcttcctacccatgagtatggaatgttcttccatttgtttgtatcctcttttatttccttgagcagtggtttgtagttctccttgaagaggtccttcacgtctcttgtaagttggattcctaggtattttattctctttgaagcaattgtgaatgggagttcactcatgatttagctctctgttggtctgttattggtgtataagaaagcttgtgatttttgtagattgattttgtatcctgagactttgctgaagttgcttatcagtttaaggagattttgggctgaaacaatggggttttctagatatacaatcatgtcgtctgcaaacagggacaattcgacttcctcttttcctaattgaataccctttatttccttctcctgcctaattgccctggccagaacactatgttgaataggagtggtgagagagggcatccctgtcttgtgcccgttttcaaagggaatgcttccagtttttgcccattcagtatgatattggctgtgggtttgtcatagacagctcttattattttgagatatgtcccatcaatacctaatttatggagagtttttagcatgaagggttgttgaattttgtcaaaggcctgttctgcatctattgagataatcatgtggtttttgtctttggttctgtttatatgctggattacatttattgatttgcgtatgttgaaccagccttgcatcccagggatgaagccctcttgatcatggtggataaggtttttgatgtgctgctggattcggtttgccagtattttattgaggatttttgcatcaatattcatcaaggatattggtctaaaattcgcaaatagacgcaataaaaaatgataaaggagatatcaccaccgatcccacagaaatacaaactaccatcagagaatactacaaacacctctacacaaataaactagaaaatctagaagaaatggataaattcctcgacacatacaccctcccaagactaaaccaggaagaagttgactctctgaatagaccaagaacaggctctgaaattgtggcaataatcagtagcttaccaaccaaaacgagtccaggaccagatggattcacagccgaattctaccagaggtacaaggaggaactggtaccattccttctgaaactattccagtcagtagaaaaagagggaatcctccctcagtcattttatgaggccagcatcatcctgataccaaagccgggcagagacacaaccaaaaaagagaattttagagcagaaatttttttaaaaagaaattcaaaaaaatcatttattaaaataggcaagtacttctaaaagcagggcttgaaggatgcactgatatgtactttgataatgtaagccccaaagatcaggacaggtgtctgtcttatttgctcttctatctcatttacaattccctgaatgaataatgaatgaatgtgtgtatcacaagaaaaaaatcatggctatggttgccattcgaaagaggcacagagttataacactagtcataggtagtgcagatagaagcaagatcattgcatgggggctggagggaacttaaataactagtagattacatataataacctcgattctcatccctcattctatgtcaggcttagagggtctgcataccccctggccacagtgccagtggagaagggtttctatcccgtcatgttctataatatgtatctacgaaaaatgagatcagggaacatccctgtgggtatgaaacaacaaaaactttttgaggaagtgaggaggtatcttgttggagatgggggtgaggggcacttggcatctaatgactgcataactgtattctttttaacagcttgactgagatatatttattcacataccatataggtgacccattgaaactgtgaaattcaatggcttttagtgtatccacagagttatatgttcttaagtcagatctgtggagtcaggtctcaactaagctacccagtgtgtgtgtgtgtgtatgtgtgtgaatttgtatatgtttatgtgggtgtttgtggttagggtggggaactcaagctgcactgacttccagatctgtctgtcttcaatagtgttggtaatatacttcaaaatgagcaatttcttttttcctgtgagctctctgaactatattttatctaaagatactgtctgaaatttcatattaagctatgggaaaagtcacatatgtcactgttacaggtgacgaattactatgttaaaacttctagtgaaaaggtttccaacattaaattcacattaatgatttatagtcttgtattcacactttacaagtgctttgccatggttaagtaagtctcacccattcttgtaaaagtgaaaacatatctgcttaaaagcctggcaaaatgaagcttagaaaaatcctccttttagaaaatcacataatgtagttcatgaacatgttcgagaagggagcttgaacatgttcattgtctgtttctgtgcttaaataccatagctttgtgaaatatatgtgaatgctcactagtttgtgtgtgtgtgcacgtgcacatgtgtatttatgtgtatataaattagaacaagccattatttttaattatttacattaaaattttcagagggttcaggtataaataaatctgtataagtagtataatatatagtaacagtaatgtataacatataagctgtaaattacataacataaatatacattataggtaaaagtatatatacacacagtagttaaatatgtgtattttaaaattataattgaggaagctaattcatccttaagtacatttccggaagttcctctgttggtggacatattctcaaattttctggcataaataatgtttcagtttctgattaaaaccattcttgttatccacactaaatagacttgcctggccagtatctaattttatggtggagtcttgagtcatcagttctacaaagatatttaacctgttcatgataatcacatgcaagagaagctggtcttctgtgacctgcagccagtgtgccagaaagaaggtgtcaagacaagagtcgcctagtgaaacagtgctggtgaatggggaaaaagagcaaaaattaaatggaatccaagccagtttgacacaggacaaattataaagaaaatcctagaacaccctggagagaaacaatgggcaatgattcttcaaccaaaaaggctctgaggcagggcacaatatcaatggtcacaagaggacagggactcccggccatatgccctatgcccttgtctcatcggaggcttgactgagggcagagtctgtagtgccaatgggtgaagggataacaagaggcaggtaaatcccaggagctgtttctacctccagagaaggaggaatccagcaatgctacagcatctcagtccaaattggctccctcgctgtttgacagcaacctttagggctccattctggactttatctcgagctcctttcctcaccccatttcctttaaagaatggccagaaaatctgagcatgatatccttctgttaagaaggagaagaaaaaaataatcttatattagtccatgatgtacactgaaagaaagaaaagttcagtatctttataagaaccttgtctgagggattatgttaaaaaaacaaataactgaaaacataatataatattcaaacttctcttgtttgtttcttggttgttactaggccattaaaaatcttataaaacattaattgtttaatcttggaacaaaatgtatttaaaaaggtttaaaattctgccttattcctcatgagcagtgataaagagaaatcactgggaagcaacaagtgttggcagactggttcagcatggtggctgcgaaaagaaaaacataaggtcttacttgataaacagtgcagcacaggaaatccaaggctcaaactccgttttgaccttcttgatcccaacagttagaagcaatcattctctcctgtcagctttcatatctctttacctattcttttgattagagatttttaaaagaaatcttttactctactaatctatagtcatcctaagaagggttcccgtgtataaagaacatgttttatatttacatgccacagttacattagcagttccatgaatttatggagacttaagtgcagctttgactcttcagcctcagctcccaacctttccaactcatcacccaatgtaccacaattcttatcccatcagaccctggatctggctatagtcatttcctcacctgacctggagccaggactgcacatgaaaatgaggcttccgtatcacaggttggacaaacctctctcataaaatgcttttgtatttctctacttcatgggtacacagaccacttcagggacttaaatgtaacccttaataccttttataaggtagatgttgtgttttaaataagttattttcaagtgatcctttggaacaaactttatgcctttacatttctattttccaagcatatagggggtgagaaaacatgaatattttccccatgggaaagaagtgaacgttttcaaactttataaggaaatgacttttctctttgtagttataatcaggaaaaaaataataaagcccatagcttggggtcatttttaattagaaaaactttttacctgcaaagcaaaaagtctacaaaccagatttttatgctgtgaaaattttttattatgcaatacttctttaaatgttttttaaaaaactaatattttcttatcttataaatgtatgaagattttgagtctaagagaccaaatagatttatgttaaaacttctctgggcctagatgaaattctcagatattttgtaagcaatgaaaaattaattttaaagtgtttttccccaatgtgtaatgcatatttataacctacagaacaaaaaacacaatcatattttggatctttaagacctgacatagcaaaaagataatttgctttgaggccctttgatgcatttaatttaatttattggaagcaaattaatgtgaaatgataaaattattattaaaatggaaatagaagaataggaatgactcaaatcaacagaggagagaagtggctgattaccatacttcataggataattcccaatttaatcatattaaatctaattgttggcggacagatgatgggaaataccgctcttgctttgtagtagacagaagaagacagaaaaaaattttaaaaagcaattcagaatgtcactaggataaaccaaaaagtaaactgaaaatgaagaccaaagtggatttcttaaggaaacattgcctctttacattgccaaatgaaaatttggtagatgaatattctatggttttagataatcatttgtaacttgaaagggatttatatacaacttaataaatatatattgaatgactgctattttcaagatattgtgctgctgatctgtcttctagctgataaatttagctgaatacctggagcaataatagaaccaagttttattgatcaacagcaatctctattaaaatggtaatgaacagcttctgcagtatatcttgatatattttctttttactgggtgtgatgaatgtgtaaagtagtagaacttatgatacatgtgacatgatgtaagttcatgataaatgctagaggattaatttcatatagctacatattgtcattatttcaaacttcagtgaaatgaaaacatgagtttttcactgctgtttttaaatttttgtgatttttcccctcagtggcaattccaaaataaatggaggaaactggaaattattctgaatattgtgtatgaataaccatcttattaaatagactcatttaaaacattttcaaaaatttacatctttctcaataggaaatgggtcctttaattctgctcatttctctccatttttagtgatgttattttagtctaaatttccataatctttattctgggctattatagtaatattccaacaggctttttctcttcctatttcttgggatattcctatttatttcccaaaccatagtcttaaacatcttaaagagaaatatacagaatctgaaaagacacttctcaaaagaagacgtttatgcggccaataaacatatgaaaaaaaagtcaccatcagtggtcattagagaaatgcaaatcaaaaccacagtggggtaccatctcatgccagttagaatggtgatcatcaaaatgtcaggaaacaaaagatgctggagaggatgtggagaaataggaacacttttacactgctggtgggagtgttatttagttacaccattgttggtgggagtgtaatttgtcttacaccattgtggaagacagtgtggtgattcctcaaggatctagaaccagaaataccatttgacccagcaatcccattactgggtatatacccaaaggattataaatcattctactataaagacacatgtacacatatgtttattgcagcactattcacaatagcaaagacttggaccaacccaaattcctatcaatgatagactggataaagaaaatgtggcatatataccctatggaatactatacagccataaaaaatatgagttcatgtcctttgcagggacacgggtgaagctggaaagcatcattctcagcaaactaatacaagaacagaaaaccaaacaccacatgttctcacttataagtgggagttgaacaatgagaacacatggacacagggagggggacatcacacactggggcctgttgcggggtggggggctaggaggaatagcattaggagaaatacctaatgtagatgacgagttgatgggtgcagcaaaccaccacgcagttgtatacctatgtaacaaacctacaggttctgcacatgtatcctagaacttaaagtataataaagaaatatataaaatctgattatttcaccccctcgatataatggaaagagtacattgtaagtcatacatctgaattaaatggaaaaataaaatgatatagtgctaataatcagatatacagaattgtagctttacaaagtataggagataagttactctgaagattcctttcattagaaaacagccagatggactggtaggcacctgtatcgcaactattcaggaggctgaggtgtgagaattgcttgagcccaggagttcaaagctgcagtgagatatgatcacgctggtggatagtgactgcactccagcctgggcaacatagtgaatttttttttttttaaagaacaactagattctccataaaacagactatcacactctaatacataactgagatcacaggaaatcagggagaattctaaaccctcttaactcattctctgagctcatgacagagtgggtagtaagtgaaaaactgaaaaattgcgtatttttttagagcagcttagtggacagacagtattttagaataccagaaagcacaagaaatgtgtgtgttgttatgcagaattcataaacaactcttttgactcaaggaggaaaaacataggatcataataaacaaacccttaacaggttggaaacaagaatagcctgtaacatatgaagggtcactcaaccttgttagtaattaggacaacctaactaaaatgtataaatgctatttcacataacaagactgaccaagggttgtgatgatacgcaataataggaacttacgtactttgttattgatagtataaactggtatggacatgtggggaaaaaacttgctcttgtcttacaatgttgaacattgaattactaacaactcagaaatttcacattttatgaagttcttcttagtgttgtttatattatgagatagaaactgttatctgtatagtacaccaagataagaataaggcagttcctgagtggaaacaacattatgatattctcttattgctgtcactcccttccttagacactggctacaaaaaccaatgaactaattcatctgggcataaattgcaaggttgagatagtgtgtcaccaatgctatatattattctgaaatttgtatgtgggttttcatgcaaaaccattgtctgtcacagtaaagtatcttttgtcatcactaagtaaaaaccttttcaagtaacagactcagaccacgtgcacacaatggatgggcttatattatgataggctggctatcctaataaaatattttaaaaagcataaatggtgggaagagcaatagaaataaagtatgtgaagaaggatactttaaaggtgaaaaagtataacaattagaaataacgataaattgaacaacaatgcaaaaggaaattcccaaaatgcttccaaaacaaggacagaaaagaaaaaagttaaattcagttattaaaaaattaaccccattttaaagccacttgcatttattagtgttaattacttgtgttaattttaacacaagaaaatggcaaactggtaatgccttcctactgtaatataaagttacttcaaagaggaacattttctgaatgacacaatgaatttatcaaggacatggggcttttgggaaatagacctacgactgttggttctctgattatctcactgtgggctacttctgttttcattatttatttgcgatgtgggcacattaccaaactgctttcagaattgcttaatgtgtaaattcctctgaaactttgaacaagagatttttgacaggtatgattagtaagtaggatttcaagacatttgacttcactgaaaaattttactgtcatgacccctttaacaatctttttacttctggagatgtgtttccaatttgggttattattaatgactgatgtattcttaaaggaagagaaatagaatattatagacttatttcacagtaagacaagtcattaaaaataactttgaacttcaagaagtagtagaaatgggaatttgaattttcagaccaaatagatcatgacagaaatcaaagtgtagaattacaataaagtaaagagactggatcatttcagtctattttgatttgacattataattttgtggttgggaggaaaaagaaggcaactgtatttcatcagctttgaagacttcgttgtcgtgaagaaggctggataacttccttatgttgtcactatcttgcttccatccagagactgtggagtctttctggaaccaatatggttgaaaaagcctttcctttttagtcagcagggcttagtattcacagcctctgttttaaatacaatgtaacttgctttattacaaggcatactgtgacttataaagctagaaattctgttcaggtgattacagatgaaaaaaatgatgaaaattgagaggttgccagctcacgttcttttctttctcactaaagagtctgcttctattttggtccattttaaagtttccttaactcctcgagtcacagagaaagtagtcattcttcagtgttgccagctcctgattccagatgagctaatgattccacagagctatctctttggttcttaactctgcacctttactgatagtcattgtagtttaatttttattatcaatgtttatagggcctttgcggtgtgtcaaattttaggcaccccaaaatataatagcgaacaagacattcatggtcactgccttcatggagcttctcggctagactgtgtataaattttcaatctacagagaatgtctctatgtttaataacaatagaacatttgtattgactcttaccaatacatgtaaactactctttgaaaagtacactaaatcccaaagtgtcttttggaaaaggaatgttacatttttaaaattagacctgatagtccatagttgaatgctaatatgatggtcaatgactaggaaaaatgttccaattcaaaacaatttcaaagttttcttcagtacccttgtatcatcatgacttgggaaaatcatcttaggaagtattggatgttatcttggaagttaatttatagaaacatgggtggggcattgtagatcatttagtccttaaatacatttttggctgaaaggaaatctctcattaaaagggaaagaaacagaagaagagaaggaagaagcaaggtaaggtatttgctaggatcacataactggttagtggcagaagtagaaatcatttccttggactctttagtgctttattactgccctcttgtaagtttgttgcttttccactgactgttgggtaagaaattataatcccagaacagttctttgtatattaaaaaaaaatcctttacatattccatagaaactgggcttggtttgtaaagctgaggcccaggagaagctctttttcttacccatttggtctttaatgttgcttgcgaatgcatgggggtagaactctaataacaatgatggacacgatgtccttgcacataaacatttggctcctcacagcatgagatgtctggtcagccacagaggataaaataatggcgtaaagatttactgtcagggagctgggccagtctcagcaggacagcggctccaagcagatagatggcctggtatgcgtaggtcacctgtgtttacactgatgaatgtgtgtggtttccctagtctgcatcattatattgagttgtgtggtgttggtagcacttgttactcaccctagaatgtgcctttctattgaaagacaagtagactaatagcttggcttcccagaaataaatgagacaattcacatgaaagcaattgcagttagacaaaatgacataaatattaaagattaagaataatattatttgtatctgtaatatacagaaatagtcaaaaaatacttggggctgcataatttgtggttgtagcagttgctgaatttagtcccatatagtgatttggttgcataatttaatgtttatgttgtatttgtttaatacatcactttcctgaatgaaatgattgtggtatgaagttataagaaataatgtctttggcttgttatagaaacagttattttagggattttttgtacttttgaagcagtttcaattacaagtcatttttcatgagttctgaagtaagttttaggcatttgttatgagatcatattattagcagcttagatgaaaatccaaaatgcatttatggatattttaattggaaaattaagtggatcttttataaaattaaatactctgctataatctcttagaaaaaataaatcccttttacctaataggcaagttcatgagaaatctgtaatgatatctctcaacatagcatgttaacttatagattatataattataaatttataagcctagtttatactaagtatattcaagttataagtcacaatacgtgaaatgaacataattctctgaatatgtcacattttttaaagatatctgtaatcccagcactttgggaggctgaggcaggtggatcacctgaggtcaggagttcaagaccagcccaaccaacatggcaaaaccctgtctctactaaaaatacaaaaaattagccaggtatggtggtgcacacctgtagtcccagctactcagaaggctgaggcaagacaatcacttgaactcgggagacagaggttgcagtgagtcgcgatggcaccactgcactccagccttggagacagagtgagactctgtctcaaaaaaaaaaaaaaaaaaaaagaaagaaaaatatatctttattttcaatattactgtcagtgcctgaaatcatgccttgttttgctttgtctacaaatatattctttcaaaaatcatccataatgaatatattttccattctaaggtgtacttcatttttggaaacagaaaaatgccaattatcatccatgcttgtgaatacagtaaataattgatctccctacatgttacctttttaaaataaattgaacatgaataatgagtctaatatagtacaacaggtgtttctgacaaatagtattggaaaatgtattgctatttgattttctatttatctgtgaagtccttttaaagatatccatgaaaactctctcttatgaatgtatggctaattgtaaagtagaatcctcataagaccagtattctatgatttcctcttgattaaataaaataaaatttaatgtgacaatggtttgtgtacttttctttccttgtcttctctgagcatctctctagaaataggaaaaaaaaatgggataggttttgtttgggtgatttccactgaagcatagcaaggtcatgcttttgtattgtctattatcagttataatttctcaaaaacagacagcaaacaggcagtgttcaaaaatttgtaatttactatcccgtgctaaagacaaaccacagagtaaaaccgcaacccggttaaccaccaaaacaaccttcaatcattctgactggttctgcatgtttcaacgtttatggtcttttggctgaaggccaaagttcatctcttattaccctttcttttccatctgtgaagatcattgcacacacactcgttctgcattccaaacaatttcacctggcaaaggaactaagtaaaactgtctctcatcttcattactattcatttcatctttcaaatcactgaatcgtgaaaattagaagtaacaaaaaaaagaaatcaggtgtattaaaaacaaaaatttgaaacagtatatctgtgaaaccgctcagtgttagaaattgtcactgatccatgtcaaattcagcaaacaaaactgaggcaatttactttcacattttactaaatggccacttgtaagcatacggatgagattttgtctttccccaggctggatcagtctgttggtttcccaaacagacaggggctgagtggcttaacaggtgtgccaatgtgagaaagaaacacaaaagcagctgttgttaaaggcgttaggtaggctttgccaagactttacctctcagatctcttctgtgaattgatgactaaagtatgtcaactttggaaaaatattcttgaaatattttccttgatttctgacttcaaaaggcaaattataaacaccttaatcaattaatatttactactagaatgattgcccaaaagactgaactaatcaagatagaaaacaaaagtattatggcttattatgtcaatctcctatttaaaaagcctcaacattttctcatagcctttagaagaaacaattttttgtacattgagatcccaattcaatgcctctttttgtccatatctcattgcaactttgactcatatgatatcactttgctgcaaacagattaagctactaatgaagacatgcaattatctttttgtcatctctctctctctgtagctctctctgtgtgtgtgaatacatgtatacttgctcaactaaaatgatcctcacagcctcacatattaagatctcatttattctcaatttgggcttgacttctaacaaaaactgttccttaactaatccaccaatagatggcatattcttctcctgagctttcatcctgtttatcatttacttggtattccaacctacctctatggcattgctttacagatctttaatgtggtctcgcattgatatggaaagtttgcttttgtagatttaacttatcatgtgagtcaatcaaagatttccaaatagttgatgaactttatgagagaaaaggcctgggttttctttctttgcctcccttcaggtacctggtggaggatgctatttctagtagctacttcaaaaaacaagttttctgagttgctctcttatttctttaaccacattgtctctgtcgttctctgtctctctgtttctctctttctctctctattcttttgcatggacaccaaattttgtctcttagattttgaccctcttatctttgaatactggttttgttctctaaactactagttttttgccataactgttttttctttgggattttggactgtatttcttagatctaaggtacagacctcctgcagggacttccatgaaccatatatccattgtagcaatgatcttcattgtcaaaaagagtctaattttaaaagcaaagatttgtcaaagaaaccttttagaatgcaaaatagctaggaattttaattctattaaatatcaacaataacaaaaaagtggtaactatgattattttctttttgacaaaataagttcatcattaaaaaaaccaataatgccaaatcctaaaaataaatttcagcctgtaaaacatacattcaagcatgtataaatatatgcatgtacaataaatatatttaaaataatttttaaatttctagactgttgactagtgagaaactagtgaaactatcgagagttgggaacattccgtgtaagggggtaatgaagttgagagtgataatggtacctctaacttatggctcagactgaggctagattcaccaactttgcatagcgtcctctgcatttagattttctattcaacattcttgcaatatcttgaatgaaggcatagaatggcagcacattaaatttacaaacggtaaagatcaaagaaggaataactgaaattattttgagagtgtggaattctgagctaagttatagtgctggtgtttgaacggagttttaatatgagttttgcctgttaggtgatttctgccaaaaaaaaaaaaaatacgaagtttgcattaatgaaagcagagtattcagctaaaaggaatattcatccttttcattttgaagtttgttattataccatatctggaatgttttgtttacttctgcatggacattttaaaaaaacattgaaacaggagacaatggcatgaaaaggatgatcagaaagatgaaacatttggaattgatgctttatgagggacattgaatatactggaagtatgtagtctaaagcagagaaggctaaagggagatatgatgcaaattcatgagaaatgttcatacctaatatttatgagtcaaatgctaagtataattctcatgactgatccagtgatgaggtaagtgtgtggacacagaaaactgtcacaatgcacagtgtgaaaagaataacagtagttcttacgtcagggtacaagtcgagaaaacgaatgcctctatggattacaggtggagagaaatgtgatctagggaaaaggggaaaggtggtattaggcagagattagaaggtgctgtagtttttgagctggagcctagaaccccacactctctcagcctctgagctgcagccacctcccctgcagctactggagacaccgcagccactaaggctgcaggacctcctgctactgaccgtgggtacttctggtggctgctgccagaaacccaatcccttgtttattctctgggtttcaattttacccccaaacctgatgaaataccgttggcaagggagtcttagaaattttagttttcttattctcagtgattaaagaaaagggcgcagagaagattatgggaatgttagaaggttagttagttaccatctagcacaaatgggattaagtgttagaggtctaggcaggatatatagagataaccaatttaaatggtcaaggaaggttaatatctataagtactttcaggcctgcctttggaaaggcagagtggagttctgtgttgctccagagagcaatagatgatagaagttattaggagatgaaatttaggtatttgtgaaaaataacttcctcataactagagctcatggcaaaaatgtcctgctattttaatatgttgggtgtttgagcaaaagtttaattctatttttttcagggattctctagaagagcttctcatagtaggcagtagatggtttagttggcagctaatgttccttaaaaatttacaattttatgattcccaaaccactcatctaaaaataacaaaatgtgtttaaagagtagattagttaatcacaaaacataaaaggtaactagccaaaagaattaaatatattcatcacgtcttaataactttgaggaaaatgagtacatgaggtgggaaacgaacattaaaggagtttcttatcagcccttttcaggattccaaacttttcttataaatatccatcagtgctccaattaagcctttggagtgatatgcaagaactccatagtggggagggaaaagtgcctccttccacacagatgttggcacagtgctgaaggatggcggctggccagcctgctttacaagtgagggccaggagcagcatctgcatatgagagcagattatcccattggcaaactccattaacactgccaagggcacggttatgctgttagtgactaagaagtcatccctttcacctgaacatacctctggtaatttagggtaataaagaggatgcctttcttttatatgcaagagaaataaagacttgaatggtaataagggagggcaatacatattcatttattatgtaagtaagaaaattcactggtaaataatctcataatatctaatgattggatgatatctaagcagtatgtcgatgatatctagtttatccaccattgaatcccttataaaacagaccagtcagctggtacccagtggtcttacatacagtcaaagatgggaagctcaggatccccacatgcagccaactggaagatgggatagcaaagtcagaaagacctgagttcaaatcttcactatgttggtcattaactatataaacttaagtattttatatcatcgagctaaatttcagtgtgtatacctttaagatagtaatgtgtacttcaaattgttgttacaaaattaaaagaggtaatgtgtataacagctatctcaataaatagcagatgttttaattccaatgtgcctacttcacactgttgttacaaaattaaaagagataatgcgtataacactatctcaataaatgggaggtgttattctatctttcagatgtctctaatggttagaaacgctttatattaaactgatttttttctctataatttaagcctgctaatcctcattatgacttaagggcttcttaaaacaaatgttatatcttttatcttttactgaaagtctttcacatatttgaaaataagaatcgttaacttcactcatcatttcttttatggactgaacacacccagtccctcaacctttccttgtattccgtggctcttagccacctcaccatagcaagaagtgaggcggggaatgtggaaggattgtgattaagtggttgaagtgcagagataaggatgggaaatgcagggtaaaaagcactggaacaggcccagctttgttttttggccaaaagattcagcagctctgatcggcttactgatattcacacggtgctgaggttggcatttttccagaggcattaagcatcattccactcacggttgacagtttccagaaaggtttctcccaaaaacacactctcctttgatttcttcctgaaaatcatgtatctggtactttatcattttagctcatatatccacaggcagccctgggtgaaaccacactttcactaattttaatcatctatacttaagggcttttaggttttttttttaattgggttcattaaatcatactttaatgcattgaaattcaccattttcatgtgtacggttctacgaattttggcaaaggtatgcagtcatgtaaccactgcccccaaaaggacccccatgctccgatgtaatcaatattctcccccaatccttaacccctggtcaccactgttttgctttctgtctctgtagttggaccttttctagaatgtcacataaatgaaactatatagtttgtacccatgctatttctgcttctttcatttaatatgatgctcttgagactgtaagttgtatagcatgtatcagtagttcccttttttgcagagaatttttccattgtatcataatttatgtatgtgccagagttgtttgcttatccactcactaggggatgaacattggagagtttttctttttctttctttctttctttcttttttttttttaaataaagctgcaataagcttccatgtacagatcattgtgtaggcacatgtattcattattgttgggtaacaatgttggagtaaatggctgggtaggatggtatatgttcatttttgtatgtttaattttatgagaaaataacaaacatggttataccattttgcatttctagccaaaaaatataaaagttttagctgctttgcatatttgtcagcaattggtattgtctcttttaaatacagccattttcataggtgtagtgtttttttaatgtagttttaaactgtaattcactcatggtcaatgatgccgaacatttttcatgtgtgtgtttgccatccttatctgccatccttatcttttctttggggaagacagttcagttcgttttctctccttttttttttttagacggagtcttgctctttgtcacccgggctggagtgcaatggcacgacctgggctcattgaaacctccacctcccgggttcaagcgattctcttgccttcgccacccgagtagctggaattataggcgcccgccaccacgcctggctagtttttctatttttagcagagatgaggttttaccatattggccaggctggcctccactccggacctcagttgatccgcccacctcggcctcccaaagtgttcagattgcaggcgtcagccactgcacccagcccagtttgttttgttttgttttgtttattggtttgttttctattattgagttcattatattcattatacataatttgcacaccagtccttaattatataggtttttttgcaaatattttccccacactgtggtttattttttatattttaacagggtctttcaaatagaatgttttaatttttatttatcagtgtttttcctgaccagtttgtattttttatgccatataaaatatctttgtgtaaaagatgtcacaaatattttctcctccattttctttgataatttttgtagttacatattttacatttaggtctatgattcattttaagttggttgagtctttttctgcatatgcatatgtaattgaacatttttttaaataccatattttctccttttaattgccttagtgccttcatgagaaatcaactgaccttatatttgcgagtctgtatccagacactctagtctattatttcctttgtctatatttatgtccttttgcaaacaccaaattgtcttcattgcataacattagaataactacagaaatcagagccgggtgcagtggcttatgcctggaattccagcactttggaaggctaaggcgggcggatcacctgaggtcaggagttcgagaccagcctggccaatatggtgaaatcccatctttaataaaaatacaaataatagccggctgtggtggtgcatgcctgtaaccacagctacttgggtggctgaggcaggagaatcacttaaacccgggaggcagaggttgcagtgagccaagatcagccattgcacctcagcctgggcaacaagagtgaaactccatctcaaaaaaaaaaaaaaaaaaaaagaaagaaagaaaaagaaaggaaaaaaaaagaaatcagttaatgtgagtcctccttagttgtttcactttctcattttttttttaattccattctagatcccttgcttttccatataacctttagaatagctggatcatatttgagattgcattgaatgtataattcagtttggaggataattgacaatctaacaatattgagtcttcccaaatatcggtctattatatagctccatttatttaggccttttaaatttatctcttttatgttttgcatttttaagcccacatattttgtatatattttcttcgctttaatttttgtttgtattttaaactgtactttttccctcatttgatcatgaattgttatttctaatataaagaaacataatggaatactttttgtatcctatgaccttggtatactcactagttttagcagcttttctgtaaagtgtttgggattttctatatacgccaccatgtctactgtgaataaagaaaattttatgtttgctcctttccaatctatatgccccaattttttatttattcatttatttatttatttttgtagagttattacattgattaggacctctaggtgaatgtggtaaaagcaagcctccctgctttcttcccagtcttaggggaaaaacgttcagtcttttcccagtaagtatgttacctgcaggcttttgtagatactgtttatcaggttgaagaagttcttttctattaccagtttgctagggtttttattataagtgactattgaattctgttaaatcatttttatcatgcgtaaagatgagcatatactttctcttcttagtttgttgttacaataaattccttttttttttttttttttttttttggcacagtctcactctgtcgcccaggttggtgtgcagtggcatgatctcgggtcactgcaacctccgcctccggagttcaagtgattctcgtgcctcatcttcccgagcagctaggactacaggcacgtgccaccatgccgggctaattttgtattttcagtagggatgggtttttgccatgttggccagactggtctcaatctcctgaccttaaacaatctgcccatctcagcctcccaaagtgctgggattaccggcgtgacccaccatgcccagccccatggattggtttttgaatataaaatcaacactgcattccggacaaaactccacttggtatgatacactaaatgttttatatattgctggatgtgatatgtaaggatttttgtattcatattcatgaaatatattgatctgtagttttctttaacataatttctccacaaggttttctatgtactaatggtggctcataaaatgaattggaaattctttttctttattgttagcaagattgtttagaggtagtaatatttcttccttcagtgttggaaaaaattcactattgaagtcatttgaacctcaagtttacttttttgcaagaagttaaaccaataatttatttttttaaatagatataggactatttaggctgtttcttcttcagtaaatattagtttgtatctttgcatgtgtcgacttcatccaagttgttgaatttggggagcataaattggttaatagtactctcttgttatcctttttgttttgttttgttttgtttgagatggagtcttgctctcgcccagctggagtgcagtggtcagatgttggctcactgcaacttctacctcccaggttcaagcgcttctcgtgccttagccttccgagtagctgggattacaggcacccaccacaatacccggctgatttttggatttttagtagcgacggggtttcaccatgtgggccaggctggtcttgaactcctgacctcaggtgatctgcccatcttggcctcccaaaatgttgggattacaggcgtgagccaccgcgcccggcgtcttgctatcctgacatttatcattcctttctctctctttctgtcagtaatctggataacgatttattactattattgattgttacaaagaatcagctttaagtttcacttattttctctattattttaatctgttttcaagttataatttccctgtgactatgtctttgacccttgggtaatttagaagtctgttctgtaattttttgttttgtttgtttttcatgtttggggtttttaagatacatttcggctgggtgcagtggctcatgcctgtaatcccagcactttgggaggctgaggcgggtggatcacctgaggtctggagttcaggaccagtctggccaacatggtgaaaccccatctctactaaaaatacaaaattagccaaatgtggtggcgcatgcctgtagtcccagctactcgggaggctgagacaggagaatcgcttaaacccaggaggcggaggtggcagtgagccgagactgtgccattgcactccagcctgggctatggagtgagactctgtctcattaaaaaaaaaaaaaaatacattttgtaactgatttctatttttaattttataacacttttaaaattatattgtcttaaactgacataaaaatatttatgtataatatgtaaattattacaaagtgatgcttcagtacatatactgtatattaatcagaatgggataattagcatacccatcatctcaaacctttgtcattacattatgttgggaacattcaatatcccccttttagctatttgaaactataaagtatatgattattaactataatcatcctaaagtggtatagaacactagaacttattcttctcatctagcagtaatattgtatcctttgataaatctctccctctctctccctgttccctaccctttccagcctctagtgtcttctattatactttttacttttatgaggtcggctatttttagcatccatatttgagtgagaatatgtagtgtttaaggatcctgttcctggcttatgtcacttaacatagtatctattagttctatatacgttgccacaaatgacagaatttcactgtttgtttatggctaaatagtattctgttgtgtatatacaccacattttctttatccattcttctcttattggacgcctaagttgattccgtatcttggccattgtgaatagtgctgcaatagacatagagatgcagatgtctttttgatatactcatttcatctcctttgggtaaatgccaagtagtgggattgctggatcatattatagttctatttgtaatttttgaggaacctctatactcttctccactttggctgaactagtttacattcccaccaacagtgtatatgagttctgttttctccacatcctttcaagcattggttacgttttgtctttttgataatagccatcctaactggggtcagatgctatcacattgtggttttaatttgtatttccctgaggactagtggtgttgagcatttttcatttgttgcatatacatgtcttcttttgagaaacatcagttcagatcatttgcccattttttaatcaagttgttttgctgtttagatgtttgagttttttgtgtattctagatgtgaatcccttgtcagatgtagagtttgcaaatattttatctcattctgtaggttgtctttcagtctgattgtttcttttgctgtgcagaagctttttagtttgatatgataccatttgtttatttttgcttttgttgttgtacttttgaggaactttttgttactcataaaatattttccagaccagtgtcttgaagaatttatgctctttgcctccagagatcttataatttcaggtcttatatcttggtctttgttctattttgagttgagctttgtatgtggtgagaggtgggggattagttactttctgcaggagatactcagttatcccagtaccatttattgaagagcctgtcctttcctcaattagtgttttcagtacatttgtcaaaaaatcaattggctgtagatacacagattagtttttgcattctgtattttgttccattagcctatagatgtttctatgccagtaccatgctgttttggttactatggctttgtagtatatttttaaatctggtaatatgatgcttccatatttattttgttcaggatttatttggctatttgggtcttttgtggtttcatacaaattttaggattttttttctatttctgtggagtgtcgtttgtatttttatagagaaggcattcactccacagattcttttcgatagtatggccattttaacaatgttaattcttctgatacatgagtatgatgtatctttctgttcatttgtatcctcttcagttttttcatcagtgttttgcagttttccttttaaaggttttgtacctccttggataaattcacttttaggtttcctctttttttttttgtacactattataaattggactgtcttcttgatctcttttttttagtttgttgcttgtgtatagaaatgctatggattttcgtgtgtcgattttttattctgcaattttactgaattggtttatcagctctaagagtttttcagtagaatctttaggtttttctatatataggatcatgtcatctgcagacaggaacaatttcacttcattcatttgaatgtggatgccctttaattttcatttcccaattgctctggctgggacttctagttctatattgagtgcaagtggtgagtgttagcatctttgtcttttttccagttctgagaggaaaagattttagcttttgcttctttggtgtgatgttaattgtgtgtttgtaatatgtgccttttattattttgaggtaatttccttctacacctattttattgagatttttaatataatggcatattacattgtattaaatgttttttctgaatctatcaaaatgattgtatttttgtctttaattatattgatttaatgtatgatgtttattgatttgtgtatattaaaccatcctcacattcctggcataaatgccacttgattatgttgtattatctttgtgatctgtgctggatttagcttgctagtattttcttgaagattttgcatctgtatttgtcagaggtattggcctgtaattttcctgtgtgtgtgtgtgtgtgtgtgtgtgtgtgtgtgtgtgtgtgtgtccttatctggttttgttattagatttagactgggcttgcagaatgagtttggaagaattccctcggcttcaattttttgaaatagtttgagaatgatttgtattaattctccttcatagattgaatagaatccagtgatgaagccatccagttaagtacttttcttttttgtgagactttttattactgattcaatcatgttacttattattggtctattcaggttttctccttcttcctggtccaatcttggtaagttatgtgtctaagaatttatccacatcctctaggttttcaactaggttttcagttggtgtatagttgttcatagtagtctctagtgatcctttgtattatgtggtatttgttatgatgcctcctttttcatttatgatttttatttgggttttctttctcactttattgctagttagcccatattgtatgatttcaatcattttaattcttttcaaattcattttttgtctcagaatatggtctatgttgttaaatatttcatgtgtacctgaaagtatatttttctgttcctgcatattctataaatatcaaataaatggatacaataatactttcctgataatatattttgaatgattcaggaaaacttaagaaacgtaagggttaattatgccactaattaaaaaattcagaaactttatgacaactttcatctctcatagccactttgactgcacagtggctttgttctcaaagccttgaaattgagttattgggatgtagtagaagcagtttgaagaacaggcagtaagcccaccttctccattagtatgttctatttactttgacatggagattttgcagtagtttgacacaaatctgaatagaaacctatttaatttcagacttctttacccactcttagaatttttcttttgatagcagataaggattaagtaatatacacaggagacagtctaagaagcatatttatttaaatataactttgttataacatcaattgcgtgtaaccaatctcatgccaaaaacaaatgcaaaaattctgttgcttaggattttactttatgtgttttaagtatatattgaaatgtacttcagaacatgtgctttttaaaatttatccaactttggtaattttggtttttgaacatcccgtagatacctaaaggactcctttggagcagcagtgctatatggatcacacttcaaaagtgtaattctggggcagcaatatgaaggtcaaaacatctccctccaactaggaactggatatttaaaagaggttaaggaaatttgatgcactgtattaaaaattgtttcaacctttttttaaactttagtgtaagtactacaacattttactaagcaaatttggagttctaatttaaccgttttttcatgttctttatcttagattctgaggacaaaaagcaatgaacacagctttttagtagctatttcctttcaaactctctggagagcaatcaaattttgtaatctgtaaaagaacatacattaatgttttgttcaaagagaattcaatctataataggccttttaaagaaatatgtataaaggcccgctgtctgtcctttttgatattttagtgtatgtatttgttcagtgtagttttgtttctttttaagaagctaatattttaggaagaaccagatactactaggccaagtacattctttttgtgtaactagaaatttcaggtcttttagttttccccaggcaacatctgctaagaacatagcattagttacatactgcttggaccaaccccatctttgaatatcacttgtagacatagtcacctaaagaagcaactaaacgttgacctaggggtccactttggcaattttgcctgcacctcattccagcgtatgccatggactttttttctgtttatgaagaacgtagccagagatagtcctaaaatagaagctaagggaaaaaaacaaaactctcacttctagatgtgcgaactctagcaaaaaaaaagttttaaaattctgccctgtttatagtcttatagacagactcggattaaaaaatatactttaactgctttatttcataataaaacagagacttttccacaaacttgggaagtgaatagaagcaatccactttaatgtattcctcagaatgagtatattctcacgtctcaacttaacaggatattccacatgtctatgttgatcccatcactctcaattacacaaggagaccagtactgccacaattccaagccagagggagcagtccatctttcacagccaagggaaggactggagtgagaggaccattctcactatagtcatagctagccactcccacactggcaactgaggctttgctccgcccagtctggtagactacacttttctattcctaagatccctgtcttattcatgtacaagagttttgagagaaggcaaccccattcccttaatattaagtttaattatacagtttccacctgttcacttcaatagtggtaattcttaggacctagcactcccagtttataaacacaacgaacttcaaaggtgccatccagctcctcaaattcttgaccaggacagcttatctcagagttagaaaactcccaacccttctctctagaaatgtcttcattacattaagagacttttcttcttaaactgtaaaaacaaaacaaaagtaactgattagtatcctctttctctagacagtgaagtcattagtctactcctggaggccaccatgagttacataggaggtttcccaagacccatcacctgtgtgaaggtctatatacctagactttggaaaggaatgaaaataagaggcaagctacttttagtctctgtctttgctatcatactcttcctttaaactatttctctctatcccacctctgtctctttctttttctgtctccctgtttctctctttttttgtcactcacacacacacacacacacacacggacacacatatacaaaagcaaccctgtaaaaatcactgcttgtgtaaagcctaaaccataattggggttagaatttggagctccactagttacgcagagaatgatttctgtgggttcttaactttctaagcttcaaatttcccatacataaaagtgatagtctaataattgtgaactcaaaaattttgtgataaataagttaaataattcctatacagccttcaggacaatgcctaaaccagaataaaaataaagataatgataatttagccttatatttctccttccattttagtcaaaatatttttaccaatccacagatacagtattctctttcttttcttttcttttttttattttgtttttatttttatttttttttgatggagtctaactctgtcacccagactgaagtgcaatgttgtgatctcagatcactgcaacctccgccgcctgggttcaagcgattctcctgcttcagcctcccgagtagttgggattacaggtgcctgccactgcacccaaataatttttgtatttttagtagagacggggtttcaccatcttggccaggctggtcttgaactcctgacctcatgatctacccacctcggcctcccaaagtgctgggattacaggcatgagccactacacccggctagtagtattctcattttatctgaggttatctccacattgcacacacccatcagagatgctctctctcatcctggtgaaacataaccattccaaaacgcagtgaccgttcactcttcagcaaatctttcttagttgaaatagccctcactgcttccctttttctcttattcttacacacatctcaaaatcagttctctattagttccaggagttgtttccttgtccttcgagtaattctacatagacaatcatgttatctgtgaacaaagacacagctccaagggtgagaacgggagctttaaaatttcttaaagctcatgcctatagaagtcattcagtgccatctctgcatctgcatgcattctcttggccaaaacaagtcataggaccagtgtagattaaagatgtgagactgcgggagaggagaaacacggcaaagtcacatcacaaaaaaccacttggaatgggaacacgggttatcctcctttttgaaaacaaactgtgtcactaatattgtcagtcttattattacactcaaatggattacaagatccctaagagtaaaaagccatagttttagtatttctcaaataggtacaatgcactgtaatgttggaatgtgtctttagaaagataaaataaccaaacaatcataacacattattctcaaaacttattttatatttttgttttaatgtgtacaattgcaatctcatatttgtgttagaatcatttgtttttgtgtcttcatgtttctataagataggaccaatattctttattgggctttgattttattttgtaacttaaatgtattaaggcaataaatgtaattttccacttaaaactatcattatagatttggttactacctactgctcagcaattttttttcttatcaaaattcttcctggttggtttacttctcattttttttccattaaatgatataaattttaagatagtagtttttcttgttacattagttcagaatcatagattcatgcataatagctttgatattcaaataaccttcattggtcttgatacttttataattttcatttcagaatcccttattgccttccattgaattcttctggtttgtgttataacatttcctgtaatttgtaagcaatccattctgttttcaaaatcacttgtgtgtaaatttttctcattaccatgttcatttcagttttaactaaagttcactcataatatgtcatacataaagaaacacttaaaatatattagaactatttacattctatatataatagttatgccagaaacgaaacagaaatgttgaattaagtttagcctaaagatgctgtcttatgtgttttaagtttggcctaaaggtttttccatacatagtgaactgtaacctaactggatgtgtaaacagagtatagcctactcttgtaacaagtagccaagtctcatcccattacgacaaccatacttcaatcacacacagggtccacctgttcaaactgtgtttgaataagccagacaccagctgtaaccaatctggctgtttctgtgcctcacttccgttttctctatgtagctttcctttgtccatacatcctttccaaacctgcagtggagcaccatgctcagctaattcttaatttttttttctagagatagaggtcttgctgatttgcccaggctggtctcaaagtagtggcttcaagagatcttcccaccccagcctcccaaagtgctggggttataggcatgagccattgcacctgctggagcactaatttctaaacaaacaaacccaagatcaaattagccagtcagagtgtgtcctacttacattctgtacataaccctactaaaacctttatgtacttactgttatgaatacttttagttcgtccctggcagaggtgctaaatttcattccctgatatttagcatgatgtcaccaaatcgtagttgtttaataaacatttgcgtaatgaaagactgactgaatgaatgcatgaagtaactatcagctacaactactaaactaacatgaccaagattcaaaggaaactttctaaaatcttcaaaaatctaagttctagtgctctttcaagacctcagaactgccttagagagtttaatggaaataacatacataggagtatggggaaaagtgctatttacttagcaactatgtgtcagacattttataagtagtgtcttacgtactttcttagtaatattttgaagtattagtagatagcatttatctaattttagaaataagaaaatggaggtgggctaataagttgtttaagattccaaacattctgtagtaaaaccagtattgatcctaatttgatggactttaaacctgctgagcctctgtctggtggaggaaaaaaaaaattaaaaaaaaaagcatttttcttccttcttaggttcagtggctgaggcctgtgaattatactgacaaaagagagattatcaagaataaatatttatttgatgtgtaggggctggggaggaacaggggcagctcacataaaagcaaggaataccccaaagaggcagttggacccgggccctgtatcccattttaacaaagtgtgataaagtgtggggaagagactagataaagaaaaggagggtttaatccctgggtggccggagtaggttgtgggaaaatgactaggaaatgtgtagtaaataagggctatttagtaaggtttgttatgcaaccttaaggcatctcaggtggtgacttattcacttctccctgatataagaaagtaggacacctttacaggtataagtttcctttacaaccagaaaattcatgccttgctgaagacagttcatcttgtgtttgctatttctaattgccttcagcttaaaatactccttatgctaaagtggcatattttggggtagcatattctgatctctttcaccccaaccaacaagactgtggctgttggcaggcaaacattacatcttatttatttacacttctctgatgtctgtaacagtgcatagcacagagtaggtatccagtagatgtttgagaaaaaaaaaataataaatgggataattaacatttttggcttctaggagattattttcattccaaattggccttctcccgctgttttttcccctcatactggtgacataccctcctgtttggtcagaaagaattctgatcttggatcatctgaaatacatttactaaaaaaacctgatatgtatttacatattgaaagcacatctgacttaacatttaggagcatgggctagcaatcttactagtttcaagccttggctccaccaagtgacttgctctatgaccttaggtttcatagcctcttaagtctcagctattttattttaaatgatgggcaaggctttttgctgtttggtttacttataagtcctgagtgcctgaaacaaaataagtattcagtatgtttggttgaataagtgaatgccatgtagtacctattttggttgtcattggctttaaagaggtgaatatactttaagtggttcaagagctcccacaccataggagcttaataaatgttagccattttattatgtaagtataacccttcacacactttcactagtcatttgttataacattgactttttcaaaagttctgtggaaatgagttataagactatccattgttgaaggcaatgttcttagttgtattcattgttatcaatttagtcattaaaaaacatttgctttccttatcaatacatatgcttcattttattagtaagtagaatttcataacccatcctgttttccatttctcttgcatactaggaaacacaaagtgaaatttggttctcgagctagttcagtcacataatgttgttggtaaaattatctataacatttggattcttttggatataaatttgcccttgataggctaagctatattatattttctataatcttgtgttctataatattctaaaatatcgttctgtaattattttatgagaaacattcttcataaatatgaaatgtatatcataaatcagtttgtttatgatatacatgtttttcatgtaatttaatgatttaattgtaattatcaataaatatgcgaaatctaaacattcattggcaaatatagtagaaactataatgaattggctatagtgtttctcatgttagacattgttgacctaaaaagaagaaactgaggtgaaattaatggagtgtttatctgggcaaagcttgaagattacaacctgggagcattgattcaagttttcctaaatgtacactccaatttgtggcagctacaagtgtttgtgttcttttttttaataatttcaactttcattttagataccgggagtatatgtgcgggtttgtaaacatgtgtatattaagtgatgtggaggtttggggtacagatcccatcacacaggtagtaagcatagcacctgtagtagtctgttttcatgctgctaataaagacgtacctgagaatgggtatttataaagaaaaagagatttaatggactctcagttctacatggctagggaagcctcacaataatggaagaaagcaaaaggctcatcttacatggtggcaggcaagagagaatgagagccaagcaaaagaggaaatcctttataaaaccatcagatctcatgagactttttcactaccatgagaacagtatgggggaaactgcccccatgattcaattatctcctactgggtccctcccacaacacatgggaattatgggagctacagttcaagatgagatttgggtgggtcacagccaaaccatattggcacttctacactaaaaagtatccaagacaagtctcaatcaatttagaggtttattttgcaaggttaaggacatgcccatcacacaacctcaggaggtcctgagaacatgtgcccaaggtggttgggctacaacttggttttatacatttagggagacatgagacatcaatcaatatgtattaggtatatagtggttcagtctgaaaaggtgaagtgagggacttccatgttatacgtggaactggaagtgggggaagtgggaggcttccaaactggaagtggggttcttccaggttataggtggatacaaaggttttctgattggcaattggttattatctaaagacctggaatgcatagaaaggaatatcttgtttgtgataaggggttatagagaccaaggtttgatcatgcagacaaaacctcaaggtagcaggattcagagagaatagattgtaaatgtttcttatggaacttaaagagtcacttctattggtcttgaggtctgcattggtggtaacaaggcatattttcaggttaccttcggaatgcccttggctgagaagaggggtctattcagatgactgggggccttagaattttatttttggtttacatatccaataggtagcctttcagcccacagtgccctccctctctctgtcctctagcagttcacagtgtctgttgttccgaggagtgcccaatgtttagctccttgttataagtgagaacatgctatagttggtgattttttttttttaggagaaagaggcagttcctgaattgtttactaagaatttacataaaaatagcttaagctattgattagctatacgttgttctctatatcagaaattccagaaacaagaggataaggggtgaagcagctaatcaggaacaaaatgaattgaaataattgcccccagacgtgggtgcaggggttgggatgtggagtgttggagggtgaaggcatgactgatgtcccacgctcatatctctctgggcctgcatacctcgcatagttcatgctattctgagctattttacttttctcaacatttagatatttgactatagaaatgcttataaatataatttatacacatataaatggcatgtttgttatttatttagtttgagctggagacttgctctgtcacccaggctggagtaggagtacagtggcacaaatcttggctcactgcaacctctgcctcccaggttcaagcaattctcctgcctcagcctcctgagtagctgggattttaggcgaccaccgccacacctagctaatttttgtatttttagtaaatatggggtctcaccacgttggccgggctggtttagtctcaagctcctgccctcaagtgatccaccaacctcagcctccaaaagtgctggaattacaggcatcagctaccacacccagccataatgtcatatttattaccttaattatgatatttataattttcaaatgcagtcttttaaagcaaaatcaagagatattcaaggacctttgaaaatgcaaaacaattatttatatttttaatgtgccttagaaatagctcaatttacactgtcgaaaatttgcatatataatttagtaaggaataattccacagtactcagtaggacctattaggtttcactagaataatttatattagtaagtcacaaattaatgcttatggacttttcaaaagtttatgtgtttcaagagaaagctaactttgcaaaaagggtttatgaaatcatctaattaattcatacattataaaaaccacattaacaatctctcaattttctttcctccttttgtatagacaattaatatagaacattttaaaatagactatttgaatattgaaaatccaattacaggtaaagtaggtggagtaatttgaaattgcattctaatacttataataaataatttgttttcagatcataaattgcttactataaagcttttctaacacttataaaatttatggcaacttgagtatttgactcatcatgtcacttttcaggattgtctttctttttcaggaatattaggtgttctttgttttaacttttaagttcaggagtacaagtgcaactttgttacataggtaaacttgtgtcttggaggcctgttgtatagattatttcatcacctaaatattaagcctagtacccattagttattatttctgatcctcttcctcctcccaccctcagccttctgataggccctagtgtgtattgttccctttatgtgcccatgtgttcccatcatttagcttccacttacaagtgagaacagaggcagtgtttggttttctgttcttgtattagtttgctaaggattatggcctctagctccatccatatccatgcaaaggacatgatcttgtttcttttttttttttttttttttggagacagagtctcacattgtcctgttgccaaggctggagtgcagtggctcgatctcggctcactgcaacttccacctcccaggttcaagcaattctcctgcctcagcctcctgagtggctgggattacaggcgcccgccaacacgcccagctaattttttgtatttttagtagagatggggtttcactatgttggccaggctggtctcgaacgcctgacctcatgatccgcctgccttggcctcccaaagtgctaggattacaggcgtgagccaccgtgcccggctgatcttgtttctttctctcccttccttcctcctttcctttctctgtcttcattctgcatttatctttccctcttttctctgttaatctctttcccttcgtttcttctttcttttctcttttgcctgtattcccaattatagcggtaacattacttgacttcaattgatgggacttttacagtttaaatctttatacttatttatattccaaattaattataagacattcttttttttaagacattctaaactactttttgccttgaaatgtcagtaagaataatatctaagaaatgtgtcctattttagtcatataaaacaaatgtatcaatttacatttatattttcatttaaaaatacatatgtagaacatgttatgtgtcagaaaccatccttagaagcacttctaaaatgtagcggatttaattgtcatcattaaattattaaataagcataccttattcatttcagttaggtattattattatgaccactttatacatgaggacttaaggctcaatgaattaggtgattttgtcaagggcagttcgtttgtgagcaatagaatcaagattcaaacctagacttttggattatgtaaccacatgttatgtgtggagggaaatttaaaaaacaaaacaaaaactccagacaccaaaaagcaaacaaaacccctaaacaaaagctaaaagctgaattctgttctttagactatgtctaaatattatctgtcagtttttacacctcttttttcttaacagatgactggagggagtgttgtattatagtataatggaaaaccttcataaccttgattacagcagctgaagaactcttgagagagaaaaaaggaagatagagttttgcctcattctctccttatttagtgttctcagaagtcattcttaatcttttacctcaattatccttagttcatttatgaaaaaatacaaaccattcaaaccctctgtcatatcatagcgtatgtgtgacttgactttatgagtgaaggctttctgtacgtgtgttctgaaataaaagcttaatgaaaacatctatttccttttctgcagtgtgcagatgataataacgaagcatgtggcaatgctacagcagttatagtcacatggatccgggacatactagaaagaaacatgtcactgatccatgggcctgtaagtgacacaagcaaaggcattcttacataggttcactgcatctattatttatctgatagaacatgtgtgaaggtgttacaagagtgctggacttaatatggattactgtggaacttcctatcaaagctgatgagatgaatactaaaaaaaggttaatcaaagtttgacactggcccttacagaagccagagctactaatttccaaatgctacaacttttgaatactctaaaataatcctagtggcagtgtcaacagagtgctatgggaaaagaaagtgcggaggatcagtgttggcttaggggcctcagaaagcgtcacagaaaaaatgattgtttattgcagagaaaggagagaaatcaaacagggtgcaacaagtgctaagtcatggcttgtccagaatactttagaacttcctgtatagttgagtcttgccttttgggagacaggaggggttgggaaagctaggattacaaataaaattggtgatattcagattatagttgctttgagaatatgcagttatttgggggtgtttagaaatggtgttattcatggacacatagagggaaacaagacacacagggtcctgtgggtggggggtggagggtggagggtggcagggtggcggggggagagggtagagggtggaaggtggcagggagaagggtggggagtgggagggtgggaggggtgggagggtggtgggggagggagatgggagggtggggggaggtggagagtgaaagggtggtgggggatgggagggggtgggaaaggggagagtgggagggtggagattgggagaaaagagaggaatgggaaaaataactaaaagtaattgggtactaggcttaatacctggatgatgatataatctgtacaacaaacctccatggcacaagtttacctatgtaagaaacctgtacccctgaacataaaataaaggtttgaaagattaagtgccttgctaaaagttagagaatatgttaatgtgttatattcagaaagtaagagcttctaatgctttctactcccttccccacaataattatgctagttttctattcatcatctctatctaagtattccacatagtatttcaggttaatgaatatttttatatctcctatttccagataaaaccatataaagttctctcaggtcagacgcacagaaacacatgtataagctacatcatcatatatcatcactttggtgttttaagtcatagaaccattgctcactgtagaacaagacagcaaaaatgatgctttatgaaaacagaaagtaaatttcacatctatcattcatcttataaattctttgtatcaaaattttaattaattagagtgacctagtttcctcactgtggaagaacaatatatgtatatacgtatgtatatgtatatatatatatttttaatgtaagtactctctcatccaggaaatgttccctgttgagtgataagcctagtgtgagaacataacgttcagccagcaaaggttatattacattaatctttgtacactgctcaatagttaagaggtttggaaccgtttatagtaaggaccatgctatcaggttttatcagtggcttattacataggtgacaatcaaaacattattgccaaacttcatgttagttcacagatttaatatctaatatacattttacagttatttgaggcaagttaccttcatttctgggttgcacacgtatcactgggagaaaatgcaaagtacataccagagaagaggtgagttccctttttcaagcagtgcaaaccacagaaaaacatcaagcaaaagatctaatgtaactctgttgtgaaaagagttgtacaagttgtactagtaactaaaatacacctagaagaaaaaagatttttggtcaacagacatttcagggcaaagatatttgcattgctaagcagaaatacattatgcataatcggttaatagataaggaagaaaaattcaatattaaagaccttcttttgtacccaatgtattataatctgagctagatgtgttccatgcactggattgtttcatcctggtagtaatttataggtgggcattatcgtctcagttattatgaatacatactactgacatggcagaactgctattctgtcaccctcacattaatctctctctacttcctgtgtttgtatacatatataacattgtatataaagtctttttcttttttttgagacagagtctctctctgacactgaggctggagtgcagtggcaggatctcagctcactgcaacccccgcctcccaggttcaaatgattctcttgcctcagctttgccagtagctgggattacaggcacctgccaccatgccagctgatttttgtatttttaatacagatggggttacaccatgttggccaggctggtctcaacctcctgacctcaggtgatatgcctgcctcggtctcccaaagtgctgggattacaggcatgagccaccatgcacggccaagtcgttacctaaaatatttcagtgatttggcggggagtgggaatccttgttgcttaatattttcctcaataaaagtgtcaaatggttaatctctttatagattatcttccttttgatatttataataattatatttgaaactctcagaagaccagatgaactcaaactacagtgccacaagagacattggaaattctgtgtgtcataccggacattaattatatttcaaataacaggaattcctttaaacaggctgaaacaataaacatacaaagagtttactcagcatttattgtgtgttgtgcatttgtatgtttgttcaatgagtcacttaccccataggagaagtttagtcacaggatttttcagaaagcctaagagggtcatgaatgaaaatatcctcctattaagatattaagcctatcacatgtggcatataagtgatgtgaaattcatgctcttaagtgatgtatttcaaaggacagcctgtttcaaggtatggtaaaatgatatatgtacaaatattgccctgtgggtgtgtagaactgaggctcttaatgacactttgacgatttgtgagactcttgccatcctgtaaatagtcatagcagctacacctttcactggaaacagggaattttcccaagatctgtctctcaccttctggttcaaaaattcttgctctcctttgacaagcccgtctcttgggttacggctctctctctagcaaatcctccagaggataacaggagagtctgtgcactgactttcagaggttcccttgatccattgcttttgagctgaatctaatgccatagtgcagaaccttacactggacctgttgccccatgattttgattcccagaagtggagatgttggctaccataccatattccaaaatataagatgagttcacaaaccagctgaagaactcacgaggaagtgtcagggcaaaggcaactttaagaactgctgttttcgatgagctaagtgagaataaaacaaaaattcccctatttatgtatcaatagctatgcactgacagtttttacaagtgtaattatacacaagcaaatggaggtaaaaaatcaaaatatcctccagaaccagatattcttgaatttaaagacttatttgactactctaaatctctgaaaacacttctagtattcaaaaatgtggcataacttatgtgggccaactaaactagaaaatggtgagttttaatatttatatgatgacaagatcaccatgacagaatagaatgttcccaaaacagcttcgagcaataatagatccagcgcaaaaaaaaaaaaaaaaaaaagctggaggatttagctctgccagttattgactatgtgacctggtgcaattactattattacctatttgacattttcaaatcacatgacttacttcacaagtaagaacaccaatgtccctaccgaggtttgttttcaaagaatcaggaaacccaactccagaaagtgctattcatactgttttcatgaatggtgctccgtgaccttgataacatatgtccctagagctgtaagccatggatttggctttcagatggtgtcaattaaataatgtaagctaaagagccacagattttaaaatgttacataaatcttactgagaaagtgattaaaaataatcatcttcaagctcacaccaaatgacagttaatacagagtattttagtcctcataaataataaaaacaagaatgatgcacaggtaccattattttcaacattgttctaaagatgaagaaattaaggtatagggattacacatctagatagtggaggagtgaattttgaaacccaaacgagttgacataaaagaatgacaaccttttaactgccaagctgtatccactatcatgccgatttcaaaggatagcatggtattgtgccgctttattttttgtaaaagaaccaacaatacatgcaacttgaaacattcctatagatagatgattttatgattgccagggtgtttgagatgacacacaaacaacatgcatctcagattactgaatagaacagagaattgcatggacatatatgaacattatgtatcattagggttttggttcatctttcaagtcaagctggtacaggctggttgacatttcctggtaaaagggtgggagaaccaaaaaaatacatcctttctcagatatgacttttgtgactatcttgagaagaagaatccatgcccgatttatctctgcatttctgttttcacacagaacaaataagtgctgaataaagtttatttgaatgaaaaacaagcctacgtagtaataacaatgtggaaaggagtaattattctgtcctgaggtgcaaaagatggtttaaaaaggtttctaggtgaattagaaaaaaaaaatgcttttgacatctaagacatgtgtatatccattttccttactgatatattttctattaaacttagaaataattatctgcctaatggaaagaactgtttataattgatgtatgtgaaaatgagctgaaagaggaaaacattcagtctatatctctacagttatgtgttcaatggtagtattgatactagcaaatgtatttggttcttctactttgtttaatctatttaataacacttagtgtaatattgaccttgggattcagaaaaaaatattccaggtgaggcatgatggctcacacctgtaatcccagcactttgggaggctgacactggaggatctgttgagttcaggagtttaagatcatcctgggcaacatactgagacactgtctttacaaaataattttttaaaaaattacccaggagtggtggcatgtacctgtattaccttgggaagctgaggcaggaagatcccttgaacccaggaggtgaaggctgttgtgagctgtgattgcacactgcactccagcctgagtgacagagtgagaccctgtctcaagggaaaaaaaaaatcaaacaatttttgaagtcagaatagagtagcagtgcgattgtacgtagcctgtatgtgttgcgtgtgcagaatgcaacatatttccatggctacttccgaaatttcaatcatcctcttccagaatttccttctccagttaccaacaaatatttattagggaataaatatgtgctagccactgagatacaaatacagacttatgtactcctctcctagggactgtattctaccatggaactagatcttctgtaagatcgaggcacagatcatcggcaagtctaaaaggaaattaaaagataatttttaaggagttctaattttccttcattgttgatgacttttcacagtattacttccttgttggtatatgagaacaaaatgctggcttgtcacatggttcttagaaagactgtctagtcataagaaacattacttgacttacttaattctctggcagttttataatggcatatacaatttctatacactactttaaaatggagtcaatgtaattttcagcaaagctttggaacagattcagccaatgtttgtcgtaacatagggatgcatgctggaaatggttctctctgcttctgtggctgggtgctcctggagccaatgctatactgcaaaaatgaagcactatgttgatgatatttctttaatcaattattctgccaataaggtgcgttagtttatatgcctaactagcattcttcttctgagcgaggtgcatgaggtacctgagagatcactattattgtgtcattgaatcatagttctattattttcagagaaaattttcatttctcaacggttaaatgtctctacaattcagtatgtctcatgcctagctctctaaagccacagaacttatcaaaactagtcttaatatctgtaaatactgactgttggttaaaagtctaggccctgtggttaaactgcctggaatgaaatcttggcttagatactaactaaatatgtgatcttgagcaacataatttctctctgactgagtttcctaatacacagaaagagaaaagtcacaccagctatatagggtcattgtgaggtttaaatgagatagtacatggacaaaaatgtcttgccaaagtaagcacgtaacggatattagctacagtcctcatcattgtctgtgcccctttttgtcgtgtatcaccatagaaaagaagggaacgactcgacttaaaagttttctggtagttcttatctaaatgatgcaaatagatgaatttttaatacatggatgtggatttgtgatatttttaggcttttgtgtttgcacagataattatggctttttaaagaatcaagttatcagatcatttcattttcagatattaaaaaataatgaaaatggaaaagtacattgaaaatgtgatcattgagggaatatatttagcaataaggagatgacaatgcaaccaggaggggcgaagagagagacagagatataaatgagcaaaactttctttgcttttgcaagatctgttgtttataggataagcccagttgttttgcagtctagcactgatgctttccatgggaagagcacaggctgtgtatgtgcatgtgtgtgtgagttcaagtggttttacattactaatgaaacacagacttttcccaagataatcaactggggattataatttacagcaaagaaggtgtaggtgcagaaacttaatttctgtggctaaaaacagctggaagtaaagatgtcgctgaaaagacattgttggtccctaagctagtattgaccccacatggagagggaatcccacagcattaaataggcgtctgtagacacaaactgccatgaagtgattcatttataaggaaggtactaattttaaataatactcaaatcattgttaatttctgtactatttaatagtattaatcagagtgaactcatctgatacagcaataatcataagaactgttctataagtttcatttcaaattctgcaataatcattgtgtcatcatgttatcacatactgttatgcgcatccatgtgaagcgaccaccacacaggctttgtgtgagcaataaagctttttaatcacctgggtgcaggccaactgactctgaaaaaggagtcagcaaagggagataggggtggggcagttttatagaatttgggtaggtagtagaaaattattacagttaaagggggttgttctcttgtgggcaggggcaggggtcacaaggtgctcctgagattcattgtccaggagaaggagtgtcacaaggtaaattgatcagttgaggtgggacacgagcaaatcacaatggtggaatgtcatcagttaagacaggaactggctatttttcacttttgtcgttcttcagttgcttcaggccatctggatgtatacgtgcaggtcacgggatatgatggcttagcttgggctcagaggcctgacacataccaattggagaatgttgccatgaaatgacataaaaacaaagactattaatgactatcctaattatactaggaagtaaatcaaaactcttcatcagttagctaccattcttgttagctgattacagcatgcatgtaaaaaatgtctggtaaaaattatagtatgtaaaactaagatatttagctatgaaaactttctatgttcatcttttattatacagcttacatgatgcttcaaaaaataattataaatgttggcatttttaaaacactttttcacgaatgtatttgaaaagtctcttcatatcagaatttaggaggcatacacatatgctgttatatacagttatatatactttactaaaaattgtttccttttgacttgccctctgatgagtaacatttcacaaggttactcgggtaaccttgagtaaattactccatttggctaatccttagtttcttctctatgagtggtgatcaaaatgcctaccctgtcttttgaaagccaaattaagataggggttatcaagcagtgaattgccataaaatgtattatgcatattttatcacatttgtattgttattataaatatgtgtttatatgtatatcctccttagtgaccatgagatcatccagggtaggagctctctggaaatttagaaaacaaaggaaaaaaaaaattgaggaagtggaaaatacaaaggaattttctcagtggtgtttgttctataagctctaaacagtaggccaccaacgtccttgagaatctttcatttatctgtctgtacctcataattatatctgtcactctcgttttattatcagaagatttgcacagttcattttaaagtctaacttgtcctttgtgctgactgccacgcatgtctgatgaaatataacaaattgaacagaggtgccattattaaagcaatctgataaaaagctgcagttgtgaggtacactgaagaatatatttggtttcttcagggaatcaaaagcatttcacatttaagttattttctggaaacttttatgtgaatatactacattttatcatgcagaaatactgtgtatcttttctttcttttgtaaaagagagcaaacaggatggatatatcaatgagttactactaaggtttcagtttttctcatatgacagaccccctgtaggaagaggaatggtgtttccatcaaaatttgattatttttatattaatatttttattaatttttttcaaatttatatatatctatttaaatcttaagataattttgcaaatagccacacacacaatttttctaaatttgatgagtcttccatttcacataattacaggaaattttctcttcatgtgattcctatctgcaagaattccatttactggaatcgatttaaataataccagtcttccaacaacagttcaatttcaatccacagcgtactaaccataattgcataaattacaaactttgctgctaggccttcagtccacaattcactacataaagaggagacatacgtcatgatcagtaaccaatcatgacacttctttcaaagtctccagtgattggtcactgcacatgtataatttgtataattcagtttatgcagagacagggacttcattcccctgtgttctgaccagttggagctcccaaaatgcctgtggctacagtttgctcacagtggtcacaagtctattgaaacatgaatcttattaataggtttttgtttctccagattaaagtcacaattaccaaagatttaaataaatgttttgtatatgtgaaaactctttaatggcctcatttgcaagttgttttatgcgtatgatagctagaatctgctctcgaccagtagaaggtagtagcatttgccagaaattttgtaatggttcacagacaattctatgcaaacaaggtaatatttcctatgtttttatgtataaattatttaggaaaggggaaaatacatcatgataatttttgaaagaaaaaagcctttaaaatttttctgtttctctttttctaatttctaatacagtttattttgagtgaaaaggaggaaagggaacttaatttgtgaagcaactgtttcattttgtcagtcctctgggctaaaaatatatagaatgattggaaagaacatgaaaaactgtcatctggaacagttcctaaagtgaatgtgcagtcacacctttactattctctgattatgctgtgattctggaaaataaacaaggtgtgcatttctcattgaaatatgtcttggaatcttctccaaattaatacctgcatgttatatgatgcatatccatatgtgtacctatagctgtttatgtgcaaatgataactactttaaccaaacaatttccgccattttcttaatatttccattgggtaatcaccttctttaggaaaatgctgagtcataatgataaatataaagccactaatttggatctgtttcttttctctaagcaatatgttcaatgagaaaaacatgtaaagatgctcctcgatttacaatggagtcacaactcaataaacccattgtatgttgaaagcaatgtaagttgaaaatgcgtttaatacctagcatgcatcacagcttagccaagcttactgtaaacattctcagaacacttacattagtctacagttgagcaaaattatctaacacaagttctattatataataaagcattgagtagctcaggtaattcattgaacactgtactaaaagtaaaacgcagagttgtatgggcactcaaagtatgattctactcaatactcatttgcttttgcaccatcataaagctgaaaatttgtaaggcaaataatcgtaagtcagggagggtttgtagtttcctttttaacaaaatggcagaggattctttatgtgtttccaatgtttctttactgaatgttagagccaggttcgtaattctacccatactaccaaccccgaaactctcctcccccttttgcattcactctcatctcaaatctctatgtcttgcaatggtcaagttggcatgaattaaattgtttaacctgtaaattcaacagtgttcagagatgtataaaatgggcaaattcagtgactactttgaacaatggaaacatggcttttcaatggtaacgtcttggattggattcaaatcaggcccctaaaaatttaaggtcctaaaacccattacgaatgttctgagacatccaatgatgcacaagggtccttctagaactgctagctttaaaatgtgtaaaattggtcagagatgacagtctaactagcaaaaaaggaatgtgtctttcaggttcctggaaataatgggcacatttatgtttttcatctctagttactgtcatctctgcagtcttacgtagtcttctacatttccttttgtcttgtaaaaatgcttttctgttagagtttatgctttcatacaataaacatttacatagagacctgtcacagtggtgagcatgtaaaatgcatttaggaaatgccgtttgatgttgtatttgaattgacattttccctacataaaaacctttaaaacttataccagtaaaggccaactttttaaaaggtagtctccttttatgcatactaagagttatcctgttggaaactgcataagcatctaatcagtgcttgctaattgtgggtgctttcagccagagcatgaaattgggcacacaattagcaaactgaagaaatgtttaattgcaagtgcaattttaacctattgtcaagagggaaaatagaaaggatgaaaatgaccattttgattgtggttaacaaagaattaaaatagataaagagtttggacccttgaggagcaaatctcagttccaatatttatttgtctaactttggacaatcccttgatcactgtaagcatcagtttttgttgttttttcatgtgtaaatggggatcataatgttttaattgcaaagtttctgtagctatctgagatagaagcttgaaaccacctaacatggtgtaaattatgtatgtgatagccactcaggaagtgattgctattatgactattattttgaatattaatactactgatgctacaataaagcaaaccaaaatgtcatccattttttccctgcagttcgtcagccaccatggtatgaaactgccatgaaatacactatccattatgctcttaagtattccttaccttgaactatagtatacggtaaaagggcactggacttgagatgaaggaagtgagttttaattctgattgtgtcatttacttgagtaatcttgaagaaatcacttgatatctctgaaattcaggcttgttagctataaaatggagacgatacctacttcaaaagatccaagagagaatagtaacaaagatagcattgtgcttgacatattagctgtgtaataatcttccattaagtttaataaaatggctctgcatatagtgagtgcttctagaaatttatgctaagaattaagtttattttcactttcatgtattttcttatgctgatgttatgaattagatgtcttattttttgacattatgtaccaaaaaaaaatctgcaagcagaaacaaataatttattcaatcaaaattttataactccattaactttgtttcttcttactctctatatgtgttttgaggttttttctttgattttcttattgtacatgtgttgttattattgaaaatttttgagacattaatagtaaaataagctaggctccaggatacttagaatagggaaaaatattataagatataagtttaattcttattctgccagaatattataccttgacaagtaatctcccctccctgggttctgtttcctcatctattaaattgcaatgttactgacattagtatttttatcagtgccaaatgaaatactgagcaacaaagtatattttaagattgaaaagcagtgtaattattgatttttattttaagttctggggtacatgtacaggatgtgcaggtttgttgcgtatgtaaacgtgtgccatggtggtttgtagcacctatcaacccaacacctaggtattaagcatagcatgcattagctatttttcctaatgctctccctccccatgaccccatcccccgaccagccccagtgtgtgttgttcccctccctgtgcccatgcgttttcattgttcagctcctaattttaagtgagaacaaaaaagcagtgtaattattttaaaattccagattaaaaaaaatcatttcacataaagtatgaatatttgcttcctggttttatgaagctaaaaataatatttttgttcagagaaaaatcatacattgtttaagaatataattggaaaataagaaaggtaagtgatgaactgagagaagcaaggaatataattaaaactcagcatctagagagctaaggaagagagctgctgttgtaaagaatagacaaagggctaaatagaaaataatttggggttatgtgtaaacaatacttttcattttgtgaaaggtgtaagttccatttatagatttacacttttccacgtggatatccacttgttccagcatcatttgttgaaaagactactttttccattgacttgcctttgctcctttgtcaaagaactattgattatatttgtgtgggtctatttctggactgtctattctgttacattgatgtatttgcctattctttcaatgatgctacccagtcttgatcactatggcctaatataaggtcttgaaattgggtagggtaggtcctctttctcatccttcagtattgtttggccatgctgggtcttttgcctttccagataaactttagaatcagtgtgtcaatatttacaaaataatttactggaattttcgttgagattgcattcagtctatagattaatttgggaagaattcaggttttaacaatattgagtctttctattcatgatcatatctttacatttattcaaatcatctttgatttaatgtagttaacattttgcaacttttctcatgtagatcttatacatattttgtcggccttatatctaagtgtttgataatttttgtgctaatgtgaatgattttatatttttaattttaaattctgagtgttcattgctggtatataggaaaacaacttttgcacattaaccttgaatcctacaacattactataattagttaattgttcctggaacttctttgttgattctttggaattttctacataggtaatcatgacatttgcatactaaggtagttttaattctttctccccagcctgtataaattgatttccttttctaattgcataagctagtactttcatgacaatgttgaataggagtggtgagaccagacacccttgtcttgttctctctcttagggggaaagcatccagtttcacactgtttgctatgatattaactacaaaaactacgtttttgtagatatctattatcaagtagaagttgttcccctttatgcctaatttgttcagagtttttatgagaaatgtgtgttggattttgtcaaatgccttttcagcattatagatatgattgtatgatatttcttccttagcctattgtgataaattacattgatttttaaattacattgatttttaaattaattaattattttttttgagacagggtctcactctgtcacccaggctggaatgcagtggcatggccacagctcactgcagcctctacctccctggctcaggtgattctcccacctcagcctcccatgcagaactataggcccacactaccatgcccaactatttgtttttgattgtttttcatattttttttgtagagaaggggtttcctcgtgttgcctagtctggtcttgaactcatgagctcaagcaattcacctgcctcagcctcccaaagtgctaagattacaggcgtgaaccattatgccaggccaattaatgtttaatttacaaataagcatatatttagcatgtacaacatgatgttttaaatatgcatattttgttgaatggctaaatagctaattaacatatatattacctcacatggttatttatcaggttttgaatttgaaccaaccattgtatctggaataaagcccacttagtcatggtgtataattctttttatacattggatttgatttgctaaaattgtcttgaagatttttgcatttatgttcatgagagatattagtaattttcatttcttaacagatcttagtctggatgtggtgttggagtattgctggcctcctagaatgagttaggaagtattccctgtgtttatattttctgtaaaagtttgaaaaaaattgacttaaattcttccttgggagtttggtagattcaccagtggaaacatctgggactgatgctttctcttttgaaaagtaactaattgtcaattaaatttattaaacctattcaggttatttatttctccctgtgtgcaatttttatattgcgccttctgtggaatcagtccgtttcatctaggttatcaaatctgtaagcatgaaattgtttaaaatgcttacgcctaatttcttaatgtctatgaagtcaatgttaattactctttttcatttctgatcttagtgatttgtatgttttctctgttttctggttagcttggttagaggattaacaattttattgaacttttcaaagaacactagcttttggtttcattgatttactctactaatttcctgttttcaatttcatttctttctgccctaatttgtattatagatttgcttctgcttacttcagatttattttgctgttatttttctcactttctaaagcagaaacttttatttattttagatctttcttttctaatacatgcattcagtgctacaaatttctctctcatcactggttttgtcgcatcccacacattttgaaaagttgtattttaattttcacttcaaactatttttattttttcttcagacttcttctttgactcatgtaatccttaaaatttattgtattctgcaaatattttggaattttcagcttctttttatttttgactttgactttaatttcattctggtgtaacagtatactttaaataacttcaatagtttaaattcattaagctgtgttttgtgacctagaatgtggtatatcctggtgaatgtgccaggtaggcttaagaagaatatatattttgtgttgtcagatggtgtaattaaaaccagttaattgttggtgctgttctgattaactatgtcttatttggtgtgtgttgactctgtcaattgctaatagaggggtatcatagtcttcaaccataatagtgggtttacttatttccctttgcagttatatcagtttttatctcatgtattttgacactccattaggcacagacacaataaggattattctgtttcatcagagagttaatacctttttaaatttatttatttatttatttattttgagacagggtcttgctctgttgcccaggctggagtgctgtggcgcaatcttggctcactgcaacctctgtctcctgggctcaaacaattctccctgctcagcctcctgagtagctggaactacaggcatgtgccaccacaccgggttaatttttgtgttttttgctagagacagggcttcatcatgttggccaggctggtctcaaactcttgacctcaagtgatcttcccttctcagcctcccaaagtgcggggatcataggcgtgagccaccacgcttggcccttattttaaatgcctcataattttccttactcacaagtctgctttgtctgaaatttatatatttactctagatgtttttggttaatgttagcattgctgtatctttctccatcccttcatcttaatttatatgtgtctttatatttaaagtgaatttcttgtagccaacccatagtaggttcttgtttttaatccaccgtgataagctcttttgattggtatattcagatcattcacatttaaagtgattaatgatatatttatattaatgcctaccataatttataactgctttctagccattgtccttgtttttgtttttacattttgttttgttttacatactttcctgccttcttcagtttgaagtgcgcatttgatattttctactttctcttatctcttttttacttctattttacctgtttttagagattaccttagcgtttgcaatatacatttgcaatatacatttgcaataatccaagtccactttcaaataactctaccttacttcacaggcgtcacaggtacattaacgtattcccaattccccctatgtcatcacatgtaacattgctcattcatttctcatttatctgtaagctagaaccatccaaaatattgctgctattattaattagaacaaattttatgttgtatcctctaagaaccaaaaaaaattattttaccttcatttattttttcttaaatactctttctttatgtagatccaattttctaatctgagtcatttttttctctgagtaatttcttttaatattttttaaaagggaggcttgctaccgaaaatattacttcaagtttcatttttctgagaaagtcattatttcccttcaaagaatttcacttgatacagagttctaggctgtacttttatttgtttttatttaaatatttaaaattttataccactctcttcttgcttacatgattctatacagtgttggcttcctccaccccttcttggcttctttgaagattttcttcttgtttgattttctgcagttggaatattatgccaggaaggagatttttaactgtttatcagagagtttggcactctctgagtttcctagaactgtgatttgttgtctgtctttgaattcgaaaaagcatcagcattatttcttgggctcttccttctgttcctttctctctctctttctctctctcctccatatattatttgcgttatgcacattacacatttcgtaacactcatacatgtgtagaatgtgctcttccatatttttcatttttttactctttacattgtaatttagaaagttcctattgacatatcttcaaacacattatttccttgactgtgtccagcctactaatgaacccatccaaagcagtctttatttttatcttttttttctttctttctagcacttcctttcaattctttcttggagttctcatctctatgcctgcattacctatgtattctttcatgttgtttgtttttatcatttgaggttttaatatactcatgatagttattttaaattcccagttcaataattgcaaagtttctgctgtatctaagtaggttatgatgtttgttttgtctctttaatctgtgttctctgactttaacttgccttgtaaaatatgatgcatgagggaaaataaaacacatagtgccttagcctgaggttttatgttagtctgcccaggatttaagctgtgtctactatttgctgtagctatatgtgacagagactaaaatgtttttgtctcccctgttgttattgggttgccacagagaacttatcttaaataagatctgagacatgaaggcttttcacttgtattccctcattattatgcaggagttctgctgatgtggtgatagggtgtgagggaggataggcattctacagtctcataattaggtctcagtgttttagtgagcctgggcccctgggttgtgaccatcacaagggtttctcggctttttatccacttatgtgatacaagaaggctagagggagctggggttaggtatttctcttctttaagattaattcagctctggtaaaacctcagtccattgggctgtagtaaactagttttctttgagggtaggcctttgttaagaacaggatttctaggctgggcatgttgacccatgcctgtaatcccagcactttgggaggccgaggtgggaggatcatctgaaatcaggaattcgagaccagcctggccaacacagcgaaaccccgtctctactaaaaatacaaaaattagctgggtgtgatgatacatattcataatttcagcgactcggaaggctgaggcacaagaatctcttgaacctgggaagcggaggctgcagtgagcagagattgtgccactacactccagcctcagtgacagagtgagactttgtctcaagaaaaaagaaaaagaaggaaatattcagggggtatttcacaatctgggctttcccctttccctgataaaagaacaaggggatttttctcccacctttaactgaagaacttggtagacctcttggatgtaaaatgaataagagtgtagccccttccaagactggacctcaaagggttttcatccctcaaactagtcaacacccggtgtccagtcattagtcaattatcccttcagttttctggttgttggatctagtgttgacttcttttggtgtgctgtgactcattctgtgtgttcacctgtccttctggttttcaaagggggcagtggtttgccctgtgatcctgattatctgaaggatctaagaaaaattactaattttcagtttagtcagcatttttcttattgtgaggaccagagtgatgatttctaaactctttaaaagtcagataagactaatcttgttttttaaattaaaaaaataagtatgtagtaactagataacttcagtaatctgaaagtctgaccttcaggaagctcaattatacctaaaggcattgtacatgtatgtttataaaaactacctgtgacaatgaaaaagtaggctctaggcagtgaaaatatactgtgtgggggcattcaaaggaagttatatcagaataagaaatcaaaaatatttgcatctttgtattattttactatgtatttgattatgccagtatgtttctagagaagagaagagaaacaataaaatcccagtcattgtttatttcaaaatgtccttagttagctctgcgtgcaggcaggccaccataaatgtgcatccacaaatccaagtccacggtccagggggagtttcctgtaacacaatgcaaaactgagatataatccatcaaatactgcagactcaatatatatttgcaagccaacaaaggataagaatcccaaggtcctctgagtaaaagttgaaagagcacataaaattatgctagccttaggaaagaaattggagaacaggacaaatgtttaggttctatttaatattatttgcctgaataatatggagtcaaggctctgaaaaaaaaaagtagatcaaacaaggatgatttttccaagtgattttatcaccattttttcctttagtagaaaaaataaataaaaccaactgcttatctgttggcgggaaagatatttttcagttaaacaattgcacaaggccgatgttctgctggcctgcttcagtaaggctctaaacattattaaaatatttcttttcagcttgttggtaaagccactgcccttagacctccagatgcccctcatcatgaaacccttcccgagagtcttagagcacctggcctttgtgcaacacggtggatagtatttgcagtagcagaggtccagcagaatcctattagcatgtttgttctgggccaatgcccatactctactggttgctaaatatttggaatagcatcctttaaatcatgaacaaagcaaactatgatgtctggttgtattttaaaaatatatattcttccagtctttcaaaattactttttgatgtaacttatagacaggggtattatttagagtttaatacttgatagaggagatatcatcaataatttcaatcctacaggcatttaaatacaaagttatatcattcaatgtgattgttaaatttttgtatatacacacacacacacacatagaattgtatctgaagaattaatagtatgacatctactttgacatcatccttgaaaatatattatactctgatattgagaaatttgcagattttgaagtaagcccttctcaaaatattcttaccaagaagtctttcagcataaaagagacagtctttcatattcaatcaatacacaatgcaataaacttctgtggacaaaacataggctatgcttgtgattcaattagaaaagtaatatttctgttgaattttgtgtcaaaacaaaaggaagttacaacaatgaggaaggagaggggtgtgcttcgctggagagtgaaataattaattttgaagacatgcagctatattgtactttatttgaaagcaagcaaatgcaaatctttttcttcatcattgtgagaaaagaacagatgtttctatttgacatcaaatattttttcctgaaagcaagtcttagggacagcactaaagttggtatccatttaatcctacatctatgtacttaactatagctgaagcactgtataaaataggtgaacagaaattagaaaaaattaagtagttttattctattaaacgggtatagaattgtgaaattctttagaaaagcattctatagaaaaaaattaagtattctattaaaagggcagagaattgtgaaattatttagaaaagcgttctatagaaaaaattaagtatttttattctattaaaagggcagagaattgtgaaatactttagaaaagcattctatctagaaatgtttttaaatactctgagtcagagctgtctaatcgaacattttgtgatggtggaaatggtctgtgcctgcattgttgagtacagttgccattagccacatgtggccagtgaggactagaaatgtggccaatgtaagatataacctgattttttaaatttcattcatttttaattatcttaaattgaggtttcagtagccatgtgtgcctaatatactttattagatggcacagcccaaaatatttaaacttcaattatctggaaactcatttaggtggaatgtctcaattctgaatgattattaatagtggcataatttctgtatttgtgtttttaatcaaaaattaatgttgtgtgctttcagatgcttgctctaacgacctttaacatgttaaagatcatatataaacaatactgaaaactgcaaaattaagacaagttcatttccaaccaaatcatatatgcattgacaacaatggtagcaaacatcaggaaagctttgttgttgatcttatatgcatattgagagtttctctttttacgtgagacaaatccccaagggatccttaaaaacaaatatttttttcttctcacaaagcaagttatccttccaataaattcttaacccattaaagttacaaaagaaaaagccaagtcagcagatgtatctatgcttgtaaggtattcttgacctattgtgtactcacattcaatcaactagtaggagctttggtaacactattattttcagctctactgacaaatcagtatcctaaactgaaataaaccatgtggtctcagcatggtgaaatagctacaatagccatttctctggaggggtctctatgagggttggtcaagtgtatgtctcatgatatgacttttctatttggtaatgtgtacgaaaaaatgcagaaatcaaactgtggaaaatatttttagagataaataactctgtcatgcttaatgttgaacaaaatcaaacatcagaatattaattagtctccaaactcattttttaagtattttttctagcatttactttatgtcttagtctgtttgggctgctataacaacatatcataaactgggtggcttataaacaacaaacgtgtttctcatggttctggaggccaggaagtccaagatcaaggtttaagcagatctggggcctggtgagggcttgttccctataagaagcaatttcttgccatgttctcatgtggtagaagaggaaaacgagctccctcaggtctcttttataagggcactaatcccattcatgaaggttccgttctcatgacctgatcacctcccaaaggtcccaccttttaataacatcacattggggattaggcttcaacctgtgcattctgcaggggacacaaacttttgaaccatagcacttcattcctgaaatttgttccatttgtctttccatttctctctcccttctttgttccaagtcttctttattttaatttttttctctgacaaactcctttcatctgtgctttctcttatttcctcttcaaatattttaagtgggagacttttataggtcatatgtctactttgattgttacctgtgttgtatttttaaatagactctgaacaaattaatataaaaaatgcagctctaagagaaaagaacaaaatgtcaaatagtaaatacattttgtaaattgcaatcatggagagacaaccttttttgcattgacacacatggtcagttttcaagtatgtcattgccactcattgtaaaaattacttaatgatgccacacagcacacagtctccagtatgctacatgcgttataagctcagcctcattgcccagtcccagcaattttactaaattatagtctagtagtgagatacagagaaggagaataagagaaagttttagttagtatgacctggaagccagaacagacaaaatagatactaatttgttacataagtctatagaatttttgcagttagaggcaatcttagaaaccatcattagacagatgaagctaatctaaagatgggccaagtgactcacgcgaagtcaggaaatagttaatggcaaagtttgactacttaaatttcaggtcctgtgtctatgttcccatcacactcttacaaatgatatacacttaaatgtaatctgggccctatgtttgccaataagattagaaaatactcactagcctaatgtgaggtcaattggttaaccaaatagtttaggaaacactagcctcatagaagggtaaatattctccatatcctacataggtcaggttggcttaaaaactgaacacgtgaaaaaattctaattctatattaggatgttaggataaaaatagtctcaaacctcatctagtcatcttcttctattgactatatctgcattgtgggcaagacccaagcatacctatgggctctaaaaatggtggttagaggacatcacctaaattttctttcctgtcaactttccttgaagagaatatttcttttagctagatggtcagatccctgaaatttctggcacatcaaatgatgacagtgtctctcagctgagagaagcggcctctttgctaaaaggatttgactacctgtttgggaggcacccttgtcccctaggtcatttaatgattttcagatgctcagacaaatatttcccttgctaatgccgtgatgagagcttttggctaaaaagtgtttaggatgagatgttgaccagtgcctcagtatattaacttgcatcatcagtttgaatagggcagactcttagtccttccaggctgtgatcacaaaacccgtaaactgggtggcttataaacaacgaatatgtatttctcacaatcctgataggtgagaagtccaagatcaagatgcaggaagattcagtgtggtaagtatttgtttcctggttcatagatggtaacttttttctgtgttctcgcatggtggggagggcaagacagctctctggggtatcttttaaaaaggcactaatgacactgatgagaagtctctacccttatgacctatcaccccgcaaaatgctccacctcctaatacaatcttcttggtacaacgtattagtctgttctcacgctgctaataaaaatatacctgagactggataatttataacgaaaagaggcttaatggactcacagtccacatggctgggagacctcacaatcatggcggaagacaaaggaagagcaaagagacgtcttacatggtggcaggcaagagagctgtgcaggggaactcctatttataaaaccatcagatctcatgagacttatttaccaccatgaggaaagtatgggggaagctgccctaatgattcaattatctccacctggcctcgcacttgacacatagggattattacaattcaaggtgatatttgggtggggacacagccaagctatatcatatggtatccaactcattcttaggattaggattttaggttaggatttccacgtatgcattttgaagagacacaaacattcaaaccatagcagacagagtttctcaagagataccttatggacatcttgggccaaataactttgttgtggtggatgtcttgtgcattgtaggaagattgcccacatgcgtggactctagatgccagtaacacccctaccagtcatgacaataaaaaatgtctccagacatagccaaatgttccctgagagtcagaatctttctagttgggaaccactgtggtagggaaatggagatgaagtaacctttttctctaccattgtgtttcgtgtgttctcatggattctcattggttctagcgatatttgagcaaactgaacagaaatgggtcccaccctcagcaactttatagcccaatgagacagttaggcattaagaaagtaagtgaatataattctagattgtgataagaaaatgctatgaagaaaaattaaaaaagaaagagattcatggagatcttctcagcctggatagccagggaagagctatctgtcaaagtgttacaatctgaataatgaatgtgatttatctaaatgaatagtataccatgctaataaattattccaagtgaacaggcggccgctgaatgtccaaagtttggatgtttaatactctgcagccataaaaaaggatgagattatatcctttgcagggacatagatggacctggaggccattatccttagcaaactaacacagaaacagaaaaccaaataccgcatgttctcacttataagtgggagctcaatgatgagaacacatggacacataaaggggaacaacacctactgggtcctttcagagagtggacggtgggagcagggagaggatcaggaaaaataactaataggtactaggtttaatacctgggcaatgaaatctgtacaacaatccccatgacacaagtttacctatgtaaaaaacctgcacatgtacccctgaacttaaaagttaaaaaaaaaaaaaaaaagattcaaaggcactggactctactatttgaagtacagacttgcaaaaattctacattagtgcttggcaatagcccagcaaaatgcactttggcagtgaaaattagccacgtcgtaaaatctgcaattcgaatgtatttacattcacaacattcaatcattattctgtactatctattggggcagaggcaacacttttcatgaccattctgggtggccattgctgctttttctatcacagccatttcaagaggctgggacctgaagccccagtgtgtgcctgaagtctttggaagtgtttctaagtcaccacaatactagcacagactcccacttctattcacggccacctcttatgcctggcccagatcctcttcatttgtgatgggcatggggcctcactccattgtcttcagtataaccttcattataatacagtgccttactggaaggaggccttcaatgactacatgttgaacacattatttaacatataaaaatgatctcaacagaatcaataaggtaaccacttgttagaaatttctttctttttgttgggattttttttgtggttctctcttagaaactcttgccacagctcttcttcattcatgattctccaggcctgggctgcactccactgccagagtcaggttgaccctgtgactctgacaccatctccatctctcagaagggccttgctctttaaatttttagttcaacatgacctttgaaatggtcaagctttcctctgtctatttcctattccttatttccttttaagtctgttaataggttccatgttcaactaatggaaactctagaaaagaaagttttaagcattatacatttgtgtcattatcaaaataagaatgtgcatctgtaatccttcaaaggttaactctttggtttcagccataaaatgcaacttgagtcttgataactgatggagaagtatgtagggtaggcatagcacttttttttaatgcatggagtaggaaattcaaagcgacatttttgattatgtatgcatcagcaactgtgatttatggtacctgtttgtgtctgttacatgagtgatgggttcttacgccaaaaataaagttactatattcacacctgaggcctgagaagtaacagttcagtaaaagaagacaagactctataaaaaataccaaagaaataaatacaatgaacacttatagcctgtcttcttacctaagaacttattactttctaccttgtattattaattttgacaactgtgcttctgctcacaaacctgtaaattgctgggctctgcttgcagtgaagctactaccttcattataatacaggaccttaccggaaggaggccttcaatgatacatgtttaacaaattacttagtatatataaatgatctcaacataatcaataaggtaaccacttgttagaaatttctttctttttgttggcatttttttgtggttctctcttaggagacttttgctgaagcttaaatgctttaaaataatttttaaataattaattactacaaataaatgagctatttagcctgaaatattaaagtgctatttccagaacttatatttctgtaattaaaatgccagttttgttctctccgggctctgtttaagaaaaaaaaaaaaagtgattttttttttttttttttttttttttgagatggagtctcactgtgttgccctggctggagtgtggtggcgtgatctcatctcactgcaacctctgcctcctgggttcaagtattctcctgccccagcctcctgagtagctggaactacaagtgtgcaccaccacacatggctaatttttgtattttttgtggttttgccttgttagccaggctggtctcgaactcctgacttcaggtgatccacctgccttggcctcccaaagtgctgggattacaggcgtgaaccactgcgcctggccaaaaaaaagtgattcttaaatgcagatgccttggtcaatttatgtatgtttgagatataaattataattcagaagtatgaaggtgccaagatcactatgggaattaaatatgatattttaagagattttgagaggcttattttctatatatgaatggataaagtcaaccacagttagaaacatcatttatctgggtaacataattgtgatttcatctgtaaagtcaaatacaaggcagcattatgtggattaacatttttttccatattatagaaacagtgttaaggaggaatcttagtcaaattccatttttttaagagacaaaacaaaataaaactgtgattgagagttcaaagtccttaactcactagtagcagaactgggtcgtgtttatgaacttttctcttcactgtactcaccaccatgcattctaaccatgaaagcaattgtagttctacagcaccacaatccatgctagtgctgatacgagaaacctaaaatgaaagggaaatcatatgtaacattgtgttgattgattgaaatgtgtgactagattcagaagtacaagccagaagtttggggaaccttacttctgagaatgggccagttctgactctcagtcaagcctaaagtttgttgctcagttggaaacaaaagcatggatatgattgtccggagaaccctgttgctgaataacaaagaggcataagcagaaaggagaattcagaagcacaacataatctaaatttgatttatggcagtgtgcagtctggatgtctccagcttgtggtttcagcttctacttctcaagtagagaagctggatggtggtaaaatacagcaggctgaggagggccagactggagttgagattttctggactatgaactctgggtgtggggtgtatcttgagaggcatactggccacaaagggcggccggagggaaaaacaagttttgcatgcccatgctctgttcagagtccaagaactaacatctgtttagttttggaaacacaggctggctctgagtatggggatttagaacagcagaaaggtcaacattgtataggagagactcaatgttttcacaatcgattaggagcttagaagaattggggtggcaagactaagaagtgagctgcaaggatctgaatgaaaagggctgtcaggccaaggcccatcagcgaaggcagagaggaactggccagagaccagggcaggaagtgtggctcacaattggaaagcagtgtcagaggagtaagagatgaatgaaacatggattaggattaggattaggagctaacgggtacagaaccaggacacaaacacaaaatctaagaactaccagtcaatcctggaatatgaaaacaaatgtcatggggatcagaattttgtctcaagggaactgtagtgttgctgcttagaagtgcaactgatcccataagtggggaaaatgagacacacacagaaaagtataggacaagaggcctgactgtttcctattctcatcccttcattcttgttgacacagattttgattgaggtttgaagtttaccatcagaaccatatctttcctagaaacagagaaactacccaataagtaaaatcaactacagtatcctccttgtagttttgtcattatttctcattagttttatttcacttatttaagtagcaatgaagggataggcagtagatgacaaagttactactataggagcactctgaggcattatccttcctcaccactaatgcacttctgatttttttcctctgttctcctctcttatttagtcttttacatataatttgggttttacaggcaatgtctcacagagtcagtggccactgtgactgcttcttatcctcattagagcaatcactaatttaaaatcagtcaccatttgaaaacttttaaaattatgtcacaagactgtaggatatttcaagataaggggctagtactcctcactcatatatatccggtcttggcattgggaatcattagccaagttaggagctctccagctggcccattgcaaagcaatgcagacagagggaaagttgaggcacctgcctggttcactgggtttgattgcttactaatccttcacttaacttggaacctccttgctcaacctcttggctcaggtgctggggagaacacaggttggcaagatgcaagttctgccttgcaagcatttttctcctgtatatgcacacacacacacagacacacacacacatatatgtgtgtatatacaggagaaaatgcttgcaaggcagaatttgcacacatatgtatgtatacatacacacacatacacatatattttatatatacatatacatatatattttatatatacatataaatatataatatataatagaaaacataaacatacatatatgtatatattatatgtgtataatatatgtacatatatgtaaaatatatatgtataatatacatatatatccatgagaatgccagaaacaatatatgtataatatatactatgtaatatataatatatactatataggtatatatgttcatatttataatatatatgaacatatttattcactgcttaaatttccactgttaccatgtgcctggaacagcttagacataactatttgcttttgagtagactgaccctagaaacaccatactgtattcaaaacaactagtttctaatcatggaattaagacactaaggtggaaccatttcagactggaagtcattttgaggttcacactgaagctatttcgtatatatctcattatatatacatatcttatgtatacatatatagtatacacatcttatgtatacatatatagtatacacatcttatgtatacatatatagtatacacatcttatgtatacatatatagtatacacatcttatgtatacaatatagtatacacatcttatgtatacaatatagtatacacatcttatgtatacaatatagtatacacatcttatgtatactatatagtatacacatcttatgtatactatatagtatacacatcttatgtatactatatagtatacacatcttatgtatactatatagtatacacatcttatgtatactatatagtatacacatcttatgtatactatatagtatacacatcttatgtatactatatagtatacacatcttatgtatactatatagtatacatatcttatgtatacatatatgtatacatatcttatgtatactatatagtatacatatcttatgtatacaaatatgtatacatatcttatgtatacaaatatgtatacatatcttatgtatacaaatatgtatacatatcttatgtatacaaatatgtatacatatcttatgtatacatatatgtatacatatcttatgtatactatatagtatacatatcttatgtatactatatagtatacatatcttatgtatactatatagtatacatatcttatgtatactatatatataaataaaataaaaaacaggaaattgcttggtgccaaagcacagaagaggaagataataattttgaggtatttgaactggactttgaagaatagaaagtttttttttttccctaaagcagtgaaaacagttgaaaggccagaatgatttatttcaagtgttacctttaaaagaatattaatacttgacagtctcttcacatatatgcctgtttcttttctttcaaaaaaactaaccccatgactagaattttgatctacttttgcctttttttttcttttttagtttaagataaaataaatagtctaacatctgtaacatatcatggctgaatttggttatacacaacatgcttcattttcatatcatatcttacttgagtttaaacctgcttttcatattttactcctttctgttactcaattcaaaagtatttgccatgaatgacttcataaccatacattttagatggtctgcttgggatttttttttgccttatatttttctattggcttattttcctttattttaatatacacacattcccttaatgttgatttcttcacgctgacctgtacccctcccttaaaatttattgccagagatgaaatgcccttgataatcttcaccttaagattcactcccctctctgaattacttcatttggttttcaaaactaaaacttataagaaatctcagactcgcaggaccctaaatataacattagtaatgcaagagagataaaacatataaaagcaggcatactcaaaaagatacagtacaaaatactgaaagaattaacagaatgagaaaaggaagcattaaattcacatcaaagaaagctttgaacattaaagcaaatgaaagtgaggggaagaaatctatatggaagccaaacaatcactgcttcctgacagctgcagttattaattagtgttccatcatttgcactaaatggtcaatcaatacttttgcttctctggaaggccatttgctttgtagcttgcttcttaatgggaaatgattcagcttgtccccttctttgtcattctgtccataactaccagcttggcagagagttcgtaagctgtgctggctctagataagggtaagaattttgtctccagatttcagttctctcctgcccaaccacctcacctgcaatctattgtttatattgttgctatgtatctctattctttctgcatcaaataatgaatagctcattttgtgttgccttcaagtatgacaaattcctttccaaatgtgattccagacagtatatccaaacatgtctttcttttcccattcctgatcatcctacatgtcaagcactgccaacgtttactcaagaaagcttggttagaacccagcctctagaagcagtagattcctactcattcctgactcttttagccacttgtcgtatggcatgagcaggtgtcttaacttctctatttatgtcatcacctcctgtttcctatccacagagctaatacctagctcagagcattattgtaaaaataaaatgaactagcatatgtatataaaaagtaaggtggttacctggggattggaagacacttccatcatatttgttaagtgaatggcatagagcaaataaaaaaaaattgactcattattcttattattcttttatatgattactgctctctcctggagtgcacttctctgcctgactcaccctttaagatacatctcatatagaaactccacatgaaagccttccgtgacgcatgatcatggctattcactcctctattctgtcacagtcctttgtgcatttctcttcatagctctcacacttcatttcaccatactgcacatctgattgctttactagactctgagaatcactgttgctagaacgtatttgttcactgcttacatttccactgttaccatgtgcctggaacagcttagacataactatttgcctttgagtagaccaaccctagaaacaccatactatatttaaaacaactagtttctaatcatggaagtaagacactaaggtggaaccatttcagactgggagtcattttgaggttcacagtgaagctatttcatatctaaacctcaggtgagatgatatttttttgtaaacttagggttaacaaacctatttataattattgtgttaacacaatgcttcatgtactactgatttttcttgaagtgtatacctataggaaatagaaatgtccatggtcataggaacatagaatcagacaaaagttttcgagttaagataactaattggaaatcatatggacataagaattaaataaaaatgggttatttctagagatatatatgtaactaagaaaaaacaaagataaacagatacttgatggcacattactgaatttcaacaatattccttcaaaataagtgacaagagatagtatagtcactgtgatatatggtcctgtccagtgacgttctgggccctaggtctagacccattatttgggttaccagaggttaggcgcttaacctctttctttgctagttttttcatctgcaaaacaggattgaataacactcttacctactcaggtaattcctaccctatgagaagggaaagagataaagcaagtacaagtatttttatactctaaaactctatagaggccgggcgtgatggctcacacctgtaatcccagcactttgggagactgaggcgggcagttcacctgaggtcacgagttcgagagtagcttggccaacatggtgaaaccccgtctctactaaaaatacaaaaattacccggttgtggtggtgggcacctataattcccaactactcaggagactgaggctggagtattgcttgaacccaggagggggacattgcagtgagcagagatcgtgccattgcgctctagcctgagcaacaagagcgaaactccatctcaagaaaacaaacaaacaaaactctatggagtcaaagatactgtgaaatacagcaagtccctgggcctttggtgactctgtatattaacagagggctctcattcaagaccttatctattgtccagcattatttgtctactatgatattcatcttttcaggacctaatccagctggacctctacttttttaatggttctagttttgatttgtatacagtttcagcagcaaactccctacaggccatacactagattcacgtccatttggcactgaggaacaaaagaaaatcaccctacctaaagtgatggggagcaaaatattgcttttgatgaatcactaatatagttttatctagctacagttttgtcaaaaagagactattgttgcaaaccaagttaaatagttttttaaaatattttttattgtagcctaatgaagattacttaattgcctgtttaaaggacttggtggaaaaatatgtgaaccacagctttagaggcccatgagctttgggcagtctatgtcatgttcatctccttatccccattgttggctccaaaactctgttagagtgttcagcaagtgttaaactgctcctaataatgcctaagtcacagtgttggatctcaggtggtgcagacttacctatcccaacttgagagaagaatgagcagccgccataggtcattaacatgccgcctgcatcattcacttacccactaaattgaggtacaaccagatggaaagaacatgggtttttggcacatgggactggatacctgaagtatggaactcattcctaaacaatggctggaagctttgggtagattccctgacctgagaattgtatggcgcattgttaggaaagctaagtctgcaggaaaaaaaaaaaaaaaaaaaggcatgttttggggtcctggctgtgctgtaagcaggacaaattcttaggatttctggtgctaattgagtgaccttatacataccatttcccctcctggggctaaaagaagatcagagaggatcaaagaaatcagtggtttaaaaaaactcaaaacaaaacaacttgagaccctaaaacagtatttggcctttggaggtttttgtttaataagtttaaattgtccccaaagtgtttctaaaaggcaggttgtgctttgctgcaatacaaacacctttgtttctgatgccacacagcaggcttgagagaagcattggtgttgtatttgccctttgtacccatctatgtttgacactcattgaccaaataggttaacattttaggagtctatcattctataaaccacctgagtgacctagaacaagtaactgaatgtctccaagccccagatttctcatttctcccttggagatggccattataatatctgcctacctatgtcagtggttattatgatcaaaggagatcaatatgtgagcatgctttgcaatctttaagcaggaagaaatgttcattagtgaggaaggataaagcttaagcgggagcttggactagataactgctagacaaggtcatacctctattatgcagttacagtatttgataataaaatgtctttaataatcaggaaaattaaaataaatgggggcctcaattatatctagaaagatattcaagaagacagactctcattagaggagaagtctgtggcaagaggcaaacaactccaagattggtttcttaactggttgtgaaattgcctccgtttatcccataagcagacctccccctgagtggatttccttaagagaggttatataggtgaaagatccttatgcctggcagcatattatttagaaatagtccactttaaattgccatggagagaaccaccaaaagatgcagagagctgtttgtgtcacaaatgttaagctataatctcactttcagatttaacctagttttctttgggaggccgaggcgggtggatcacctgaggtcaggagttcaagaccagcctggccaacatggcaaaactctgtctctactaaaaaattaaaaaaaaaaaaaaaaaagccatgtgtggtggtgggtgcctgtaatcccagctgctcaggaggctgaggcatggagaattgcttgaacctgggaggtggaggttgcagtgagccaagatcacgccactgcactccagcttgggcaacagagtgagactctatcataatgttattaaacatgtaaaagaagcatctgacaataatttcaaataagctgcttaattttacaaaggcattccattcctgttttggcactgccattggtcatccatgtgactttgagaaaactactaacacaaataaaaaataacaaatttaacttagttttatttaactcaccttggttttattcattgagtagtgatgatgatggcaagactggggaaatggtagaaacttatattaattgaggtttttttttgtgccagggacgccacacagctctttagcatttcataaagtatcccaatgatcctggaagttgagtaatgcattatccctaccttacagatgattcatccgaggcacatttgtgttagcattttgttcaaagtcacacggatgaccaatggcagtgccaaaacaggaatgggatgcctttataaaattaagcagcttatttgaaattattgtcagatgcttcttttacacctttaataacattatgatggtatgaaaacacattttaggcagcagccaataaacttcaatataataacaattaccatcctgatttgatacagaagcctccaacttcaggtgttcttttaatattctatatgctagtcgattttgtttaccatacgcatagttataaacagtcagtgcacatgttgttgactgacctaaatatttacactgtcacatattattaaaatctcagtgcttttctccaattctgtaagattaattgtctactaaccaatgaaataatttgaatttctacttttcttcttataagcttaggctaatttctatcaaagagaagtttctcaaaaatgaggactggaataaaagcttctgtggcttgttcacagcctcattgactggaagaattgtgtctcttggtgggtaactgtgcatggggtgctaaggactgcttggagtctaagtgggaaaatggcattctgtgactgggaacctctgttccttaaaccttttctgtttaattagaaggaaggatgtcccattttatcctcacttaaagagcaatgaaatgattaaaaatagtgttttaatttcacaacttaggagcaataaataattttgagtctctggctgtcactatcagttatcgctcaacttaatattgttgaagtttagataaggacagatggttctctcttctcagtattagttctgttgcttggcagttaattacctgctactgtgactccctctcccatcaccaagaaatcataaaaacagaaaaagtaacggtatctttctccaagaagtttgctttgtctcatggattggttcctttgacagttttttatttgagagggctcctcttcgtgttcctaatatgccaaagttaagcatgcaacctcggtcttcatgttcacaagttgaaatgggcgtgtgcttcttttacaattatgtccaatacgctaactgaaagtagaacatgcctttctcctaggggttttcaaattcataggatggtttacatttattagcttctgaagtaaggaagatttctcttacaaaaataaatcactctattttttgttaaattgaatctactttgttccccacccaatgttgatgcaataaggagaattttatttgttctatgacttttcaattcttgcacctgatttggaatatcacatcattctgtctgccccttcggtcttgttttatttgaatctttcagcccaacagtcagctttgctgaggctacaaagaaatgcagtgccaccaaaatatgagagaataactaagctggacatttcacaaggctgctgatgtgagaaaatacaattttagcaagttttaatctatgtccctaaacaatcttaagttgaaaatattgagagaagtataacagtaggagacaatgttttgcctaattttttcagacttcaaattagtgaatcgaaatcatgttaaaaatttgcaatttcagttcacaggcagatttctagattttaatatataacagacaaaccacttcagcaattacttttgcttgcactgtggtttttgagaacattggagttttttccatattttccattatctctgagtttttcactgaattttgctatctttacatattctttctaattgaaaagggataatttgttcgtccttgaattcagttttcaaagacatctgaatatttgaaattcacttctctttctccattttttttttgatgttatcctctctgtgttttctttttaaggaaaggtaaccttttgattttgttgtttattttttgaaaactattgtttcaattatgaaacagagataggaaataataatccgataaatgtccaaaactatcattatatagcatgacattcagtaaatacccagtaggagtgctggcttacattgcagaaagacctgcagagacccaaatgttgaagcattgaaagagctgaatacattggactgaatacatagaattcttccctaaaaaacaagggaggcaagtactgtttttttggtttgtttgttttttctcagttttcaccactaatttgcttataaaggaaagaaaatttgagtttctgtggactcttgttttattacattcatacaaaacttttttttttccagttatttcacaagaaagaaggtgtttagttgtccacaaaggactatgcctctggtttggtgcaatttctggttttagtagttcttatccctattgtctactccaaaatgctgtcagcacagtttctccagccccatttatcatcctgtagagtagtacctctttactggctcactttcaaatacctgagtttgctaatgttgcagctttccacgttacaaaagaccctggtagcctccctagagaaggcaattatctattatgcttaggggacacaaaagtagctcacggagggaagtgcctacatactctgctcatgctgaggctgacctaaatcaatttcagatgcctataagtaaaaattgagctctgtatataaggttaaagctgccacatttttattaaagaattatccttctaggataactgcaaatgttgaataattttcatggtgattacaatgttcaaaggaactccaaaataaaaaatagaaatgacacctattttggagtatcttacttccatttccattcactgtctgttacgttttcactctttattatagattgtatgtctgtctttggtttggttctttcagtcttatgatgtgttaataaactattatagactatgtagaggatgtaatcattaaatacagaatacaaacaaaactaatcttttgaaagctattatttagagaaagagctagaacctatgtaaacatatatatattctatatatatactctctatatatattctatatatatactctctatatattctatatatatactttctctatatattctatatatatacagtatatatatagactatatatactgtatatatatagtctatatatatactctatatattatatatactctatatattctatatatatactctatattctatatatatactctatatatatactgtctatatatattctctatatatattctctctatatatcctatatatattctctttatatattctatatatatattctctctatatattccatatatatattctctatatatattctctgtatatattctctatatatattctctatatactctctctatattctctatatactctctatatattctatatatattctatatatattctatatatgtattctatatatattctatatatacattctatatacattctatatatacattctatatacattctatatatacattctatatacattctatatacattctatatatattctatatatacattctatatatattctatatatacattctatatacattttatatacattctatatatattctatatacattctatatatattctatatatacattctatatatattctatatacattctatatatattctatatacattctatatatattctatatacattctatatatatattctatatacattctatatatatattctatatacattctatatatattctatatatattctatatacattctatatatatactatatacattctatatatatattctatatacattctatatatattctaaatacattatatattctatatatatattctatatatagtctacatatatattctatatatagtctacatatatagactatatatagtctatatatgtagactatatatagtctatatatatattctacatttatatgtgtgtgtgtgtgtgtatatatatatatatttttttttttttttttgagatggaacctggctctgtagcccaggctggagtgcagtggcacgacttcagctcactgcaacctccacctcctaggttcaagcaattctcctgtctcagcctctgagaagctgggattacaggtgccggctaccatgcctggctagtttttttgtatttttagtagagacaggttttcaccatgttggccaggctggttttgaactcctgatgtcaggtgatccacctaccttggcctcccaaagtgctgggattacaggtgtgagccagcatgcccagccctcctgtgtaaacatattaaacgataaggtgctcactattttctgagctgtacaacaggaacaattgctgaaaagaatggtacctgaaccctgtattgggtgaccattggccttttgtgtcctgtgatgggtagggcttggcctaggacttccagacactaataccctggggtagaatgcaggcaattagtaattaattgcactgatgtgtctaacatgttgtagtagtggcgattattgctccatttaattcgatgagtaatttagacattaatgcaaagttttagaagtagcagcaatcatttatattatcctttctcaatacattaatagtttaggaattttcattctgtggctggttggtgagatgagatgaggccaatgaaaactccttggcccaggggattggagatttgaaatatttactatgtaagtgacattgttagaaaacactaggcattatgccaaaattacaattatgggttagtgttatggactgaattgcgtccacacacacacaaaatatatatatatatatacacgttggcgaggtgcagtcgctcacgcctgtaatcccagcactttgggaggccgaggcggatggattacgaggtcaggagttcgagaccagcttgtccaacatgatgaaacactatctctactaaaaatacaaaaattagctgggcatagtggtgggcatctctaagcccagctacttgggaggctgaggaaggagaattgcttgaacctgggaggcagagtttgcagtgagccaagattgtgccactgcactccagcctgggtgacataacaagactccatctcaaaaaaattttcttaataaacatatatgttgaagtcctaaaccctactccctgtgaatgtaaggttatttgcagatagggtcctagcagatgtaatcaaggcaagatgggtgttggggtaggcactaatttaagttgactggtgtccttacaagaacagaaaacaccatctggcaatggagatacagtgagaagatggcaatgggaagatagaggcagaggtgggagtgctgcagccacgagacaagaaacaactggggccaccagaagctagaaggggacaggaaggatctgagagctcatggtccagccaacatcttgagttagattttagacttctaaactccacaattctgaaccagtaaacttctactgttctaactcacccgatttgtggtacattactatagcagccctagggaactaaaggagttagaaaccttttcatacttatttagacttactaaaattatacctatcacaaaatattcacaaattggttcaaagaagttgatcagaatgatgatatatatagccaacggttacattcaattaataaactacaaatgagaattattgttactaatgactcacctgggaagaactattaaggtaatttaaagaacacactttatatttagagaaattagctaaatggtcaatgcagttcaatcagtagttttcttatatttactatttcccaggaactgtagcaaaaacaaggatacaaagataaataagagaagacattatgaaagttggttctctatgaaataataaccaggtattttcttttagaattcttgtgtgaaacttcagaattctctataggctattgcattttgttcccaatgctcaggtcttatagtagtgtgcttgccagataaaatatggaggtccccgctgaatttaatttattgaggcttttttgttttgttttgttttgttttgtagtaatatgtcctgtgcactcgttgggacatacttatgctaaaaaagttgttttctggaattcaaacgttactacctgccccacattttcatttgctagatgttgcagcctgggtagtagtgaaagtcatatgcaagatatcaaaggtgagaaactgaagaatcaacacttggaagtggctacattcctacaatctcacttattgccaatttgctatctcaaggggcttataacaattttcagtcatctgtagtacttaagtcttaggaatattttggtgattaaatgaagtagtacattgtaagtgttagaacagttactgttgaatagttagggccctgtaactgttcgtttttatttttttttcccaaatcagtgtaatgcatagtagagcattttcctgtattttgaatgaggatacaagagatggccacatgtgtacatttgctaacaatgtctaatctatttgtcaatactgaaagacacatctttgaaaaaagatgggtcttgttccgtttggttttaatcactttgtaagattccagttcagtgcctgatgagcctctgactttagaagcatgctgttaaatctaaacttttttttttttttttttttttttttttgagacagagtctcgctctgtcgccaggctggagtgcaatggtgagatctctgctcaccgcaacctccgactccgtggttcaagcaattctcctgtctcagcctcctgagtagctgggattacaggcgcaggccaccatgcccagctaatttttgtatttttagtagcgacagcgtttcactgtgttagccagaatggtttcaatctcctgacctcgtgatgcacctgccttggcctcccaaagtggtgggattacaggcgtgagccaccatgcctggcctaaatctaaacttttatgtgtccagtgtattagttcttagggctgctgaaacaaaaccacagattgggtcacttaaaacaacagaaatgtattctctcacagtgtggaggttaaagtctgcaacccagatgttggcagggttgttttttctggaggttctgagtgactctgttcccggcctttctcctggctactggcggttgctgttagtccttcgtggaccttcacttgcaggcttatcactccagtctcggcctccatgctcactcacatggtggtctcctcattgtgtatatctgtgtctcttcttacaaggacactggtcatataggattagggtctgcccgaatccagtattacctcatttagcttcatttcatctacaaagaccctatttccacactaggtttcattcacagatgctgacaactagtaaaacaacctttgcagacattataacagtgagaaaattatggcagtgaaagagatctgatgtaatcaacctccattttgcctttagccttcaaactgcccttaattattcctgggtttgggacaagctaatttggggaaatatttagtttatagttaaatgataatagcccttctcaaccacctttgtaaagctaatgagagaccaccaggtttaaaggatgagaggaacttaaattctgctacggtgtagacataaaggattacccaccattatttcaaaggtcacaagatacacaacttctctaattactcctgcagataacatcactatttgtagaaccaaagattggcctttccagatgtcttttcaggtttttttgcatgcacatctgatgatggatggctccacctggacccactaatcactccagtgaccccaccccgagggactcagcatgcgggaggaacatcttccattcccctgggattgcacccccaaccaattagcaagctcccattgccaggtcaccccctttcttccaccaaattatccttgaaaaaccctagcctctgaatctgggggaagactgatttgagtaataataaaatttctgtctcccgttcagccagctctgcatgaattaagctctttatttcaattcccctgtcttgataaattggctctatttgggcagcagtcaaaatgaacccattggtcagttatactaggctttcaacatactttgggtggacacaataaggaccagtggctatacttcaggggtattttgaaaacctcaacgattacattttatattaataggcatcttttttaacatttaaggtattctctacagtgtatcattggtatagagaaacaaaggttttctttcaaaaagtgttttcctcaatatttctagaacatacatttaggaactatttagggaacaatatctaggtaacaatacatgaatattatatttaaacactttatgatttgattgtaaaacaaatttcacagtctagaattcccaatgctttgagaagtaaataatgggggtaaataaaataaaattggtaagagaactattttttttcttttagcttcccttattttggggccttcatctctgcattccaaattacttcattatttttaaagtgccattcaattttcaattgtataacaagtgtttgctaagcaattacgtaaattttcttgtttaggtgggcaattagatgaactgaatgctaagatattttaagctaatattcttgcatgaaaatctaaattttctcattttccagagaaatgttaataaattttactcagccatgcaattaaataaatgccaacacttagattattactattcttaacaattaacaaatttcacaaatacttccaaaattagagtggtgtaaagagtagtcttggattgtgaatgacctcattttacagtttactaatctataaatgaacattaagtacctaataataatgccattgtcatgtttaaatactttatattagtaaagaagctataacagattttccatagcatatattcaaaatatattatttctcttttcctctccatttttaaaaataaaccacacagtcatgcccattaaatataaccagatatatttacttgcttggttttccttttgttttttcttgtcggggaattatagggataaggaagagattgatttttgcttttttttctgctgaagttataaatgcttgaatttggaattattttgtaattctagttgaaatgtgaaggagcatttactataggaaacatatggtcctataaaccagtatcagcagttttcaggtaatcaataaaataaatacgagatatccccatgataccgctattgtccaataaacgattacctgttacacagtgtcctttgcattgtgtaggataaaatgacagattatgtacaccgattttggtaatttccaggaaacaactgactcacagaagcttaggtggtgtacttggaatataaatgcacatactaatggagctgattttatcattcttaaagcataatcaaagtcagtagtttactaccactgaggagaatgatgctttagatcccagggcacttaccacaggaaggatacagggatgaggccatttgtaagccacatccagaagatggtgagatgacctctgtgttcctcacataagaaatttaacaccagcacttacccacacacactaaaaccaaataatttggatagcctcgttgtgattcacgtacatgtttcccaattgccggcaattttcactgtcaggctgactaaatgcagatcattaacttacagggtcatgtttttcaggccgttttggtattatgtaagaacattctcaaatctataatagcaagctctacccagtaatatttatagaagcgtatgtgtaattgttagtaggagaaatatctgaagacgattttattcgctctgtaaatatgtaggtcagggtcttaagaaaatgctcattgtaaacatttcttttttggacagggagatgtccctgatgttccccctagatgtccattgaagtactactcatgggagattttatttaggccacctagcattttgctgagcattctggttgtcagaaaaagataaagcacctgctgttatgttgttgctcactaagtagagaaggggtccaatggctaaaccgacgatttcaactcacggtggcaaagagcatcacgagcatgctcaggaagcacgctgaggaggcgggcacccaaccgaacctgcagagacggaggacatctttctggggagacaatacctagactgagttgtacaagatgaatacgatttagttgtgtggcgtgatgtttcaggtaaagcgttcatcttgagaaaatgcatagaataataataataataggggtctgaagaagaagataagagtggtatggtctgaccaggtctgtcaagataagtagctgtaatgagggagtggggaggtcacggaaagcttgtatgacttgcaagtgagtttcacccttatcagatatgcaatggagagcccttgatgtttattgcaaataatgcgagccagttttgtcattggcacttactggttttttgcttgtttgttagatatctgtatcttccagaagttactgaagataatggctacaggtgtgtcaattggcttgcttgtggtaatcatttcacaatgtatacctgaatcaaaacatcaggttgtacaccgtaaatctatacaatttaatatacacaatttttaggctgcaaaaaaaaaaaaaacgaaacaacagcctttgtcctaattccattacacattaaaacatgtattaactagtagaaaaaaagcacagtctgttcttcgagttgaataaaatcctcagctttctgtccttttagacaatctaccatgatcttaaatgaaaggcttaagttcaaatgtggcagtgttccagaagtagtactgtgctgcatatcaggtcagaaccaggcagggtgtaggctgtttaccatagaaggggatggcctcttagtgccaggtcgtcgttctcagtggaaatatatttagcatagatcaactggctttggtttcttcttaaactctgttcagaaaaaactctgagaggtggctacttgatattttaaacttgaccacaagtgttgaataccattcatttcaactatgaaaaaccatttccattatgaagtagaaaattaaaccctctggggctgatccacgcggagctcagttgaagtattacactttctcatctcaggaaggtgggcttctgatgagtctttccattgctgactaagccccagcacagcaaacctgttcttcattagggctcctcagacagcaactcaccacctccagggagtagcttaaaacagctgacccatacacatatactgttgagacaaaagtcttttcaattaaaatagaggcatgatcacagtgagttttaaacaggagattcatatgagcagattctgatttttgaaagacgacagtaaaagcagaatggaagtgtcaatttcagaaaggcaagaggatgtacacaggttacctaggaggttactgaagcagtcagtgctaaactatttgtattaagaaaaaaaaagagcttaagagaaatgcacatttatactgttgtgtcaaactccaaaaataaatggaaattgtgttaaacaataactagtatagatgagtaattttaaatatatgtatatatatatttatttgtatttctaccagatgtgtgtattaaatatagatatagatatagatataataaaacacaggctagagtttattaaattactatcccttatgatcacagccctgaggtccattataccagtttggttgttcttatctctttattgtttacatccattttctatgcaaaatgtgaaaggagctacctctctaaaaccctcggaaagattttcaccttgaaaataacaaaaaatggacagcttcttgtaaatctaatcaaagctctaacatgttttgaccagttacatagtttttaaaaggtgagggacagtagagctaatttaaaatgctaacaagtttttaggtaatcaatcttaacaattagatgattaatagctggggagttaatcatccccagtcacaaaagaatggctctgctcctgcttcatacacaattaattgtgagccagcaacgtcttgccattatctactgtgtctgaacagctattgagttgaggtttcctttatcatctgatgatgtataatttgattgtttcccttaaaactcattcctaaccaaaaatcaaaagaaacatactgagactttgatgatgaaaataatatatctaacatttaaaataaatagattttataacttggtgacgaactcagtttgctctctttccctactccaataaaaattattggttctgaaactaattttgacatttaatatcacattaactttcattgtcatttaattgctccatgtcctccttgttttcccatagattttaaacccctaggccttggacatatttctgaattcctcatcccattttataacattgtacacatccaataaatgtccacaatataattgaacagaattgagatcatgacgttttatctcagtaacttgataggcttgtaattatacagtatgccctaaagtgttgaattacataatctctacccccttttattttcttttacctgattcatttcttatttataactaatgtttattaatatgtaaatatgccccatcctttcctcctgaccgcaacatatatatacaaggactgtggtttctgttttatttacatttgtgaccagtttcttgaatgagtggctaaataattcagtgaatagaactcctactatctgtttcattgacttagtgagtttttaattctctcacttagtgaaattttacttgtcatccttgtttttatttccaccacttcccattcctaaggatgccttctattctataccttagttttagatggttaccacattgatgaataataatcaattctttttattttatatgaatgcaacatcagcttccattttcaaaggaaccttctatccacagaacacaaactaggaccgtgctaaaatttcaggagcctagtgtttattgtgttcataaactcatgacattttccagcttgaggtgatttaagaggccatgtagcacaaacttgtattttacagatgagaaaactgagcattgagcaagttaaatgatgtaccaaaagtcaaatcactagtgaatggcaactgagactgaaatcaaagtcccctaggcctggctgtgtccagattgtacgagtgcctcatgatatctaagctacaaaaccatgatgggggatgaggggagagtcttgctagtgtctcacagtgcggctggatgacaagttaggaacaacagcaggactgaggcaccagagttgctaggctatgaaacacatcacgtggaaccatggaatcacgtgcaatattttatttattatttattattttatttttattttaatatttgcttaatatttttatatatttttattttaatatttgcttaactgttttttatttccatcaagttgctcatttcaatgtttaatgaacatttagggaacagagtccaagatctgggttcaaagacctgagcagcagagtgagatgaaatcaagaaacctttcataaatctaaaaaatgatctgtaggctgttgatacaactcacaatatcagattggcagcctggaaattagtatcttcagttgaggaatacattaaaatcttaaactaaggtctttcaagaaacttaaaacagcacggatagaagtgtgtttttaacgtataaaattatttgtgcctgggatttaatttctttaacacattccaaaattcctttagggcataggttttgttctgcacaccactgaaattctgcataaggcacagtgtctagaacccagaaagtattaaataattttttgaaaaaatatactcatgtatatattccttagtttttgtcaatagttatttgatatttagtaaaaattacattttttgtctatatatatatataaaagcatccaaaatgatagagaatagagtgatatctaatgctaactgcccaaattacacaattattcccagcgagtacctatcatatgctgaggaattaatctgtagattcagatacagtacagtggccaagattcaccaatagatttctatttttttcttatacacatttaacatcagaatttgaacatcatagaagtttcaaaacagtttgtagaagctacttaaaatttgtttcagatctcctgtaatatacattttattattttgaccctgcaaagcaaatatcatttttatttataaagccgatgacataaaagcttattatacagaaacttgcatttctcatttcctaaaacttgttttctcttcacatgttatgactttgtttcaacttaccataaattcaccttgctgttccagttaaacttgaaatttatcgtgtactccttgctgctaaccagtaagtcagtgaggaaaatattgtatgtcagatgcttttctcagctctattttcctctcttgttggaattgccttcttcatttttttgtgtgttgtatatgatattctactgcatttttaaagaagagagataacttcaatgcatttataattcaaaggtttactcatgttgttcttctgttccagatgatagattttgaaccattctttaacactgatttggccatcataccaaaaagaaatacagttgtccctcattatccgtgggggaattggttccatgaccccatagataacaagattcaaaatccaaaatcggatgcttcagttctttattttaaatggcatagtattttctataacctgcacacatcttcctgtatactttaaatcatctctagattacttgtaatacctaatacaatgtagatgctgtattgatagttgctatattgtattgctatttgcattattttttattattgtgattttaatggttttgtattttcaaatatgtattttcaatctgcagttggttgaattcccaaggatacagggtgaaagtgtgactgtgtatgtataaaagaaactacattttcaaaagttgatattctaatcataaaaaatagactgcactaatatataatcatagaccactaatagaaaagatattaattgggattgagaatggaaatcctatgctggctaaaaagtctctgatgagctaaatagactgattttgctaagagctactctttcaagagcccacgggaaataggtacttattcagtttagtcaaacattcaggaatccagacccttagtaatttgaaactgtgacagctacaaacttgaccaatgtcaaatttacctatttcccatcaaaataaatatttacataggaaataaatcataaaaacagaatatttggggatgaagcattattcttttcagttgtcattttattcgtttgcttattatttatagtgttttataattaactgcaaaaaacaaaaaacaagaaataaaatatatacatttaaattcattttaaaatttaaattttaaaccatgttttaaaaaatctaactttagattttgaaataactcagactattttgctaatttgtttgaactagtacagtctcatattataataagattaagtgacatttacttagtttgactaccctttcctatagcgaataaactgacatttaaaaagttgctgcttgctggcacttaagattgactgatgaggatgtgcagtcatggaggaagagccaggactgagaaagaaatataaatgaggaaaaggaagagagaaaaggagccagacaagacttgaggagagatgagagaaaggaaatactgtttgagggtagaaataggataaatgaagtcacagagaagaggctttcatttccacatctgttacttgaccatgtccatggtatgagagtttcatagttctttttctgtttttgcaggctgcatgctcaaatattctctataaaacataaacccatctccttaccctctcttcatttagcatttattttcaagatgctggctacattggtacattaatttcttatagatatttaatgagtcagttcacattaactggtgttcccttgcttaaaataataataataaagatgctggtagcttgtacctatgattttggtcaccaaaatacaggatgtttttccattacccagtactaataaaaggtgaggtacagaggtacagtaggtgagacaaattcataggctggcagcagcttagtttttcctatatttgaccccaactggagaaatgtgtattattatttttcaaggctgggtatagagctatatattgttgagctgttttattaatataaatatatagagagttaaaattgttttcaaaaagcatgttaggagttcacctaatgggagtgactgagaagaagaaaatgcacagaatttagtataaagaaatcccaaataataacaataaaaaagcataaagtatatctgaagatttatgttcaacaacctagttcaaaatctataagaaggaatgatgatattatcacacagaaaattatcttatgtgaggttctagaactgactgtaggtgtcacacaaaatttagacaacagagattctgaggaaatcaacatatcctacatcaaggaaatagattaaaatgtggtatggtctaaaggtaagaggtctgaaccaatattttaaactacataatgcaagatatactaatattagattctaaatatttttaaatatttgtgatgttacttgtacttgaacaaatgaattttgaacatgcttcataattctgaaactctgccattacttaatgatgctaaaatatgcataatatcctctcctcaaggaatctcgatgtgttttccaaaattaaaactgtgtccaaactgagttttccaaaatccttaattttgagtaatgctgttatctttcacctctggagtgttcacaaaatctatttttattttctgaaggagtacagcgtgtatatattaaacacagctaaatgaaccgagaaagaaatccagatgtttaaccatgaaatctaaattttgaaagagtcttttgaaaatatgctgaaatgttttcaaaatatcatgatgatcaaaacaaattgttattggaatgaccttcactgtaagcagtattaacaatccggtattatacagaaagcatacatctttttttgaaaaatctttgtaattttaccattcagtgataaatataaattcctgaaaatgccattcttaccagaaaaccagtcaatatggttttacattagagcttttaaaaacttagtttgtggccaggcacggtggctcacgcctgtaatcccggcactttgggaggccgagacgggcagatgacgaggtcaggagatcgagaccatcctggctaacacggtgaaaccctgtctctactaaaaaatacaaaaacaactagccaggcgttgtggcgggggcctgtagtcccagctacttgggaggctgaggcaggagaatggcgtgaacccgggaggcggagcttgcagtgagccgagatagcgccactgcactccagcctgggcaacagagcaagactctgtctcaaaaaaacaccaacaacttggtttgaaacatgtatatataaatgtatatatttaaatatacattgtggctatacacctctaccttctctgtattacttatctatgtttatagctatttatatacatgtatatgtatgtgcatatatatacatatgcatatatatgtgtagagaatagaactgtagttactagcagcttggaagagtagagggtaatagggagagattggttaacagacgtaaaattttagctagagagcgggaataacttctagtgttctatagcacgttagggtgactgtagttaaaaataatttagtctatattttcaaatagctagaagagaggatttcgaacgttcccaacattaagagatgataaatgttccaagtgacagatatgctacttactctgatttgatcattacctattgtataagtgcactgaaatatcactttgtacaccctaaatgtgtacaattattataggtcaattacaagccaaaataaaaaaaccacacaaataactcataagaatacaatataacaattattcatatggcatgtatattgtattagtaatctggaaatggtttatagtatgagggaggatgtggataggttatatgcaaacactgggccgtttgacataagggatttgagcattcctggagtttcatatggagcagggtcctggaactaatcttctgcggataccaaaggataattgtataagaatcttggcagcaaaattgtggcagttcagaactataaaaaaaagtcaaagacaatgggaaaaaaagactcagtcaggtgtccttattctctgcttttgatggggcactgagacattgcctgtgaggatttgaggattgattatttccttgtgctaagtgttttcctgaactatgtgttttacctgaacattgaaaacctaccaccacatctgagggaagaactgttgttatttacctatctttcatgaggcaactgacacaagtagatattaactaacttgactgttagttgctgctactaaagggcagagatgattcagagtgaggcagctgcactccagggttccagctctcaaccgctgtgctgcactgcctcccaggaaatactgaagtgctaagcatggttgcgggtctacggatgatgcattacagtttatggacagaaaaataatcaaatgcttcatctgaagaaataaaggattaagaacaatagaacatagattcttcagaaactggatcatatgagtaaggtcacagaaaagtaaaaaagtaacattgttgagttttctgccttttcaataaattaatgactttaggaaatatctattagagatatataattttaaaatatacacacatatatatatataaacttttattcaggtatgttagagagaaccagtagagggagcttttagccgtaagtttactttctattgtgaaaggaattaatcaaataatgtgtgaagaaaaataaattctaaatatgattattatttacgtgatacttcaaagcatccaaaaaataaattaagaatgttatttttttcagttactttggaactcagttacaagacatatttttatttatagtaacaggcaaaatgtatttattgtgtacaacatgatgttttgatatatatgtacattgtgaaatgactaaatctggctaactattctatgcattacctcacatagttatcttttttgtagtgagaaaacttcacttcaactcagtatttttgaaggacctagtatattattaattatagtcaccatgttatacaatagaactcttgaatttataacttctgttaactgaaattttgtatcctttaatgaatacctcctcattccccaccagaaaccctagcccctggtaaccagcattttatttattttatttctatgggatgaactttcttagattccacatatgaatgagatggaacaggtataacgggttatgcataaagtgccttatgtacaggttatacataacgtaccttattatacgcttataacttatgtgtaacaagtataaggtgagatctcattgggttttaatttgcatttatctgataatcagtgatgatgaacatttttttcatatacctgttggccatttgtatgccttcttttgagaaatgcctattcagatattttgtcttttgtctttctgtgcctgatttattttacttaacataatgtccttcaggttcatccatgttactgcaaatgataacacttcgttcttttttaatgggtgaattgtattctattgtgtgtgtgcgtgcatatagatagatatacaaacacacataccacatttgctttatccattcatcctttgatagatgcttaagctgattcaatatcttagctattgtgaataatgctgcaataaacatgggagtgcagatatgttttcaaaatactgatttcacttcctttggaatatgcctagtagtgggatttctgtatcatatggtaattctattttcaatttgttgaggagcctccatcctgtttttcacaattgtactaatttatattcccacaaatagtgtgcatgggttctttttctccacatcctcaccaatacttacactttctcattttgataatagccattctaacaggtataaggtgatatctcattgggttttaatttgcatttatctgataatagtgatgttcaacattttttttcatatacctgttggctatttctatgctttcttttgagaaatgcctattcagatattttgcccatttttaaatcaggctattttattgttgctgttgacttgtttgagtaccttatgtattttgaatgttaaccttttatcagacatatagtttgcaaatagtgtcttccattcagtagattttctcttcgttttgtttattgttcctttacctctgcagaagcttttatgtttcatgcgttcccatttgtatatttttacttttgctgcctgtgcttttgatgtcatatctaaaaagttttattgccctgaccaatataaaaatgctttcttctatgtatttatctagtagtctcaaagttgtgggtcttagatttaagtatttaatccattttgagttgatttttgtatatggtgtgagatggggatgtaatttcatcatttcacatgtgaatattcaattttccaaacagctatcaggttctgggctcttctttgacggtagacattttattactgatttaatctccttacttgttattggtctgttaagattttctgttttttttttttcataattcactcttggtagatggtgtatatcaaggaattaatccagttaagctaggttatccaattttttggtgtataatttttcataatagtctttgatgatcctttgtatttctgttgcatcagttataacgtctcgtctctttgtttctgacttagtctttctctttctgcctttcttaggctaactaaagatttgttgattttgtttatctttctaaaaaaatcaactcttagttttgttgatcttttctatcacttttctagtctctattttattgatttctgccctggtccttattattttcatctttctactaactttggacttagtttgtttttgtttttcaagtttcttgaggtgcaatgttaggtcatttacttgagatcttcttttttgatataggcatttattgctataaaacttcttagaatggataaagtaattcttagaattgcttttgctctcccaggggttttggtattttgtgtttccattttcactggtctcaagaaattttttaaagttttcatgaacattttttcacagactcattgattgttcagaagcacgttctttaatttccatgcatttgtaaattttctgaagtttcccctgttcaatcaaactattgatttctagttttatattattatagtcataaaagatacttggtatcatttcaaaattctgattttttatgaattgtggcctaccatatgatctattttagagaatgaatatgcatagaataatgcttattctgtagttgttggatggaatgttatttatatgtctgttacatacatttgatctagaatgtagttcaagtgtaagtttctttgttttctgcctgggtgatctgtccattgctgtaaatgggttgtaaatctcctactattgttttattgcagtctatatctctttttaagtatattaatacttggtttgtatatttaggtgctccagttatgggtacatacgtatttacaattgttatatcctcttgctgaattaacccctttattattaaataatgacttatttttacctttttacagtttttgacttggagtccatttaatcttatataaatatagctacttctattctcttttggtttctacttgcatggaatatatttttctatttattcaatttcagtctatgtgtatttttacaggcaaagtgagtttcccatagacataccatttaaatcctgtgatatgaaaatttgcctttttgatgctgtcacataagtttcataagctttttttcagtccttgtcattctttatttttttcttctgactttatattttcaaataacctgtctgtaagttcacaaatattgttttctgcttgttcagtttttcttttgatgctctctattgtattgtttgtctttcattgtatttttcagctccaggatttctgtttttttttttaatttaatccctctaatgaatttctcatttttttacttattattattattgttttattttgttcacttctctgtattttttgaagttctccgagcttctttaaaatggttattttatattattttcaggcacttcatgtattgctatttctgtatgatgtcactggcaccttaaaatatctgtttggtgttgtcatgattctcattgttctgatctttgtacttctatgtcaaagcctgtgcatgggaagtcattgcttattccaatttttatagtcttgctttttctaggaaagccttgtggcaggcatagttctggggcgcatcagactcctgagccagtgttgaccagtgtagcactgccagaatcctgggtcctgctttagctggtacaatgctggggcatgccagaatccctggacagctgtgactggcatgacactgccaaaagcctggaacccactacagcaggctaggtgttgtgtttggctggaagcccacagcctctgagaattgcttgctcctgagggctacccaaagcctgggaccactgatgtcaatatggcagttgtgtaggccagagataaatttcactaagcaagcttaaagtgtgaggctatgtggtctcacctggtgagacctggtgtcctggtgggtctataggctcagtctgctggtactggttcggaatatggagctatgaggggtctgctggtgcagagttttcctgtgagtacccagtgttgtgtccaggaaaaatcctgtgctcacatccctttcattctatctagtggatggcatctctttccatactgtgctgcctggggttgggagaggggtgatgtgggtattgtaaaactgtgattcctaccctttcaatgtgtcttttcttattattgtactacaacgaggcactgtgatctctcacgtggtaaaaagatcctagcccttgtgacgttatttttgtgcatagatagctgttcagattgatgtttctgtgaagggatgcttgctggagagtcctactccactgtctggctcccacaaggcatttttgactgctcatctgttgctgtgctggatattatcatccacaggagaattgcaaagatgggtgcctagacacaacgagcttataattttgctggtaaaattgttagcttattagaaatgtattgtgaatgaaatttatacataatagtgtattggcaataagcttgacaaagaagataagcaaacaggagttagaaagaccagagcacagagaataatagctgttcccgaaaagacaaaggatatgaatttatggtgaagactgtgaagggaattttcgatgggaaaatattatgagcaacatggctgatttaggaatgggcatggagggtgaggaatcatatacatacaaccaaaataaaaggttaatatgaaggatataagacacagatttgaatattgcatgaggccgcaagtgctggcaaggagatgaaagtgatccagatggtagtaggaaataagaatacattctataatgagattgcagcaggaatggagagggtaccgaaggatggagctagaggataattaggaaatataaaaaattggaaggaaaaaaccctaacaagaggcaatagcaataatccaggcatgaagtgattaactttgttagatgtgatgtgctgtttttcaagccatataataaactctccttactgaacaaaacaataattatgtgctttcattctcttgcttctccttttagactgtgttaaaaaaaaaaaaagaaaatttaagctagttttggcagtgttccagtgagccagtttgtggcatttttgtccatctgcctttactttcatggtttactgattgcttattttgcagtcttttgtttattttatttatttcttcataaactaaataaataacatttatctaaagtatcagctggatataatggggatagatgtccagggtaattttccatcatacttaaagtcttctttaggagtacttttcacattccactgccaaccactgaccaccagtatgttcacctttagccttcagaactcacggaagaataggcaagattaatcggatcataaggatcatatagaaaacttataaaaatggtaagggtaaaaaatataaattggggtcttcaatgccagtccagagtgtaataatgaacaactgtaaagtttatgtatgaggtgataattttaagtcaactcttttgagagattagcatggggttgtccttagaacggactgaagagcggaagattagcagcagagagagaaatcagaaggctgtacaataggataagtatgaattgatttcagagggaatgaagaagatttaagtaggtaatgagagaagagtaaaaaatcaatgatttactagatgtaaagactggagaaaaaatgtcaaagatgactgatatacacagtttaaacgattagtactgtaatagatatattcgggaaacgagctagtatttagttgaaaattgtgtgtcatttttaggcacattgatttttggtactcacagttgatataggcatatgtacaaatattttaaagctatttctcatattctcatagattccataaagaagactaaaattctaaaggttgaatagccttcatttttttaaaaaaagtatagaactcattagaaattagatttttttcagaaaaatatttggctaaaaatagtgaaatctttttttttaattttattttagatgtctgcatcgaaaccctgataggtatttcatgctatttcttttctggaatgtgaaatccagtattaagtttgatacatcaatcagtatgctatccactctgacatagtgaaattgattagtaaaaaaacaatgcttgtgttgtagaattaaaatttcctttttcttattattatggagaacacatgtcagagtccataggaggtacaaacaggtattctatgacaagggacttgaaaaggtggtgtgtttgtgtcccttaaagttaaaccatcagtggacctaattagcataagttatagatgccttttttcctgaggttgacaccatggagttatttgtcagggatatttttcatccctggaatttgtctttgaatgcatcttattacaaactagtgattcgaccaaattatggatgtacatcatttgtgtttagctaaatagtcacttattgtgtaaagacattttttggaagctctagagtaattcactcttctatgcactcctgcctatgcagtgacttttttttttttaatgtgtcttaagtacttgcctgaaaatcataaccatgcacagtacaagtgtctgagtaaagttacacaaataatattgtaatatgacaatacacatccctcaattagtagcaccaagaataatgcccttgcagtagacctgacaatttcaaacaccatacaatagggaacagcatccaagacagccaaaccctctgtcatggcagaaacagaaacagcctgggaaatgttacctccatattcacttgtggtagtaatcataactgtttattgcttaaattagagagaaagtccaggaaaaaaatttcttatttagctgagtagttttctcattcaaaaatgcatttaactttaggccaggagtggtggctcatgcctgtaatggctcccagcactttgggaggctgaagcgggcagatcacttgaggtaaggagtttgagaccagccttgccaacatggtgaaactctgtcgctactaaaaaatacaaaaaatagccagatgtggttgcacgtccctgtaatcccagctaattgggaggctgaggcaggagaatcgctggaacctggggggaagaggttgcagtgaacagagatcgcactattgcactccagcctgggtgacaaagtgacactctgtctcaaaaaaaaaaaaaaaaaaaaaaaagcatttagatttaaataacatttaatgagaaaatgaacaacctggttaaatatcaaatgattaaacttacattagatgtatagaagctaccatcaaaattaagccttatttactgggatgatttcaaaggtttctattcttatgctgattattctgtgattatttaaaattggtagaaagatctgattctggctcactcacttctgcttcttccatttaattagcaagtatttgccaagtagttattatataattagcattgtgctagagtctttacgatgccaacatttcaaggagcaaattgcttctctcaatgtctgcattgcttgaaaatggagttgttaagtcaaaactcttaagctgccagtaactttctccctctgtttaatagtttaccaagacctccaatgttggaactatcttgcatgtcacaccaattaaataaaatgggtgaatattttcaaattcagtggtggtaaatgtttctagaggaacacagctgtgtgagtgggtgcaatagaactggatttgatatcaagtggccttctacaagtatgattttccacaaaaaaaacacaaagcttaagttaagccctgttattcctactttctctaccttcagatttgagtgataaagacaatagaataaaatatatcctctaagtagaatatttgcattatgtaagctaaaaagattggctttttaaaacaatcaagtggtgaatattcaactccctaatccaatcctttttctttcagaacaactttggaatttcaagatttcaaggttgtgtgctctagggctttgaaaggcagagtaactgaggataattctttgcaaaccataacaatattaatagaatcatcccatcatggttttagaaaacaacaacaaccaccaccaatccattactaaattttacacccaataacattattaaggaccaaaatggatttaagttttttcactttatttacaaacatctaatgctaggcacccagaattagtcctaattgtgctaggtattgctcctagagctttaaatttattatctcatttgatcctcacgataaccctataagtttggtatcattatcttttattgaagaaaagaagtctaaggcaaaggtaagttaaatgacttgcagaggatcacaaagtcagtgggtgattgaaccaagatataaacaaagacaagatataaacaaaggtatactgactttgccatcttaaaagtctgttaaggcggctgggcgcggtaatcccagcactttgggaggccaaggtgggtgtatcaggaggccaggagatcgagaccatcctggccaacatgatgaaaccccgtctctactaaaaatgcaaaaattagccaagcgtggtggtgcacacctgtaatcccagctactcaggaggctgagacaggagaatcgcttgaccctggaggtggagattgcagtaaactgagattgtgccactgtactccagcctggcgacagagcaagactccatctgaaaaaaaaaaaaaaaaagaggtctgttaagggtaacatttgccattggtagataaggtttcccttcacaaaagaagagaaactatggcatatgtgcagtctatgccttctgccacccactaaatagaaagggtgcatgtatcttggaagagactcgttaatcaaacagatgtgctttcaataatggtgaaatctcttcattaagcactggcagtaagtcattacaatatcttctctagccttttggctgtgatcaagggtagactatcttctcattaggataatggggttcaataaaagagtgttccatcgttctccaaaagggagtagagtggaactttttgttaactataatcatttagtgattcattttatcttttttagatcttgttaattcattgttgcacaaggttaatcctttatccacttaggctatggttttgacaaaatgtgttggtcataaaagttaacttcttaaaagacgttaaagacagtttcaatgaacatcagtaacataatgtgtggaaataagaaaagtattttgtttctatttgcttgcccagagtgatattaattaaagcatgatttatatattttaaatgaaataattgaggacatttttgacatatgttttcattttttgtggcaaacaagatcaggagaaaattataaatatttgagttaaacatgtatttggcagtaatattgtttgtgactaaggtcagtccttagtctcacaagattatattatcatgtaaaagttataacaataatagatccatcaaaaattggaaaatatgaaaatgagtctctccctttgagttttttaatgcaattttaccaatcaaatatgacaatgatgaataattttgcacatttacttttagtatcttccccctatgaaaatgcttgtattataaaattttacctactggtaattacagttaactcacaaacttccatcctgattatgcctacttaccattagatcaaaagcatttgccaatcatatccttttaaataatcatttgaatggttctgatatttcaatgataaaattctgtgatttagttttatgcttatagttggatatttgaattatcccagatgtttttgctattataggtaacctagcaacaaagaagttttttcctattatcttttttccatatttggggatatttctgtagaaaataatccccagaattgaatttattgaatcaaagagtataaagctcttgatacggagtccctgaattcttaaggaatatgtttaatccatctatgtagctctggaaactggcttactacctagtatgctcgttacttacatttttgaatgtgttaaacttttaagaaaacctattaaatgactactttatgtgcatggctatctgataataatcttttgtacttataatagattttcctaatatctaataaattttcacatacattatctgaccttatacctacaaaatacttgcaaggggcacaaggcagacattttgatcatcacttttcagagaaaaaataaaaaaggacctaagagagattaaggatatggcgtagaatttagtcttcttacctggaacagcagtggctccattacatcctatctctgtgtacatgtgctttactacggaaagaatttgaaataagttgattttgttttcttttcagtgaataattgcttttattcttaaggaggaaaaatgtctgtcagaatgattttgtctgttttatagtgaaaaatgcataccactccttaatcatcatcatacaatttttctaaatgttcagtgcaaacatcaatatatgttaaagcattattttatacgtttaaacagaaatgaaaggcaaagatcaaagtaacccattaaactctatttatggtacttaaaacattagttagggcatttttaaatgtactatgtgtgttatgtaagtgtgagctctgaattacaaagtaatttaaacaaatacggattcctaaaaatttctcccaggcaagtccttacatatagatcccctataatggtttaagataattatggactgaatatttcttagttttttaaatttagagcattgattgaacattgatgaaattttttcaactttaaaaatgtattttataatatctatccaatatgattgaatattaaattattcacgggatgaaactgcctgctataggcttaatgaacacaatgtacaaaatatactagttttccgtcttttctcctttttttaaaaatttttatttactttttgaatcaggaaatgatcaacctgatttcagagatgagaatattaaagcccagagagtaaagtagtttgtccagatctatgtggtgttttcttttcttttcttttcttttttttttttttttttttgagaaggcgtcttgctctgtcacccaggctggagtacagtggtcgaatctcagctcactgcaagctctgcttcccgggttcacgccattctcccgcctcagcctccggagtaactgggactacaggcgccagccaccacgcccagctaattttttgtatttttgttagagacggggtttcaccgtgttagccaggatggtctggatctcctgacctcatgatccgccctccttggcctcccaaagtgctgggattacaggcgtgacccaccgcgcccggccccaaatctatatggtttttaaggatctttgctggggattcaaagcctattttgttcacttcaaacctcagctcttctcgctgaacaaaaaggcaattaaaagaatgatgatagacaaagttgaaagttcactagtttataatttttaaaaatcctatgccaccatttttctttcagtagtttagacttaatacgtttttgaagattttaactcaatgtaatggaaaacatttataatatgatggaaacatttttaatgaagcttttcaacaaggagttcttaaaataaataaactttgtggtcaaacagagattaaatggctatctattaagaacactatggaatttctattcaaattgggtagcagactaaatgacttctaagatacaatcagtttgtgatttaattggttcttgaatggatctgcctctggcttgtagtctttatactgtaagcatttatacaacaagtctgcaattcaaccatttgactacaaattgccgtaagtttttggaaagctattaaagctcctctaatttttacaaaactctcttgctaaagttattgtgtagcgagggcataccatgtgtcaggtattatgaaagttttccttccttctttctctttgcaattgctctatctacctatttatctaaaatcacacacatatataacatatacatatatacataggtatacatgtacatggatacatgtatgcgtatgtgtatctttactaaatatgtatctatacatatatgtgtatgtatctatatgtatatgtatatatttgtatctatacatatatgtgtatgtgtatctttactaaacctaacagcagttttctaaagtaaacacttttattacctacactttgctagtgaacgtaaagaaagtgaaacaaattgccaaagattacataactggcaagtggcaaagctaggactcaatctcatggacaagtgacatctaagcctttattcttaactactagattatcttatgataatttaaacttgtgtgtatgttttatctttttgttaatcatcagagtcaatgatattcagcatcttctgcagtacagaccaaggaaaacaaagccaagctgtcttaggcagccaaaaaatgactatccatgcaaattaaatgtcactatgttttacaaatttgtctttactattagacatcaactaaagtagttcagaaaagagatgataaaaccctgaatgagtgaagctatagaggaaaatgtgaatgaaaaattaaaaagaaatactaagtttaaacaaatttaattgtggtagaaatttaaatatagaagatggatttcaggggttgtagtattaccacctcaatatttggaggatctgtttacatgtcttctcctaccactggcagaagagccttggggttagaactttttctgtcccttgttatcttctcagtatctcacctggaccaatgctatggcatgttttcaaagataacctagtagtggtgatgaaaggcacagtttcttcatgtttaaagatgagccatgggtttccttttatattttctcacatagactcccagatctgtgaggtcctggaatgtacaagtggttatcctcataaattagctaacaccagaattcatctagtagcatagagcaaaggattgctctgccaacatctgaacaatcaaatcctggcccaaacaagccaaattatctcaacatcaactcatattcttaccacatcctgatgttcctatgctgatattgcttgatcatacagattccattttgttctcctatttgagagtttgagaatctgcttctcttctctttccacccctacctcaccctcctcccttggaattagagattgaatgatctcggacatcttgataatctctcctctctgctctgtatgctcagctactcgtcttacaatcattaatttttaaaatttaactacatgagtgtgccatttgtttttcccacctccagggaaaagagatgaacttgactcatgattttgatcccatgattcatcctcagcccttgctgttggatgtggcggaacactcactagtcctttaataaagatcagatgctgtgtggatactggtgggcttcttgagcaggttgctattgcctacctagaagcatttgccgaggattttcttttcttttgtcgtcagtgctataatatgccacagtctttaaattgacctcagtagtgtctcattgaacttaatatttagttcatttttctgctgacttttgagaggtggcatggccagaaatgtatatagtgattgtatcttttctctttttgccttatgaaatttacttaactatatggcttactaaatatataactggagaaattaaatagcaaaaattttactactttttccatgaaaagttaagtgtttatgtagtaattaattgcttagtccagcttcctgagatataaaaataatgctgataggcattaacaggcgatatgattcactacttttactcattcattcaattttatattccaaagaacatgttttctaataagaggataattaaatgtttacaagtgttatcttggaagtaaatccaacaataatttataataataaaatggtgtttgggttatacatgtggcactgtctcaaagagtcttaatagcatgggaaaattagttttattgtgcagatatattaataaatttaaagataatcaggataacttttgaacatttacaaatgctcaaattcgagcatacaaatttgagtatacaaatttgagcatacacatttgagcatacaaatttgagcatacaaatttaattaaagtatttttacctttttgccaacctaacatccttacgtgagaatagcatataattacatatcactataaagagcacattgtaagttatttacatattgttagactgttagaatgttacctgctaaattggagtgggaactaaacacacatacacacccactgactgagtctggcacatttctgggtcttcctttccttacaggaattaaagttcttgactaagtgattcctaagtttttcccaagtataacatgggtatacatttatgtttctaattttaaagaggctactaaatcttacattttatcatgctctctaattcctcttttttttatttttaaattttactctaagttctgggatacatgtgcagaatgtgcaggtttgttacacagttatacatgtgccatggtggtttgctgcacccatcaatccgtcatgtaggttttaagccccacatgcgttaggtatttctcctaatgctctccctctccttgcccccaacccccgacaggccttggtgtatgttgttcccctcgctgtgtccttgtgttctcattgttcacctcccacttatgagtgacaacatgcagtgtttggttttcggttcttgtgttagtttgctgagaatgacggcttccagcttcatccatgtctcttcaaaggacatgagctcattcttttttaggcctgcataatattccatggtgtatatgtgccaccttttctttatgcagtctatcgttgatgggcatttctgttggttccaggtctttgttattgtaaatagtgctgcaataaacatacgtgtgcatgtgtctttatggtagaatgatttatcatcctttgggtacgtacccagtaatgggattgctgggtcaaatggtatttctgattctagatccttgaggaattgccacactgtcttccacagtgattgaactaatttacactcccaccaacggtgtaaatgcattcctatttttccacagccttgccagcatctattgttacctgactttttaataattgccattctgactggcatgaggtggcatctcattgtggttttgatttgcatttctctaatgatcagtgatgataagctttttttcctatgtttcttggccgcataaatgtcttattttgagaagtctctgttcatatcctttgcccacttgacggggttgttttttgcttttaatttgtttaagtttcttgtagattctggatattagacctttgtcagatgggtagattgcaaaaattttctcccattctataggttgctgattcactctgatgctagtttcttttgctgtgcagaagctctttagtttaattagatcctatttatcaattttggcttttgttgccattgcttttggtgttacagacataaagtctttgcccatgcctataacctgaatggtaatgtctagattttcttccagagtttttatagtttggggttttacatgaaagtctttaatccatcttgagttaatttttgtatgaggtgtaaggaaggggtccagtttcagttttcagcatatggctagccagttattctagcaccaaattcccaattagccaaaaattggtttaagtgattcataaatctcaagtaaatctggatgttaaaggttgaaccttaataataattacagagtaaatggaaagtgagtgaatctcactggacttgtttctttagagccaagggttgaggcagagttcatagagcctgacttttatggattcaagttgtgcaggattttctgaccaaagcttcatcctgtgatttcatcttggtcagttaaatctaaataaattctactgtcatttactaaaatatttagggcattgttatgcaatctaagattatttacactttaataaatacatgaaaattctaattgtatttattgtgtcaagttttccattgcaaacactgatttatttttttcagtcaaataataactcaggaaaaaaaatagaccaggtgaggtttccttacacattatccatgctaccatttatttaagaaacatattattgatcttttatgtttttgcaaattccatgtaattaaaaaaaaaatgtaagaatggtcaatatctgaacttgcttctgtgttttccatgatgacctatttatgttgcattatagaatttaaccaactgtgtatgaaagtttagatgatattaacatgtgagtcaataagaaaagaactgttatacagaaatattggaatgatttgactttcaatattctatactcaattgtatgcaagttagataaaatcatgttgaattttatctcatgtacgttaccaaagcaatacaaattccttagaagttatataagtaaaaatagatttatttttaaattatcctggaaaacattgtcttggtattcaaaccattttcacctgtgtttatcatcagaggtttccatcttttagaacatttatttaccagttctcttgtatttttctcagctgtctgtttgccatatggtgttactttcagaattctctgtaatactgagaggttgtgcttgtggtaacataggataaaattccatgcagacttgaatatttgaaatcttactatatgaagattcaacctatacgaaaatagaagcttaaccataatttataggtattatgttagaaaaatcccagctatttctacatctattttttattcttttgtggacatgtagatacattcttagcaggcagatctggcctaaggcaagctagtggtatagcaacattggctttcctgctttcaataagacacaagttttattccccctgaagtttaatgcctcatatcttaatattctcttttgattcccttaaggcaaccacccatgaaagttgcattcagactcttcattctcagaaggtatactcaaatgctatttcttccagagacattttaattctagtaggagtcaaactcgtaaagaaaatggttgaaactctgagacaaattgataggtagcatgtatagttaagcctgctataaacagtaaaagaagcaacataaggtagaacattttcccctccaaggagaaaaaatcatgtccgttaagtatattttgattcattttttattgtaatttttgttatccctggaaatagaacaaaaacatgtgtcagctgactaccattgaacctgtacacaccctgcttcagcttttatccaatgagaaataaaattaagtcatgtaggttgttagagtctctctctctctctctctgtctctctctctctctctctctctctttttaactgaacctggctgcaataataatactgaccttgactgtgacctctctgtgtgatagttccattgctgtgccttagagtcgaatggtatctctacagttttttcagaattcttgggtaaaaaatgtagcaggtgttgtcaggggttaggaaagagaggctatttattctttccctgtagttttggatggaaataaatactttttaggtgatctgtttctaagaagtgcagttttccggaaaccacacaccgtattctcaaaactattttcctgtttcttccttagcatttagtctaatcatctcaaagtaaaggattattcttaataaaagaaaatacggctgctcacattaaatttgcttcaagtccaggagaaaacctgcttcaaattttttaaagacatttttgcctccattgtatatggattattagcccaatttataagagtaagtgccagaatacagtctttggtggtattttagggtgatactctcctgcaatgggattgattttagaatttgtagggtatatactagttgaggatgtaattggaatttgtgcctgtaaacctataagctccaatcctaaaagacacatgtttattcattcaaaaatatatatctagcattggtgttgtcggttactttgctgggcataaaaactcagagatgaatcagacacagtagagaatgtctgcaatctataggaaattatattctgaacagggacggactcaaaagtgtatgtgtgaatatatgtgctcttttaaatccaagaaaaatattttccacatcaccaattgtgccactgaaaaataaattgttattggtatacagtggcatttgaagatattagaaaactcaaatcaaaaagggaacattgctctgccatgaataaatgatgtttatacttctctttgcaaactgctatgtcacctccaggataacttgtcaagtgcattttcatattatgtttcaaataacactacccaataagtggaacttagaaaaatgtatcagtgtgcatattcttatgttctgaataataagaaatgtgaaatgtcaagtgatgaactaatagcaaacaaataattcaaacctctctaggttagcttgcaacacagagtcagaaagtgcatcaagaaaatgtaacagtgtgcagaatgaatttgtaaactgatttattgacacattcaaatgatacagtgctatttataggacactgtactatagatgttcctgcagttactggagaagaaactcttgtcctgtggggtctacagtgactgccttgcttcaataacatatgtttatttgccatatcgttgtccattttctaaaatagaatatactttgtaaggattttcaataagtttatgaatatgaaacgaaagtggatgactgaaggaattttctaggcttcattagttgacatgcactctttttgagttaaataatatgatattctagaatctaaattgattttctatgaaaatagaaacaaaaataggaaaaaataatattttgatctactccgttggtttacatgaatgcctgcaaaaaataagtaattttgactacctacaaaattgtatttttgcacataccttatagtgtctcttgttttaactaagatgaatttatgataaaaacatgaaaaaaaatcaagtggttaactctaatttgtttattaagctatgttagtaaaagcaactaatactggcctatgactttccaatttaaaaagaattttgtgtcatttcattgaactctccattagcatagtggtatgcttgataacattatcttctgggcaaaattagttgtactactataagtacccatatcactttcttgcggcattgacatctctagtatagcacttgatagtatatggtaggtatcttttcatatcttttctagactctcaagtctcattaagcaaaagatgtttattatctgcgccagtcacacacttcccaaattcaatatatacacacgggcttcctattggtagtaagactttattaactttgattgagttattgtttcaccaaatcgaaaactgaggttccaagatgttaataaatgtacccaagaatgcatatgaatgagaagtagaccaaaatgcaaaggtaggtcctctaattctaaatatcagttctttctaaaatcttgatcttccaacctttcctgttcttagcgcatttgaaattataggtctacacagtataagaaacattattaaaatgaatacagacatattttaaatagtactaaacatttgtgttataacacgtatatatgtaatttttcagaactgcttcctatatacaggtcacagggcactgcctcgtggttatttctaatccaccccacagttcaataactcagaattgtaaaatgtgatcaaataaagtaatcatgatgccaaattcccttaaggatgcatcatttttaaaagtttcttaatatgaacatttcgagtcagtgatttagacagctttgaatatcaatttttcatgaaaaagaacaaatgcgatgacataagcagacagtgatccacttgtgttatgaaggtagcagtaaatgggtgacaatttcttgaaatccagatatgttcaaatgagcagagttggcagcgtgtcctaggcttttttgacaaaggaatgcagtgtcattatctattactttgatgatttatctacgtcacagtaactgcttcaaacctagaaaaaggtaaaggggcaaaaagaattatttttcattgttctgctatgaatccatatcagcatttaggggtttgttttataatgttccttaaataagtttaatttctttacataagcaagtgataattaagtaagcacttttttgatagtaaggaataagctcacttttaaaattctgttctctcacaaacatttcatgacattatagaatccagaaatgtcagctataaaagagatcccaaggatgatgttcatttctcctgctttacaaatggagaaactgagattccacatgaatatgtcacttgatcaagagagttgacaactaaatggaaattagaacttaagttttctaaattcaggttcagaggccggcttcagtaaaaatataggtgttgggaaaatagtacagtgatttccatgagattgcagccatctcttcattattatggtcatgaatatacatatctcatttatttttcactgctatggctctatttcttatttcaaaatgtaaaaacagcaacttttctcatctcttggtggctatatgaacttcagcaatacagaattcagtggattgggccttctccatttcctatttacttctgattacattgttttctcatgatgcattttgttttcccatctggaattcattctctgggaatctcctctctgagaaagcttcaaaaccaaacagtgtttattttttgtaatgacattgcttgcactttcattctgtaatatctccattcagaaatctttaattgttcccaattcctttctagatgagatcgcaaattctctgcttagctttcaaggatcagcacactttcaatcactttttcttaacacttcccaaaacccacctggcgtattaatcaaactgactttttgtagcctctgattagtttcatttctgtacctttgcttgtttctgttttccttttttcctgcccacaaaagatgtaagatctcctttaaattgtgaaaatctctagattgtagtgcttctcttctcatgcactcctggctgtgtgaacataaaacatggaagaggttatcccaggtgtggtgctcaactgtctgggtgaggctttgatctcctgagttctggtctctgtttgccgctgtattggtgattttcatgctgctgataaagtcataccagagactgggcaatttacagaagtaagaactttaatggactcacagttccacgtggctggggaggctttgcaatcatggcagaaggtgaaaggcacatctcacatggtggcaggcaagagaagagagcttgtgcagggaaactctcctttctaaaaccatcagatcttgtgatagttattatgatcaaaagaataatgcgggaaagacccaccccatgattcaactactttccacagggtccctcccacaacaagtggaaattgtgagagttaaaattcaaaatgagatttgggtggggacacagcgaaatcatatcaccgcctacacctgacttcctttctgattcttctttcctgattagaactttcaggacttgaatctctcctctccttccctttttaagaccagagttaagcttcaacttgcttatttcaaaaacctcctactgagaagcactatcaatttgctacttatcactggtgatgatggcaaaatgatccaatcaattttcttccttcagttccatctaaaatgagtgcacacccacatatatgtgttgaaatgacttactttttgttttcttttggattggtatagtttttttatttttcataaaatctgtctgaaaacaattttatttagaaattaaacattatcaatactatatgtcaaggcaagcaactttctttggaatataatatatcctagaaatcaatgcaacatatttttacgtttagattacccccagatgcccagagcatttctttactggtgaaatacagaattcttggacttgacactgagaggaagtgtcagcagtgatctaaaaagtatttcttcttaaaataagggaaatgtgtgtgcttaaagacagagacattagaaaggggaggatgaacagattatattttttaaaaaatggttaggccgggcacggtggctcacgcctgtaatcccaacactttgggaggccgagatgggcagatcgccaggtcagagatcaagaccatcctggccaacatggtgaaaccccatctctactaaaaatacaaaaaaaattagctaggtgtggtggcacatgcctgtaatcccagctactcaggaggccgaggcaggagaatagcttgaacctgggagtcagaggagctgagatcacgccacagcactccatcctggcaacacagtgagactgtcaaaaaaaaaaaaaaaaaaaaaaaaaaaaaaggtgggtggggtggggtggggtgtgagagcaaggtccctcagaagttataaatggatgggcattagtgcatagctatctttattttccaggttaccccttatggaaaaaggttcgcagttaccataacaccaattaataaagccatatttgctggaaaaatcttattcaacagcaaagtatcacagtaagagaaaggacgtttagtaatttaatatataaaaataaaccttcggtagttttgcctgaaagaaggccagtaagtatcttaaacatcttagggagcttttacaagtgctgtagcccttgctttctgttttctagttaagcaaactttattgctttcaccaatgagttacagaatctatgactggtaattttagtcaaaaacatgagttcaattagatgtgaagatacaatcttggcatatgttcttaaatgagccaaacctcctattttaataaataaggtaaatgagcccaaatccatattttatggccattgctcagtgaatgactacacacactattcagtcacccacataagaaatcagtaatttttgtcattcttcttcctattacttctcacatctggttgaaaaacaaattcagtcaccttctaaaatatctttcaccactttcttctcttgtcattccactgccactgccttcattcacctctgtatcatctccaatttacctttttttttttttttttttttttttttttttttgagacagggtctggctctgttgcccaagctggaatgcagtggcataatctcgactcattacaacatctgcctcctgggttcaagccatcctcccaccttagcctcctaagtagctggcactacaggcacacaccatcacgcctggctaatttttgtattttttgtagagatgggttttcaccatgatgcccaggctggtctcaaactcctgagctcaagctatctgcctgacttgtcctcccaaagtgctgtgattacaggtgtgagccaccacacctggagactactaatttatactggtgtataatagtgtccaagtttctagaacattcgtccaataatggctgtaccacccagatatcaatgttttgtttcttctaaaatatagatataaccatatcatataactacactcaatgaaggagccgtttcagtggtttctcaaggcctacagaatataattcacatttactgcatgacatttactaacctgtgaagtcttgaatcaaagatacctagattcaaacataataggtatccaatacagatttgttgatagaaaaatgagagtatgccaaacagggtcaaatgaataagattattcagtttgccctcggcattcctttttgctcatctgttctgtagattcaatgatcgccaccttccatacatccactgtgcattcattctgacactggtcactgtcccatatgccaagaatacagaagcaaacaacacaacccttacgtccaccctaatagggttaataactcatagtagagtcagatattaaacaagttaatacgcagatgaatgcagaattactaattgtcataattgctggaaggaaggaaggaaggaaggaaggaaggaaggaaggaaggaaggaaggaaaataggaaagtgtgttccctgaaaagagagggaagcagactaaatttagtgtaagtgatggtgaactcagggaagcacttgcctcctgagatttgatgtaggacatgatcatttatccaagagaaaatgtgaagaagagcactttaggcagcgagaacaagtgtgtttgttctgttgttgttgctgtttttaagtttgtttgtttttgtctctttcttgaagatgctatacattcccatatttacactttattgtgatattgactctgttgcctggagtgctcttctctgtcattttatgtgtagtgaaattgttcttatcataccatctttttttttaaatattaaaactgtccttaccccttcaggcagaacttaccttgcctcctccctttgttcactcctttcaattgcgattatcccattgcttatagctaactgggtaatttatttttctctagaagacaagccttctagaaggggatacaacttctttattcaatggtaggtcctccgtgttattgaagacatgaggagaaatgaattcagattactgggagacaaaggggaatatttttcaaatcgccacttcaaaggatagtatgcgactcaaaatctaaatatatttaagaaagatatagttaattaatgccagattaacagaaattaaaataaatgaatattattttaacatagatccttacattgtttaagataaattcatacccaggggactaaatattctccaacttattttccttgttcattagagacaaaaagttgatttggattacttagaattaaaacctgttgtgagagcccttatatagaaattttaatagaatcatgtctagatagaaaataacacagtttacattaaacgtctactttcattacagcatacttggcaaaatatcacattttgtcttgttgtgggcttccattctttgaatgttactgaagcccagttcctaagaatccctggccaggtgtggtggctcacacctgtaatcccagcactttgggaggccgaggcgggaggatgacaaagtcaagagtttgagaccagcctggccaacatggtgaaaccctgtctctactaagaatacaaaaattagccggacgtggtggcacatgactgtaatcccagctacttgggaggctgaggcaggagaattgcttgaacccaggaaacagaggttgcagtgagctgagatcgtgccagtacactccagcctgagtgacagaacaagactccatctagggaaaacaaaaaacaaacaaaaaaagaatccctgtagtagtctgttctcacactgctaacagagacatgcctgtgcctgggtaactcataaagcaaaaagatttaatgggctcacagttccacgtggctggggaggcctcataatcatggtggaaggcagaggaggagcaaagtcatgtcttacatggtggcaggcaaggtagcatgtacaggggaactcccctttataaaacctgcagatttcatgagacttatttactatcataagaacagcacaggaaagacctgcccccatgattcaattacctccaactgggtccctcccatgacatgtgggaattatgggagctacaattcagatgcgatttgggtggggacactgctaaaccatatcaatcccctacaaagcccacaacatgtgggaattatgggagctacaattcagatgcgatttgggttgggacactgctaaaccatatcgatcccctacaaagcccagcaaagttggcttccatcccagtcttctgcagtctctctggccactttccgtcctgtttacctcatgcttctgctccatcctcactggcctcctaggacctctgaacatacccaccttgttcctgctccgagccttttgactggggtttgttgtgctagaattactactccacagatatcagataaccctatggcttgttctctcttttccattaagttctgctaaaaatgataccttatcagtaaggccttctgaaacctctaatttcaaggatgcttatccattcacccatactcctcatcttcctgtcatgccctattttccctataattaacaccatctgaaatactgtgtattttttttattatttactataatatgaaactctaggttgttcactgttgtcccccaactgtaggcactctataaattgtcattgaaggaaatgcatattaactttgcactcagcgtcactgggtagttaatactatttttcaaatgttataaaatcaatatatgttaattgaagaacatttccaagctgtagaaaatagaagaaaatgaaagtcaacaattatctagcaatcagtacagtaccatgattgacattttggtttacatattctttcagtcatttctttacctataaatatctatttcataaaatgaagatcatattataaatactgttttatagactacttttttagcctatcatgccataaacatttgtcaattgattaaggatttttctacagcttcacccttactggctctatagcgctccatttttcactctgtacctcttgattgcatggcctaatctgaagttacttaagccaagtacactgggaaaatgcttacctacagcacttagttatttaaagctaagtgggttaagtagtctaggaaatagacttggttttcagtaagtacattgcttattgctaaatgctaactttcagttaaccagttaatgaaaccagagggtcaaaaattgcaacatttaccagtggaccaataaattacaattcaaatgagcccagcccttaggaagattgtcaatcaaagctttaagagtactcaagttcatttagtcatattgtgattgaccttgacggtcttcagattattggtttattaaaagttctaggtagctcgaccttcttacgagactgtagaatttgagttaaaaaaagaaaagtctactgtcaccactgtgttagagattaaaacctctgcctagctcctgggtggtgattcagtttttgaatactatttccttttgttgcatgaagttataaaattaaaacttcaatttgttttccagattacagctagggtaaaaattgttttttattattttgtgttgtagagtttttttttttcttttaaattagaagatcaagttcgaggagtcaaaagcttaatttaaaaaaaaagcctcacaaatctatttcatttctagtacattacagttcagtagataatttgaaactgattcatctgttataccatctgttggaaatatgctacagctgttaaatgtccagcaaaatttgaactacttctcgaagtaatttgcccttggtacatgcagaccagacaattttttatttgatttacaaccaagatttctccaaacatgaccgattttctagctatactacttttatttcattattatttttaaacatagctattagacaaaccaaaatagaaaatgaaagaaatctgaactaatttttaagattaaaaataatgaatttattcattgccataagctattaaaattgcattgattgtgttcaatatttttcaaaatatatgaagacttcctatggtgtgccctacattctgcatattgggaaagaaaagaagttcccttcctcagaagaggattattggcagagaaatcaacatataaaccaatattgatcataatagattttcaatgatacagaatgaaaatattatattaggaacaccaaagtcttatgttctttttaagactaaaagtagatgtaaaagagctaactgacagtagtcaatagtttcaagtctcaaaaaactcatttgctggagccaagatatttaaaaagtcctaaagtcatgtactgtactgatgagttagacaaaccctctatataattcaggggttccaaattacaagtcattttaagttgttgaagatcagagatgatatttcttatgtgggatacagtgaagtagatctatgtgtaagatcatgggatgaagccatttctcttttgcaatgcagattttaaaatggaaaatacaaaaatacatcttagaagctaaacagatgaagtgaatacatctcaatagtcaaaactaggaagcactttgccttgcttgcttttagatggatttatttcttatcattgtcagtaattcattgattcaacagctctctgcaaggttgtgttatgctgcatgacagattttgaggctctgggaatagagagtggacacatcaggcacctgccttcctctcatggtatttacagtccattcaacaagaaaagtaataaagaaattaaaaacaaaccagataatttcagattgtggtgagtgctgtgaaacaaaacaagacagtgtgatagaatagtaagcaatgtctcaatgaagacagaaattgagttggttaatttagatgaactgatcagaaaaagtgaaggtagtatttgcgtcagaatcagagtggaaaggaaccagctcttttaaacctggtagagagaattttagctggacagcggagaggatggaaaggcctttgagcaagggtgtgcttggtgtgtatgagagagagaggagagtgaatctagagcttagtgacccagagaaggagtgaaataaaatagcgccagagatatcttcagggccagaccatcttgggcccagtggagcttcgattttatactaaataagaggggaagccatcaggaagccttcagggcatggcaaaatctgatgcccagttttaaaaaatccatctggcaactgtgaagaaaatggattgtaaggagataaagatcgaagcaggaaataagtgcccaataaatatttattgaatgaataaatgaaataaagttgatgtcttttgctgaggctattcaatgtaggcatatccattaaattgctgattatatatgggtttctctgagaacatctatttaaaactgcagaaacctctttcagttaaaagatgtgggtctgatttggcacacaaaatattgaaattcctgcaatattattatatagggtaacatttcatgtaaattcttagaatcaaaatgagaggtggtgagaacaatttgacaatttcaatattattaggtctgtgtagcccagtgcaacatatatgattttacctgaagtcactatagaaaccatttgtcccagaaaactagacttcaaaagcacaggccttagaatcaggtacaatttggcctttgtcctgactttaatatcctttagctgtgagatctgaagcctcctcatctataaaatggtaatactacccatctcaatgggttactgtgataactcaatgagatgacccactcaaaatatttacttggctatcacgtaagtgttcaataaatgattgctattactatcaattgattcgttgattgtggtttaatgatctctgccatctgtatattcatcaaggtccaaattggaaggattgagatgggaggtgggaaggctgcctcattcgggctcacccctataacactgggctttgtctcattaaatggaaaatgaaataaaagagtaaattaggtcacctccatctagtaggaaacaagagagatatagtaaaaagaaaaaaggaaggcagatgaatttattgtattcacttagcaattttcgctgtgtgtcagataagttatgtccaatcagttgatttcattccaattccattatctttagctttttcctaaattagcaattgatgacaaactaattgtacttctcttcatggtccttctgtttgataagttcttttgtgaacttatttgtagactctatgagaaaataattaattctcaatgcaattttatgacctgttttagcaatgacctagcactctagtattttctgtgcaaagttagttgcttctgccatgcagagcctaatataaataataaaagatctctaatataaaatgaaatacataaaatgaggctatatttgtatgggaatttctatgatagatcagtaagtgaaaaggtatgttaaagaccagattgtaaatgttttttgtttgtttatttgcgtgcatatctaaatatctgttacgttaaatgttgcatctgtgtatatgtactatgaagagtaataatagcaatgacttctatggattattagggttctttctttaactgtattgtatgaaattctacaggagcaagagaaagatgtatcttattttcaatagcaaagagtagtccagggaagctggagcaagagatacacaaaagcaatgtatgaaccataaaaatgggaggaaaatatggtataagtgaagatatataagctagattgagtagtagtcaatgagttctttgccctaagaaggagcatacatttttatagcatacttctataactctgaatgtttaaccatttattttatgttgttatgatttaaaaatctagaacgactgggtcaaaacaggaaaaggacttttgaaataatggaaaaactaaggaaactgtgggtaagacaggattaaacaagctgccccaatttatgttgctaggaataaaatctaaatattttgactctaaggagcatgctgctacctctgaaagtcacgcctttcaccaaaaagtattaattatacaaagttaagttaaacttgaccctcaactatgtctaaaaattattataaaaattggaagagaatatcatattctgtttcctgtactttccacatattattaaagaaaaatgtgatatgtgaaaattagaaaatgtaaaatataaattaaatttagacaaaatttggcttgcagacatcaggagtaatttaagaagctctggccaaacctcccaacaaacttgccttctgcttcccatcctgccttgttccttatgactaaaactatcttgaattacaagctgaacgaaaagctcttctatggcttcccaagcagcacagcagttcctcaagaggtcttttgtcttcccccgatgtccatttcagggtctggtgtcccaactcagtgctccaggactgcaccttgccttctgctcctgagtgtcccgatgttgtgtgcccccccacatttctgaccatcattagttattgcattaactaatgaccctgaaatggacatcagggggtagataaaagacctcttggaggaactgctgtgctactgatgatggaaaggaatagtcataacacgtgatgcagggtaaatgtgcaggtataggtagagtagctcgaacttcaaaaggcagaagttgaatgtacacgtaagaccacagagtgatgtgttcaactcagaatgtgccttttgccatggaatttttcctaatataaaagtgaggatgttattgctagaatttctgttcagctagcactgtctcattcttgagtcatttgttgtttttagttgttttcctccattaggcttatgttaccaaatgggtcatataaaacatctatttgaagtgttatagtttaaacatatattgttttgtgaaacattttcagacattatatttcagcagagatgcatttgaaaaccatacttttgtgtcaattacgtatattctgaagtcctttaatcttgtaaactcctgccagtatcccttgccaatagccaaacctctcagccgtatcttttaggtaaagggcaacagctatttcatgtctatttgccaataatttcctctgctccagcttgagttagtacaggattcatatagctagtctgccttcatgattgactgaaattgtgtgaaaataaaactcaaggcccatctgcttttctaattttcatccaagattccctggaagggaagtacgctggagaccaaatatttgccattgctgtgtatggctgtagttttggaagacatcccagtatgggaaaacacaatactggattatttcaaatgttagttctctttttctttcgctccttccctcctttactattatataaaaattctaaatttctccagggatttgactgatttcctagtatttaatgtctgcaggagattgagatacatgttttagtacaacaaaaaagcagactttttagaatgcataatgagtgataaccattattacagttggaaataaaaatggatagtatattgtaatagtcagtatggcaatatgtgcttgcatggagtgctgctacaaccatctctgggaaatttcaaattcattgtgggctctttcatgttgcttgaggtgttccctctttctaaaatttcctttctacctatctgtagtctctaatttcttcagattctattcattaattatatggcatctgacactctaatcattaatcattctgattcctaagttccttcatatttgttatactggataagaggtttggaaactcactctgtaaaagctcagatagtaaatagtttagtttcgtgggccatatgatatccattgcaatattctactgctgtgtgaaagccatcagagacaatacataaatgcatgatgtgtaactgtgctccaataaaactttacttacaaaagcaatctgtgggctgggttgggcctgcaggccatagttttctaactcttggtggttaacactattttggggttttcagagcttgagagaaacttaaacttcctcatattacttgtgtatcacctgtaggaaaggggttcattgacatattcagggtcacacgtttatgatggagccaggtctaatgagcaactcaactaacaacaaccctacatttctaatttatttgtggctttttgtatttgattttattctatttagcattgaattttaaaccatttttattactcttttgttgcttcatgtttaattactttttgtggattcatttattactgccacttatggaggaatatgccatatctttgtatgtatgtgtgtgtgtgcatatatacaaatggaatgtagcgaaatggaattatatatatatatgtgtgtgtatacacacacacacacacacacacacacacacacatatacatataatctgcctgaagtagtgaaaacagcaaaatgcagtgtaagatctcaataaataatcgtgattaatgtcctccagggaaaaatatagtaattgttgcattttttagcttataatatgattatagattatgttttaatttggaagaatgtgagattgctggtgctttacattctgataataattttgcagtcacctttaaaaaaaattgcttattggccctgatctttactaagctcaatttaattctaattattgttattctgaataattatataattttttcaaattattactttaatttttaaatttttaaaaattgatttgattttttaaattagtaaaaaatgtaaaatttggtactcagatgatgaattagttacagaagccaatttgtttaatgtaataactctaaactatattatggttttataaatgctacatataaattctaaatttaaattagctattggatcatttaatcagttatcaacttagtttaattacattcaacgcaaccatatctatccattggatattcactcttagaaaatgtgtcatgcattattatcaagtatgagctagcctgattgagcaggtatggactagaaaaatttctcctagcatgatcctgcagatttataacgtggctttcttcctcattttcttcatatttctactcaaatgctacctgatcattttgtcaaaactttccttgagaaggcagcataaaatagcaattctcttcctctccacctcacccccaaactccctgcccactgtttcatatttaatgttccttcttagtattaattaccatagcatactataaatttacattttttcgttggcatgtttcttcccacaaaaacataagctctacaagggcagggcattgttaatttcaccttcagctgcacttcagtgcttggcagttgatgcatatttaaatgaatgaaatgaacatgagtgaatgttagcacatttctaatataacgggaacattagaaggaatgtttactccaattaaaggcaacacttatctcaaaaattataaaaagttataatcaaatgtatcagaaagtaggaaaatcaaggatgtatgtttgtgctcacagctaaacagaagtagatgttttcgattaatatgaaacccattactttagatgatagctttgtgaattgatacttttaaaacaaattttaagttcttttcattcttttacatttaactttctggggaacttatttatacacacatgccatatttcacagaggcacgcagtataactaagaaaaataagcaattttacaaatattatatgaagacggatttgttgattttaatttccaatttgtatacaattgagtggtgagataataaataataattcatttctccagtatcattggggacttaagtgaatttacaagaaaattagtttattctttctgttgctaaaatattttttgcttataaatttgagagagaaacatttttgaatatatagagaaacattttctgttttattaaacagagttctgagcataaacatttgtggggaatttaagaccactactctaaaaattaagtgttgtggcatgttataatatgagatcttgcttccagactctttgaggttcattgggtttagtacattcattcatttatcctacaaatgtttttagagtacgtgccaagtaccattgttcagatcactggagagtaagcattaggccaactaaaacttcatttcagatagagctttctatctagtgggagagaaagacaacaaaacaattaaatgagtaacaacataacatatatgtattatgacagaaaatcaagcaggatgtggatacagagactgatggcaacaaaatgctgggtgaactagcaaaccctgtcctcagtggcaaaggtcacattgagcagagacctgtgacaagagaggatacttggagtagtagttgcaaaggcttacagcaggggtaggattgtttttaaaggaagaggaggggccaggtgcggtggctcacacctttaatcccagcactttgggaggccgaggcgagcagatcacgaggtcaggagatctagaccatcctggctaacatggtgaaaccccgtctctactgaaaatacaaaaaaaaaaaaaaaaaatagctgtacttggtggcacacgcctgtaatcccagctactcaggaggctgaggcaggtgaatcgcttgaacccgggagacagaggttgcagtgagccgagctggcgccactgcactccagcctgggcaacagagtgacactcggtctcaaataaaaataaaaaagaaaaaagaggaaaggggccatggtggctagacaggaatagacaagaacatggggaaagagataagactagtgttgtggccatcataggccactgggtggcggggtagcaggggttgggcaggggtactttgaacagtaggccaagttgagagcaggagccagagagcattttgagtacagcagccacaagttcacttacagtttgaaaagtgtttcttcagctgctgccggcaaaactatagcagagtgagaggggaagcagggagaccacacagtcttttgtaacagtgatctctggaagctgtatgtgccctatctgtagctatggagttgaagtgaggcagtaggatttggaacatcccagtatcagaagacttagccctccatgccatttcccagagacccagagagggacggtagactcagaacagtcctggccacgttaacattagaagcacttaggcgttggcaaaatgagaaagatccatcaaaggaatcagagagcaagcagctaatgagaaaaaagagaaaaaaaaatcttaatgacattataaaagccaagtgcagaaagtgttacaaatagaattgaggtattgcctggtttcagtgcagttgattggttgagcatgatgggaactgattaatttttctgtcagtaataattttcaagttgatggttattctgtctttacttgctgatgtctagttctttctttctttgatttttgagacggagttttgctgttgttgcccaggctggagtgcagtggcacgatcttggctcaccgcaacctctgcctgccaggttcaagcaattctcctgcctcagcctcccgaatacctgggatcacaggcatgcaccaccatgaccggttaatttatcatttttagtagagatggggtttctcctgttggtcaggctggtcttgaactcccgacctcaggtgatcaacccgccttggcctcccaaagtgctgggattacaggcatgagtcaccactcccagcctcttttttctattctagtgagaacatgtaacatgagatctgccttgataagtgtgcaatatcatctagaggtataatatttcacaccagatctccagaacttagtcatctcacataactgaaattttatacgtgttggttagcaactccccatttcttggtcttttggctttggtaggagtcctctttgtctttcctcctccaacattagtaattctagttccctgttcctataatgtataaatacctgaagatttccaggagatgccagataccaaagcttattacaggaacaagctcaattttactcatgattctcagatagcaagactgaggtgaagtcctttggagtaatgtgctttgctatggttttccatttgaatatcagggttatataaacagctcctgtgttatattatatttaggataacagaattgcctaaattcctttgctaaatattgtttcaaagatacataaaagacatatcagattcaatgattttttaaccaacacataccaatcgttatttcgaaatcgttgttgagtgtctctctccctctctgtcttttgttttcagaaaaatgtgatgagccacttgtctctggactcccccatgtggctttcagcagctcctcctccatctctggtagctattctcccggctatgccaagataaacaagagaggaggtaagccaaattttgattcttttatcaataaacatgttaaataagaacatgttatatttatagccatatatatatataatcacacaacagatgttggcagacaccagaaatcactcctgccacttctattaaaagatccatagatgccattaacctctcatgtaatctccacattgaaataacataggaaaacttaggctggaagttagagatagtacgtcaaaaaggaagacattttgaagttgcctgggataataaagtcaaaatggcataaacgtttagagttaaaattcctattaatcagaaaatcatttagaaagatgtaaaaaagaattgactcccaaaatgcgtacggtgtattaaaaaaagcactttgtatttactgtatattaatgtaaaaagttagttcctattgaaaatgcaaatgccccttgtaatttttcctccggtacccagaatgtagctctattataaaatctgtgtaaaaaatcgttagatgtgtgcaactacaatgtgagttcttgaccttaaatcatggtatttgttagtaactggcagtttcaaattttctagcaattcactgagagtaaaagaacataattaaggacagaggcaaaaaactcttttgcttcaaaggaacactggtacaaacatcagtgaatggcaacttaaaaaggaaagaaacaatattatctcagataaatatgaatcaacaaacagagaccatgatgtttaattcagtaaaacaggaatggtggtggttgacaggggcttcggtggagagggagaaaaaattgagatatctgttaaaaggtacaaagttttagttagacaagatgaataagttttggatatctattgtgtagcatggtgactatagttaataatatgttgcatccttgaaaattgctaaagtaacagcttttaagtggcctcaccatttatgaaaaataactgtgttgtgatggatatgttaattatcttgagttaattatttcacaatacatatgtcaaaacaccatgttgtatactataaatatataaattttttgtgactgcaccttaatacagctaaaggaaaataagaaatgtgaaatcataaaacaatctagaatcaaccaattctataaataaaaaaatgaaagggaatgaatataggaggaagtaagaaagggaagaagggagggaaggagaaagggagggagggagagaggaaggaagaaaggaaggaaggaaggaaggaaacaaagatgaaaaaagaaagcaggaggaaacccaaaagaagaacaagaagaagaaaataaagagagggagaaaaaatattgtatcagaaaagaaaggcatatcagatttagaaagaccaaaaaagagaagaaaatagataggaaaaagctagcctagtgtatacagaataatatataaggtattcacagatctatgaagaggtctcagtcagtaaaaagacttggtgaaagagtgatacacaagcaaaggtagaggaacataacaaaaatgcagttttaatgtaatattagtataaattagctcatttttataacctgatattcatcaggctatggacatgagagagttgttgagttactataagttatcaaaaattctgcataaagatgttgaagtaatataaattttaatatatttctctctcataaaagtcattgaaaacaactaaaacaatgaatatagacagaaaaacatgaaacaagggactggccatacccaaatggtaattatgatacagaccttcccattactaggaaatctaggacaaaatatgaaaaagaaataccatataattctaggtcccaagagagtgtactgttccctaaaagaagtgccataatgccgagagacataaagcacctgtgaggaatggaagcagagtcagaaaatgttactttcaaaagttttgagtgaaaatacgactgaagaagatgatttgctcagtaaatttgggcaagtcaggttctgtcatgcaaacagcacttcaggaatacaaatgagacaatctagtcaccaatgagaaaattgaaagtgcacaataaagaaattgtggccacatgactggtgttgagcaaggaacccatttccatataagacctcgactaaacgatgtaggagctatagttgtaggagagagtataaatgttataggcacagaaatgtaaaagtgtcaattatgggaattagagagatgtgggtgttttttcttcctaacctttcagagcagcaggttaccagatgctgaaactttaggtacaaatttattctgcctttggttttttaatgggaattaacatcttttacaagaaaaaatatataggttttttgctctcatttaattctagaaaagttaaattattttttctttgttttaacataatacaagataccactttacaccatttagagctgcttatgtatttatctactcatacagagagagtcaggtatctgatattaagcttccaaagtgttaatatatttcttaacttggacacttggatttgaggagtatctttactttccttatagtagttttgtctgtagtttgtagaatatatatttatatctacctagatgattgacaggtaggtaggtaggtagatagagagaaatagaatgcatttccagaaagacagatgtttcaaaagcaaaaaaactataaaacaaaagttacagtttcttaactgtgtgacccacagttcatctctttttgaccattgatatactggattgtcatacattagggtgaaattatcacgttgggaaagaaagtgttgtctgtcctatagatatagatctacacttcattgtagcccattttatcatttgttatgtggggatgtgcagctacgtactttttggcttctaaagactgctttgcttatcagcgttatgctgtccataatgacatataactcgccctccccaacgctctcatttttgctccctaatttttacggatggtgaggtaactaagctatatcttcaccctttatgctgctctgcccctgcaggtacagcaagaaacatacatgtagggcttcacccttgttggccacgtaaatgtgggtcaagggaactagcatgagaaagaaaggttatatcctctccaaggaaaaacaaaaagaaagtcatacatagttgttacaatacaaaactttttttttttttttaagacagggtcttgctctgttgcctgggctggagtgcagtggcatgatctcagctcactacaagctccacctcctgggttcaagtgattcttctgcctcagccacacaagtagctgggattacaggagagtgcccaccatgcctggctgatttttgcattttttaatagaaatggggttttgccatgttggccaggttggacaacaaaatattttcttccactctaaaatttatatgcaaatgcccttgggagaagagccatgtagggtgaaattcttgaaaacatatatgtggctaatagccagcattgagagaaaagagatttttttttttaagtatagcatgatgttatatatctggaagatataaagaagacagacaattccaagcagaaaaaatatatgaacattatagaatccaggaatgttggagatacattttcttaatttacaagtggcaagagtcatctgatacagacactatataagtatctgaaagtgagaagatcatatactaacagaaaaatatcagaatgtaacctactaattatacaaatgcagaaaagaacaaattcagttgagcattatgttgataaacattggcttcaagttttattatttacttaaatgatattcctaaagtacattttggagagaaagtttataaatacataggaaagcaccatataaatgcatatattcaaatgacagattgtcacatatttatgaaattgaatttagtttatggttctccacaatacaaatccatctgctataatcttgatgtcagggaccagtacatggcaaaagtatggaggaaatgagatgtttaaatgaaaaatccatgcgtaattctgacatgtcttttggagctcattgtttttagtttattggtgctgttgttttcttatcaacaccttattcctgtgatctgtgttctgatttatccccacatttttaatccatcgaaggcttcccagtcttgtgtcattctgagttagtagcacttagatgtgttactctttccaaggttagcacagatacaaaacctttgaaagtttcaaacagcatatcccttaccttacttttaatatagaattttacagattataaactgctttcatctgtgctctaattgtttctcaatcttcataacaacctggttagaaagaatggtcagttagagatgccaatcaattcttctgccaaactttcaaccttgtacttcatatgccttttgtagaaatcagtccttttcttctgccagagagacagccatccaccacgtggtccaggtctctctccactaccacagaggcttagtgagaacacctgatctcaacggttgctattagaatccctctgctttgttacctgacatcgttttgggaacccaggggactactggggaaacgataacaggctatgtgtaaactagagagaagaggagagcaggtgctggggaagaagtgaagacatgaggccagggtacctgcacagagaaggatgaatcaagctctggtttcactcacaggctctttcagacccctgtttccaacttgcttaacctctgactgaacttcagcttgagtctctcagatgtatcattccagttctaatggtcacctccccctgtctgagctcattaaagtaagtttttcttcctagttactaaaggacttttggttttaaagaaaaacacaaacaaaaactagttattatccccgttttacaaattcaaataatacatatagaaaccccaaaatacatcattaggttctaaagtagcatagctagggaacagtggcacagggagagggacacaaatccatatcttctgctggaacccaacactctttatatgtaattacaccagatgaggtaatatcagtgctgcctttttgaattagcccaatgatggtgcctaaaatgagtttgaagatttgagtcaagttcaatttatttatgctgttatagccagagaaacccagtcatgcaatctcagtatttcccaactaatgtagatcctgaataattttctttcttttcaccttcctgccactgatttttacttagtagatatgtctaagaatcttgtttgttgcctcctcaaagatgtttcctcctatgtattttccctgagtaatttctcccattttaagaatgcgtcatcttctctatcacaccagagggcagaaggttgtggtggtgatgttgttttcacattagttttcctctatttccttcagcagggaaaacacattgcacttgcggtcacataattaataatcacttatcaaaggagtatgtgaataacagatgtttggagagactgctagaatagatctcttgaagtttctacgtgtatctcaaagagaaccacagtccttacctttccttaaaagacaccactttatactagaatgatttataatcctttgggtgtgtacccagtaatgggattgctgggtcaaatggtatttctggttctagatccttgaggaattaccacactgtcttccacaatggttcaacgaatttacactcctaccaacagtgtaaaagtgttcctatttctccacatcctcgccagcatctgttgtttcctgactgttttttttttgagacggagtctctctctgttgcccaggctggagtgcagtggtgcgatctcggctcactgcaagctctgcctccgaggttcatgccattctcccccttcagcctcctgagtagctgggactgcaggcgcccgccaccatgcctggctaattttttttttgtatttttagtggagacagggtttcaccatgttagccaggatcgtctcaatctcctgaccttgtgatccacccgcctcggcctcccaaagtcctgggattacaggcgtgagccactgtgcccggccggtttcctgactttttaatgatcaccattctaactggtgtgaaatagaatctcattgtggtttgatttgcatttctctaatgaccagtgatgatgagcttttttttaacatgtttgttggccgcaatccaacccaaatggccaccaatgatggactggataaagaaaatgtgggacatatacaccacggaacactatgcagctatagaaaagaataagttcatgtcctttgcagggacatggatgaagctggaagccatcattctcagcaaactaacacagaaacagaaaaccaacactgcatgttctcacttataaatgggagctgaacaatgagaacacatggacacagggacgggaacataacacaccgtggcctttcatagggtgaagggcaaggagaaggagagcattaggagaaatacctagtgcatgtggggcttaaaacctagatgacagggccgggcgcggtggctcacgcctgtaatcccagcactttgggaggccgaggcaggtggatcacgaggtcaggagatccagaccatcctggctaacgtggtgaaatcccgtctctactaaaaatacagagaattagccgggcgtggtggctggcgcctgtagtcccagctactcgggaggctgagacaggagaatggcctgaacccgggaggcggagcttgcactgagcccagatcgcgccactacactccagcctgggtgacagagcgagactccatctcaaaaaaaaaaaaacaaaaaaaaaacaccctaggtgacaggttgataggtgcagtaagccaccgtggcacatgtgtacctatgtaacaaacctacacattctgcccatgtattccagaacttaaaaaaaaaaaatcactaaagccatagtttccagtttaatttttaaaaattaacataaaaagacacaaaagacaccactgaagttcataattgccacgatgcctttataccacagcttgctcagataatcactgtaggctggtgtcattttccacttcctgttggccaggaggaagttctagtgataagcatgacgccaacctcttccctagctcacacttacatacacatgtccccctccggaaacgcgctgggctgcctcttacaggctcccaggcagttcagcaaacagtaaaaccttattctactcttgagaaatctattattcctgctactcctagaaagaaaatttttccctttttcccactctcaattctcttgtctctgagttgcatttataaaacaccttctttccctctgctttttctttgctctcctctttttgcctttaaatattagaaggatctgtcacaactaattaaatctagaactgcagctgatatactataaactgggaacggaaccacagcgcgtccatgagggcattgtctgtctgtgtggcctagctcctcctgctggtactcttctgctgtctctagtccgtgatgtactcctttgttacacatggcccactcatgaccgcccgaatcagccacagtaggcggtattcttaaccttaattaggaagctttattcttagaatataacatcaaggcttaaattatgaagtagactcaagttcccaattgatgagattctgccctatttttgcagcttccattccaatatttttcctctttccctttgccagcctctaccatgtagtactttttaaaattttctccttttctcactcacaggtaattcattattacttaagtatgaagtaatcggtgaagtgatacctctcaggacgatttgccttataaaagcacatccttgggagcagaaaaattcaaagaactggtttcctaatggggcatttcaggatatttgacattcctattttggctggtcatacttcttcatcttcaattggctctcctggaaacacctgctgattttgtcggctctgaggcagtgctgagcagtaaaaggagagtggcttgtcttcatgcctaactaagttccagtactgagctgaccaaggacaagcatgggattagcaaattatttaaatgtattatatcttggtttcctgatttctatgattactatatctgaaccaggatataataatgataaaggatataatatggaataatttgtcatctgagtcaggaacttttgacagtgaaagagagtatcattaatagttacacaaggataatcctgaaagtatggtccctctacttgtagtttaaaataaaatcagttatactgtttagcagagctaccgtgaaggttaaaagaaacaatttacacaaactatgttgcattgaaatattagtctctttcccataagttactcccagcttctaaaaacaacactatagataccaacattttaaaacgaggattgaattaaatacctttgtcattacaaagacgatgcctccttaaaaatttattgtttaaatttgtgtatttgccaatgtatgtgtgttttcccccattatcatctaagacaaaatattatcataataatttaaaaattagtaaaataacatttttaaaactttcagtatttttggggtgttaagacttacagtgacttaaatattctgcaggacttttcacctcaaactcctttcaatttaagtgaaagagattatgccagtgatttttaagtgttgttttgttcttattatcttaatgttgtttgaatttgatctcttagaatctatatatcttatagaaactaacatgtagttataagcctcatataaaaaattgttctggacattagggcgaataaaaagtatcacctttgttttccttagcccaatatattctatcttttaaatacaacttttcaaagatttcttctgaagacctcacagatttcatatccacctccccaaatgaatgagagtttccatctaactggtattgtgaattttaatgtattcttttttacttaattctcaaagataaaccaaaattttggcttgactgggagttttataaaattaaatgtgtaatacaggaatatgtgtatcattgacacttgttataaatgatagaatgttgaaagcaaactcaccaggcaatgactcatacattttgtttgggcatacctttttaaattttaaaatagtattgttatttttcaaccattacactcaattttaaaatgttggtatttcaacaccttgtttttgttttcttcatagaaatctgtgctaggttttgttgcaatttccatagagcaatgcgtcccaaagtgcatgatgttaatatgtgtggtgaacacacgtatatacatacaagtttccataatcaaatcagactggacagatcttgtgctctgggatcttcttttggagaatcacagatcgtctttatcacagaacatctttaaggccagcagaatacatttccactttgggatttgcttttataaaatttagctaaacattgtgcggatcacgggctttcaatggggtttctttaatgtacttagaaatatagtcgtatctcccatggtttcactactgtgtttctgaaaatactgattataaaagttctttgataataagtctagtgatttttagtttaacagaatgaactagacttaattagagaaaggggaataaagataaaagagtttttcaattttggacttttgagatgaagaattttttagttaattatttttaggaagttactattttcccctttgtgtaccaaattctatatatcttaatatttgctattgagaaaatcatgtactggcttaacatcaatgctatcacattgatccctgctgccgcctttgaaatggctctggaatattaattttctaacactctctttagatcacaacattaatagctgactgtctaaaagagggggaagtttgcgaataattcattattataatatgtttggtaattttagtttaaacacaatactgaaaactatcctatttggtactggccctataaagtttaggacatatgggatgggataaccacatctgaattagcaaatcaatgtatttaaacaaacaaacaaaaatttaagaagatgtgaagaatacatatacctttgtaagattgttgatatggatctagatttttcgttacccataggagacatcttgggccacttcctacttgtgttcaattgccaaaattcctcactcacttctataatgagaaattttgagtggacactctctaggaccctgtcgtcactgaacgcccgttgtgtagccaagaaagatcataattccttggtcttgatcttactgggctcttacagattcttagtggtctggaccacacctccctctgtgcgtagatatcgtttctatgaaatttctggagaatggtcaggatatctaggcaaaaagctttatcaaatatttacacactgaatttttctttctaaaccattcaagaatataggcaaaatgtgtttacgagaataatcatttaatattcctttatccctttgctttttttttttttttcttttaagacaaggtttgtcacccaggctagagtgcagtggcatgatcagggctcgctacagcctccacatccttgtgctcaggtgatcctcccatctcagcctcctgagtagctaagactatagactcgcaccaccatgccctgctaattttttttttaatgtttgtacagacagggttttgccatgtgtgtcaggctggtctcgaactcctgcactcaagtgatctacccaccttggcctcccaaagtgctaggattacaggcatgagccacagagcgcagcctatatgctaactttattcatagagagtctttagtatttttcacatctcaaataaggaggtggagaatttttgtgaatgatttctaccatcagaaatattcattttaaaaataaaattcttcacagcctgaaagcactttcatgctgtacttatgcaggtttgactctcagagaatattttctaaatgtgtgaacaagtacataaaatattatttactgcatatattattctactaattgtaaatttcaaatactcattgcttatatgtaggaatcatttgttaaatcaagagttaatatttgctggtacttttcttgttccaaaaaactatctcacaaattgtttggtcactgtcgtagccaattggaatctagactataatagcagatgagtaacaacaaccaacgcaattatcatcataaataaactagaaatttaaatctcatttttaaaaatgaatattcagagtcattagagaatggccctctcatatcaacattctttcaacacttccaatattgtagaacagagaccatgaggataatgttgagctgataaagcatgcctttcttatctcaagatattatttcacatacatggctttcgacttgtgctggcttttgggtaacagaatacattgtatcggtccttaacactgtatctggctcataagaaatacattctgtaacccagtagaagcagtgtagcctacaagaagaaatgaaggccaggaaagaatagggcaagtccacaagtagccgtttgggaagctcacatcagctggttggtgagtggcattgaacagagttcattcaatagacaagtttaggccataaaaaaactgcacctgtaaaaactatagttcaaacctgaaaattacaattcctctataccaaatgagtgactgtatttttcaatatctactctcctgtgattaaattccatgcttttgtgactatttatccctttttctttattttacttattaagaggcagaccaaattatttccaagacaattgggaggacttaatctaataatgactctgttagcaaccggctcaggtcatacttattaaaatgaacagacccttctcttaatacccttagcaaattagtgactttttcacatttttttctttcagaattaagaaatatagaattgttcttttatatgcatgccttgcaaaagtaattctaaaaaaattgtcactaataagaattcaaagcagtgtagcctttgttagctgccttttctatacaccaagaatgagcaatcaacattgtttactcatcctcttgctttaaaactcagatatatgcttgacgcgaatattgctgacaataaaacatgacatttaagacagtctatttttattgttcttgcctctttaacatcaaaatgtaaacacaaaatgtagaaagatttcttccccaggttttcacccaaaggtcattttattttatttcccttagctattatgattttcttagcaaggtaaggaattcatgttgcttttattttgcttggttttcattctcagcaacttttgcaatgtatttcctttgcatctgtcttctgctttaaaattgatagacaatggtatctgtttgaactgcgggtccttgtctgcaatatgtctgtaaccaccacctcaccagacatccacaaccggaaagactcttctgcctccaggatgaattattttgcattacaaggtttgtgcctgagcatatgtatgaataatgcataattaagcgtgttctataattttctctagccagtgtctggcacatacatatttggatggataacgaattgggttttgttttgttttcaaccctctgcttagaccaccaaataagtcttataaggatctactcttaagatgatgaaaagtattgttgacttccttactcttcctccctgagtgttctagagggtggaagttaaaatcacgtgcttctgaggtgtacaggcttctatggtactgtgtgcggaattggtgggtttttggtctcgctgacttcaagaatgaagctacggacccttgcggtgagggttacagttcttaaagagggtatatccggagtttgttccttcagacgtccagatgtgtctggagtttcttccttctggcgggttcgtggtctcgctgacttcaggaatgaagctgcagacctttgcggtgttacagctcttaaaggctgcacgtctggagttgttccttccttctggtgggttcgtggtctccctggcctcaggagtgaaggtgcagaccttcacggtgagtgttacagctcataaatgccgcacggacacaaagagtgagcagcagcaagatttattgtgaaaagcgaaagaacaaaccttcccccgcgcatgagggtacccgagcaggttgtcactgctggctggggtggcctgcttttcttcccttatctggccccacccacatcctgctgattggtccattttacagagagccgattggtccgttttgacagagtgctgattggtgcatttacagtcctttagctagaaacaaaagttctccaagtccccaccagattagctagacatagagcactgattggtgcatttacaaacctttagctagacacagagtgctgattggtgcgttcacagtcctttagctagacacaaaagttctccaagtccccaccagattagctagacacagagggctgattggtgcttttacaaacctttaactagacggaaaagttctccaggtccccaccctaccgagaagcccagctggcttcacctctcaatggcactggccacgggactttgtggcacctagcccaggcactccagcagcccagagggagcttgtcccccaaacaagcccagcaggcgcgggctggccaccaagccggcgcccacctggaacccgtgtggcctgagagcagagggagcggactcttgcctctgccagccccagagggggacccccacagcacagcagcgggctgaagggctcctggagtgcggccagagtggacgccgaggccgaggaggcaccaagagccaggaagggctgctagcacattgtcatttctcagtactagagtcatagggattgctagagactcttctcgtattatggtaaggtcatatgttctcataggatcatatagaattcccagaggaggatgattaaatttattccaacaagaggctaataaagcagaaatgatgacttctttactgttgaagggctggcagtccacaaaaacaagtgccaagaaggccaaaatagcaaaggatgttaccactgcccccaccacatttatattcccaaaccttccacacacctacattcacattcaaatagtattaaagtataagcacttctcattggtcttcaggtttttttttaattagatagatcagtcttcttaaacagcattaacatgtttaagcttcctgtcctttggtagtgacttaagttgtcaacttccttaaaagtcattactgacggcaaagtatttctttttggtcatttcaagacatccacgtgtttttttgttttgttttgttttgttttgttttttcgtctatctctatctcagaacttataatgaagtattgtattgtagacttatttttctgaccccaagagactgggtgggtgtcacctgaagacatgtcctgtgtatcaagtatccatgaatacttgacatacaggatgatgccaagaacagagctgatattcacaaatgtagaaataaatgcttgtatgtacatattattttatctgatccttacaaaaccctaggaagaaattcagaagttacaaaactcagtttgatgaataagaaaactgagattcaccaagtttagattcttgcctaaggtcacagctaacagaaactggatctgagtatttgaaattaagtcttctgacttcaaaataattcactattctgtcctccacttgtcttccctgactttgtgagaacttttcttttggaaaaatttgaataatatttgagttggttataaagcataactaaagttttcccactggtgttttagaacacaaaaagagacatttctctttcatttctgagaagcgtatattgagtagattttcattcagaatgcctttgtgatttctttgcatgttttttaatctgttttaaataatctgaaagtaaaagaagttattttaaatatttgcatataatgatgtatttgttaaaagcatatctttttttcactatactaaaagcctagccaaaattgaaatcaatttagtctaatttttgaacttgtattatgtggggtggcaggcaaaaaaaaaaaagacaaacctgtactctaaatattatatatgtgggaaccagtaaagatttgaacagaacaatgagaccaacattctctctaccagaaaagaatttaaataagaaaaaactactgatatgcagcaccaatacgctagaatctgacagaagctgtatttttaaagtcactaacactcttaatattcaaaacacacctgggaaaaagcagtaagtcagtacaaagtgaaagaaaatgaataacaggagtaaacctcaaccacaaaatataaagtatgtgaggcctactagatatgccgtaagtggatctacatttagtgtgagatgagaacaatctggcatcaataataacaatatcccattgtatgatcattatcaatcactaaatgctttcttccctttcaaataaaggattcagcattgtgacattttgcctttcattttgttgttgtttagtagaatgaccatacttcctggaaaactagaaactcccaagggaattgattcattcttttctcccaaacttctttctatcaagtattaaataaagtaaagcaaagactcatttgaccaaatctttcaaagttaccattatctaccttctctatagattatttaagacaatcattgatgatggaaaataattttctaaagactgtttccaagaagcacaaaatacttttggtttttaattcaaaatcctgtatttgaatttcaacaattcaaacaagaaattggaaaccaaatattggtattttgtacaccaaactgtgtttgttggtttcattcccaaagaaatagcactaactaggaagagaagtatgagttttaggctttcaaatcgtggccatcaggacttgagaggaaatatgcaggtgccccagttttagggatgtttattggatacgtccaaatgatgcaacttcagcaaaactatcttatcttcgtgatttggtcagtgatttttttttttttttttgtaagacggagtctcgctctgtcgcccaggctggagtgcagtggcgcgatctcagctcactgcaagctccgcctcccgggttcacgccattctcctgcctcagcctccggagtagctgggactacaggctcccgccaccacgcctggctaattttttgtatttttagtagaggcagggtttcaccgtgttagccaggatggtctcaatctcctgaccttgtgatccgcccacctcggcctcccaaagtgctgggattacaggcgtgagccaccacgcctggccgatttggtcagtgatttctatgcaggggcctggagacaggctttgagtacctcagtcttttttttttttaactttaagttctggggtacacgtgtggaatgtgcaggtttgttacacaggtatacatgtgccacggtggtttgctgcacccatcaacccgttatctacaatagatgtttctcctaatgctatccatcccccagcccctaccccctgacaggccccagtgtgtgatgtccccctccctgtgtccgatgttcccctccctgtgtccatgtgttctcattgttcaactcccacttatgggtgacaacacgtggtgtttggttttctgttcctgccttagtttgctgagaatggcggtttccagcttcatccatgtccctgcaaaggacatgaattcatctttttttatggctacatagtattgcatggtgtatatgtgccacattttctttatccagtctatcagtgatgggcatttgggttgattccaagtccttgctattgtgaacagtgccgcaataaacatacatgtgcatgtgtctttatagtagaatgatttataatcctttgggtatcagtcttaatttagcatcttgtggttccaagtgagaagtttaggtagacagacccagagatgccaatcagaactcaacatgctccttgcagcactgggaaagaaaacgcagggtggaggaagcacacagtcagtggttatgacagagataaagaatgctgatgctttgttacagcttcactttcatgtatttgtgagctctttctaacttttccttccactgatatgacatacatttggaaattatcagttctcctcagcaatttatcaatgaaatggcaaggattcactaaggagtgataaacaggcaggatgttttgtcaacagcctgaaatacgttaatcagcttctggaatgccaacaatttaaattcaaatagatttctcactgagcctgagatctaaaaccctgtgatgctgtttctgtttattggattaatgtagattttaggttcctttgtcctcaactcttgggaatcccccctactatttttttctttgtttggatggcttagttggaatagaaaaaagtgtggttgatttcttcagaagtgttatctgtgtgacctcatactcaactgcgggaataacagaaaggcagaaatcgggaaataaaaatcctgttgccgaatgagaattctacatctcactgccgtttggaatggtacagtgattcatatttcaggcacctcaattagacattcattattcataaacacttatgtaactctgagttattcaggctgggagagaacattgcaatctttctttttccttttctttattatatgacatcttatatcaaaaaaaaagaaaaagctaaaaaaaaaacactctgctacatgtaaatctgaactatttattttaggcaaaatggcatgaataaaacaaagctgatctacatttggctttgtcttgtcaaagaagcaatctgaacaaataggctaagatcaattctattagaggtgaaatacggaccaagataccaacattgatcccttcagccatggcccttgcatatagttccaatgtacaataatacaggtcaggacctggaaaggcctaaatgataagactaagtgtcaaaatcagtgttgaaaggctgctcaaactacagaaaatgaggtatccaggcatttaataagcatgcattgagctaagcacataccaccactaaagattcatttgcatgtgggattaaaacatctgaaaagttgacaagggaacgttttagagactctgagatggtgacatcattatgacacaaggcactgttggtctgaagcacactggtgagtgtccccaaccataaatttggagatagttcaggtggcatctgagtattaatcaaaagaaaatagatacttgtcttactcgatgaaaataataattattttttttgaaggggcatcaataatttaacaaatatttgtggtttactttgtgttcagaacatgttgtagtctatgtcagcactgtctggtaaaatacatggtgagccatatatgtaattttcaattatctaatacctgcatggaaaaaaactaaaaagaaacaggtgaaatacattttatatgttttagttaaactaaaatattgaaatattgtcattttgttatgtaatcaatataaaaattatcaatttgctactttacatttttcatactaaatttttaaaatctggtgtgtatgttacacttatcttgattcagaaactaaatttccatcagaaatacttcatctatatttaaatttcacaacatttatggtttaaacactggactcacatagccaaattgctcccaaaatatctaaaatgttctcctataaatgaattatcagttttaaaatatacatttaaattatttaaaataaaatagcaaatttagatctgcagtctctcaggcatgtgttagtccttctagcaacatgccaagtctgagtagccacaggtattgacacctgcacctgtgggaatggtgaccctggggatgtgcagggtgtaatcatatgcagtggcattaatctttggggagagtcagaattcatttatagcctggtggtggctaagagatggcagaattataataactgaggaggctaagtacttaacatcaatttgcagggcagtctcattttatcaggaaaagcaagaatggcagaggcaagaatgcgatagctgttccttgacattggaaaaccttcagcaaaacccagggtttgggggttccccctgggtgtctgaaatgtagcattcagcactagctccagcctttgggcagctgtgggggccagagaccaagtgtggtccctggcccagggtgggattagacagcataagtggtgtcaagaagtatatgttagagttaatgaagagtaggcagtatgtggatcacaactctagggaccatcaaataaaacttctttcagttaaggcattttgtttactgttaaagaagacaggactctaggatgtgtcttacttttccagaacatgttacaaactgatgtttcttgagattatgttggggtatgctcagccagtctctctcaccgggttctagagacagctgctgctgattttgagggtaaaaatctagtattcattgatctgaacagctgaaagcaaatcccttttgatgcaatcagattgactcaaagcattagacattttctctctgtgcagactaggctaaatgcccttggatagtctgtttcatgggcttagccttagcaatatggacctggattaattactctggcattgtgtaaactctgtaactatgtagaaatagtattatctcctatcatatctctatgtctgaacattatatgcaaccttctgtttattatcacagtaaaaaagtctgtccaaatcattgtatatgcataatttctattatgtttagagggattgatgattagaagttgataggaagacattatttaataattacaagagaatgcattctttaacaaggataatatacctcattaaaaataaaaatcattgaattatttctctactgaaacatatcagtgtcagaaataacatgaccctaaaggatatcagttgtgaataaaagccccaaagtggggattaaagtattaatagtcatgggggtaggtatgattttgcagaggtagaaactgaaatacagataaataactttcccatggtgtctgttgtatgtagtgaagccaggattaaaaaactaaggcctatctaactgtgttttttcataatgaggtactaactatgatacgaatgctccaaagctgtcaaaccacgagaggaataatgtattataccgattattcattcagaaaaacaatacaagtacttcaaagtagcaagaatctactctaaacaccattttcacaggtataaagcaaaaataggatttgatctttgaaaatatctattttaaagaatttagtatattgtgcttttatatcaattatgtactgccttaaacattcatcaagttctgctctaaaatgcagcatctctgaatatgacctgcagcttcatatgctatagacagagtagtcagagaaagtagaaagcaggggcacccattgcctttgaagagttttcagtgaaaaatttaaagaaaaaacgctaatcacagacataatgtaagtatatgaatataactattttcccctaaatctgaacatagataatgcaacataaatctcatgataaagagcaatctctaccttatatagcttagtggagaattagaatataattagtaaatgttgaaaataaagatcaactatgttgatggtattttaaaccattcagttctgtatatcgacattttgccaacactatgctaattctatggctctctttttggccctgagtttacttagtattctccacagtatactctgacctcgcaaatcaacattcatggtacaaaacattaaaagtacagaatatattattgttaagaagaggattcacatgtaaagatgacaatgaaagtgttcctggggaaaactagcaagggagtggaaagtgggatggagaagtaaagtcagtgtgccaaatgtcatggaatgtaaccttggctcagatcccacagggaagctcttgagataagtcacatgtcacagctgtctgaagcaggggctagaagctggagactttatatgcctacatctatcagacgttggttacttttcccaatttcccaactacccttatgttcaggcaagatgggttctggcagcctgagggttgtccgcagacaaaatcttatggattctagctattatttgataaaattgacatgttcacaccttatgccccagcaatttcaatgataggaagacatcccagaaaaatgcctgctcatgtttatgggaagatgtgtattaaaaatatgcagagaagcagtgtgtattgtataataacccgaaaatgaaaacaacttaaatgtccataaacatcatcactgttcaaagcatatgctacattttatataaagaaatacaatttgaaattcaaagggaatacacttcaagtaaatacacatgaaagaaaaatcataatgttgattaaaataagtcatagaagaatacatacaatgtcatttcacttacataaaatccaaaaacaggttaacagtatatactttaggaatatatgcatatatgataaaaccagaaagaaacagaaaggcatgctttattgaaagtgaaggctatcggttacttctaagttgcagggagggagatggtgtcacaggaccaccagatttgtatgcttgctgtgcagtaacagacaaacacactgagacagcagggtttgcaacagagaaagactttaatgattatagggcagctaagcaaggacatgagaacgaccgtcacatccatctccctgaggagttctgggctggagtttttaaggggattgtggagggtgagcggctgtaaaattggggttttgattggttagggtaagagtgatgaaatcatcttgatgcggaaactgaattttttgtcagcttctcctggggtactttggaccagctggtgtcagtaattccacccatatgtaggagctattgtagatcaagatatgaagataaagaagatctagcttctgaaacgcagttctataattaaagaagtgatataacggtatagggacttagagggccgactatgacttcctaggttagaaacatagcttggccacttaaaaactgaataacctcagtagaacctcattgatttcactgaaaatcaacttccttatctataccatggaggtaataatgctgactaccttattcactttgtggggattacataagttaatacatgtaatgcatttcaagcagagctcagaggcaagtgaagcactcattaagaaaacattcttggccgggcgcggtggctcacacctgtaatctcagcactttgggaagctgaggcaggcagatcacgaggtcaggagatcgagaccattctgtctaagaccgtgaaaccctgtctctactaaaaatacaaaaacttagccaggcatggtggcgggcgcctgtagtcccagctactctggtggctgaggcaggagaatggtgtgaacccgggaggtggagcttgcagtgagccaagatcgcgctactgcactccagcctgggcaacagagcgagactccatctagaaaaaaaaattctttttaattatacatgattttgattgcactgaaaaagggtgggccagttgcacctgtaagaaaaatcttattagttttctgttgggactactgagggacacaggatggaaaagcactctgaacagacaaattggcatgtgtgcaaagcattgaattacaaaataacaagggaaaaggtgttcaagggaaagtgatggagaagattgtatgggaggtggcaggagacaccttgatatcatgtggggctgtctgataaatttgcattttgtcttagagctatctgtaattcttaggagattttaaacatggaaatagcatacagactatttcactaataaccaagtatgccttgtggaggatgaactgaattaggacaaagttgttagcaaaagaccactaatagctgtttcaagtgaaaaatgttgatggatttaagtaaagcagggtagaagaaaaagaaagcagattaaacagatatttctgtagaattaactatactccataactgactgacttcagagatagaaagatgctaaattatgctgcagaacaagctaccaccaaaatctcactgatttacaaaaaggaaggtttagttctcactaagatacgtcctggcagctgcagcattcaaaatgtatttgtttgttcattaccatttatcatctctttctctgtcactgttgacaagatagagatacaaagttgttcaaaaatatttcaggtgtaactatgtatacatttgttacatgaattatcacaaccttaaatcttttatttctattgtcttaaccatttttgccacacagaagctattcatatgacaattaagttgatatttttggccgagtgtggtggcttacagctgtaatcccagcactttgggaggctgaggtgggaggatcacttgagcctaggagtttgagaccagctgggacaacatggcaaaaactgtctctctaaaaatacaaaagttagccaggtatcctagcacacgcctgcggtcccagttactcaggaggcagaggcacaaggatcacttgagccggggatggggaggcagaggctgcagtgagtggtgatcgtgccactgcattccagcctaggtgatagagccagaccctgtctccaaaaaaaaaaaaagactttttttgtggcagtgtctcaaacagacacaatctgacataatttagcatgttttctttatttttgacacagggtctggctctgttgcccaagctggagtgcagtggtgtgatcttggctcactatagcctctgccttcttggctcaaacaatcctcatgcctcagcctcctgggtagctgggattacaggtgtgcaccatcagtacctagctatattttttggtacttttagtagagatggggttttgccatgttgcccagaatggttttgaactcctgggctcaagcaatcctcctccctcagcctccaaaatgttgtgattccaggcatgagccactgtgcctggcccataatttagcacttctatcaaatgcaattatgacatgaaatatttctggttaacaactgacaatgtaactaatacaataagttttatttacattttatgggcagattttttttggtgcattctgtagtcatgaacaaattaaatggtcattatcctcatggagattctagcaaaaagcaaattataattacccacattttcatacccagctaagagtcctagaaagcctccaacctgttctagccattttctcatatttgtacagctgcaaaaaaaatatttttgagtacattatgtgagctaaattgtatttcaggtggtagagactatagataaatatcctctttcatacaaactaatcctttcattttgatgcattatttttgaggttcatatgaaccacaaccacatcacttgaattgatgtattggaaatgtgataaacattgtgtccagactgtatttgctatttattagaacttacctctccttgtatgaaattaagtatttgttttagatcaatttctttgagttgctttcttttttcttttttaagtgaaatagaaaatgaagtctgtagaatctggggaccttcccttgactaaaaatgagtttccatagtattaccataaaatctatggtaacccatttcatactgaaagattcttgattgcttacctgttgatgtcattccctaggtgacgtctccttaaagacattattgtatcccatttttatttgtatacacagcatctaacatcatgtccagcatagaatatgtgtctaataaatgttggttggttgaaagataattttcatctgcagtttctttatgcacattcgagtttagtatcttctgaattattgttttgttttatatatgacttacatgcacattaaagtaagaaattttccaaagagcttgagtagcgctaagattggtcattttcaagcatatcaaaagacaatgagtgaaaatactgtagctatactttattactctgcaagcgtatgactaaatgcagctgactcctccacacaaaattaccatagtggttaagagtgagattttagcctaatacctaagtctgaacctttctctgctgctaactcattgtgtgatttttgtgcaaattacctacatttctggacctctatctcttcacttttaaaatggggatcactttgataattgcacctatctcacagagacattttcaagatcgaaggagtttaatagtgtataaaatttagtaaaattcctggtacatcataattgctatgaaagattggttatgggactcaacaaaatctgttaaataaaaaaagtatgaaaatatgaaaatatataataacatagtaacatactacaattatgaatatggactcagttctaattctgaatagtagggaatgcatttggaattattagtaactaatatgatatattcttttgtaataactatatttttccatgcttaggtactgatcactcaggattctagttgtgaatgatagcagcaacactagctattcaaacagaaagagatttattaaagggacttttttactgaagtttctagacagctacaatcagatttgaaatgccaccaccaagaacaacacctacatctccccagagctcctcagtgaagccagcactgctatacccactgctgtagatgcctgatgattctggcactgcgtgccaagctgcccggggtggcctgggaagaccagctggctctgaccctagccttgtcagaaaatcagtttggcacagaaattgctttatctctctagaaccaaagtcttgtgtttttctttctgttgggcatttaagtcaaatacctctactctagctgcaagggaagctgagaaaatgaacttctgaaattccccaaaatatgcaggttgttcaaagctgctccctggccaccaaggtgtcctcaggcacagagacattaactagaagaggattccttgagcgccacaaataagaacttatggggccttatttagttgacaggggtgaacagtacctggaatatcagttgtaaatgtaaggagaattctcacatagagtttaaattgcttaactatattcaattatttcaaaaacatgaaacgaattatactagatataatctcccataggatttactgaggaatacagagaagagtaaaacaccctgctctgattcttacagtgagcaaagaaggtgtcaggagtagagaattttttcccacatgcaatgtgggaaaagtataaagtaccctacagatgcattgaaggaaactcctctctttaggaagaataaggagagtctgaattgatttgctggttaagtgtattggtctgttttgcattgttataaagaaatacctgaggctgggtaatttataaagaaaagagatttatctatacaagcatggcaccagcatcttctcagcttctggtggagccttaggaagtctttacccttcatggaggatgaaggggtgcaggtacatcacatgatgacagaaggagcaggaaaaaggaggaagtttcaggctcttttaaacaactagctctgacatgaactaatagagtgagaactcactcagtaccaagaggacagcaccaagccattcatgagggatccacccccatgatccaaacatctctcactagacgtctgagaccatctccaacatttgtggccacatttccagatgagatttgcaggggtcacacatccaaaccatatcattgaccaaacatttattgaatttcatattaccaatgaaggtacaaattaagtaatatatgttccatggaattattaaactttctccacatgttgaaagatttattcaggcataaaaagtttctatttccaagaaaggtacgtaagtggaaatatatagagaattttcagggaaaaatatgctttttaatttgactaaaaagttggttagatccagaaatatggtgggttctttgtgaatgccataataaagaactgaggcatgacactcattttattatttttaattgtttttccagagaagaggctgacatggttaaagtgtgttgttaggagatttccattgtcaatgtggtacagatcaaataaaagtgagaaagctcttttattataccaaatagcagatacggtgaattttaaatgcttcatggtaaagagaatagagtggaaagtgagatgcagatgacatagattctatggttctagaataaaattattaattttaatgaatgtgtggagcaagacagatatgaatctcagtgaccatgctggaaggactgtggtgttatttacatctatagaaacatgatggaaaacacattctggaatttagaaaaaaatttagatagaattgttgtgttgaatgaattatatttgttttctgttgctggataaaaaattaccataaattcagcagcttaaaacaacacccacttatcaactcacagttctataggtcagaagtccatgtggaccggactgcattctctgatatgggtatcatgaggtggaagtggatgtgttggccggactaaggtacttggaagctctggaaacagtctccttttagcgcattcagattgttgacagatcagtttcttgcagctgtagaaatgaggtctcagttttcttcagcaatggaaaaccccccttacatcaaatccctgtcttgatttcagtctttctgatttctgcttttgctggcagtttagaaaatcactgcttattttattagattagggatatgatttggctatgtgttcgcacccaaatctcatgttaaattgtaattcccaacgttgggggagggacctggtaggagatgatcatggggggcaagatttccaccttgctgcttttacgatagtgagtgagttctcaggagatcaggttgtttagaagtgtgtagcacatccttctttgtttcctgtctcctgctccaccatggtaaaacacgcatgcctcaccttcaccatccgccatgattgtaagtttcctgaggcctcccagccctggttcctgtatagcctggggaactgtgagtcaattaaacctcttttcttcataaattacccagtcataggtagtttgtttacaggagattgagaacagactaatataaataggctcttcagaatactttctctatcataaggtcaattgattactagacttagacaaatagtgtgcagctggaagtgctctctggaacttggaagaggattgaagtaagagatatactctgaagagtgaattattccagtagtgctatgaagagaagtgactgacataatcaatgaagattatattgagaagcaaaagtgaaaaatctgagatcttgcaggtaaaaaataaataaataaataagtcttagtgaaaagatctcaatttcatttatgggagtaaatgccaggaattgagagcgggaggtaaaatatgtattgttagacttgaggaggtcatgattcttgaagtggaatgaacgtgcacgtctaaaacacctaaaagtaacgggaaaataaaagaaatgaagaaagaaaagaataacttcccagatatctagcaaaagggaagcaatagaatacaccagctgagggacttgtaaggaacacatcatctgaggaaacgttcattgcagtaaaatgagaagatggaatgtgaataagataaaaatgcaaattatgtagaaagcatagttgcaagaacacagggtggactagagacaaaaagggcttaggaggtaaagaacaatcccctagtgcacataatctcttgttttcatctctttgccttggatcacgggccaatcatgacagcaatggtgcattttcatctttgaatccatgacacattgttggccctcaataaatttgcattaaacaaatgaaaagcaggtaaccagaagcgatctgtgcctacaagaggagctgtgtgtgccaggaattagtctagcaggagcttggtagattatacttcctggaaatatagatgcatataattttaaagatataatcatgaaatattaaaagaattgtaaaagtggcagtgaattatttagaaacagtgtccctgcatgcatgatacaatattcagatgtgtgttaaaatgtatgctccaaggaaagtcttggtatagttttatgtgcgctgcatattttcaaataatgctggaaagcagtttaaagcttttgaatttcttcatcccgttttcctgtctccttgtagagctccctttgatttcaaaggtgcttcattgctagaatgagaaataggtggtaggaaagtttaattctttgaggctaaagtttgaaacagtttttcatttacagataaaaattctacctttggacttcagcattgttcagttttccccgagataaatccgtagaagtagcctacacctgcctacaccttgtgactacatcttcagattatatatatgcaggcacagttttagaaatgggctggcaaaggaagcaagagggaacagaagataagatgctcccctcctctgtaaaagagatactgtaatcatatgattgtgtttttagccaccgaaagcaaaaaccgactgatattacctttagatgctaatgatttatttgatagaaatacatttttgctttaagcttattgatcatgctcatttataaatgtaaatttattctgtcatcaggattccaaatcatttaaaacctacaaatatttattgaatgtttcttgctaaactctgtggttggttttgggaggatgtgtaaaatccaacacttgatctccagggattttcatcacctaggaaggagagataaatacattttctttttgaatggaaaactaacatagcaaaagaaacaaaaatgctataaatattcaaagtatgagatgttagtcctatcacatcctttgttgtatgaggataaatataagtaaatataaaaacacttatatacatggcagatatcacttggtattaattctccttcagctcttggaaaaataaatcttattgaagagccctataaacaccacttctcactacacttactgcataattttagaaagaggtttaattaacatgaaatagctacactcaactggtctaaagcagctgtgtagcgtgaaagtcacacaaagccccagtctcaatgatgtattcctcttcccacctcaatcatcataatccactttctgtggtactccagtaagttcagggaggctttctttcaatactgcaagtcctcattgtcctcctcttaattctcataccttttcatttcagaattctctcttggatctttgatagtacttgtaccacctactggctcaaacatttattttagttgctctgaaagcacaggaggcgaacaagaggcaaaagtggagactttgggcatagtggccattgggtttgtggcagatttttctggcccatctcagtaaagaaaggaatcatagtgtttggggtcttaaggagaggacaaggaagatatgagccaggtatcagcatcagagagaccatatggccactgaaatctcaaactggatcatagcatactgacagtgcttacatggcccgcattccttgaattctgaaccctcaagatgatgaaacatggagaaatagctgatgtaaacttataaatacataaatcattaggcatagggtaggcctctataaaattgatagttgaattgtgactcatcacttgggattggtgggttacaaatgtgtaaagcctcaggatttgctctctgttttcaccttaatttgcttatttattaaatatgtagagagcagggatgaggaaccactagcctgggagcaggatccaattctcaagaagaagtaattgtttattatagagaagtaaagtagcagaatgaaagaggaaagaaggaaggaacagcaagagggagggatggatgttaatttgccccacttgggtcaagtctaccactctctactccatgtctataatattaatctctgtgtcataagggaaggttctgtgactggcagccacaccgtaactagttggaagagttgtccaaagcaagttagtttgctccttctgaaaaaaggagagcagttgtagaaagtttgcacaatgaaaaaagtttatatttatttgaactgttgtattagtcttcctattattaacagagactagccaggcagcaatatttaactatgtgaataataaagaccagaagtcaattttttttaaagaaaccatagctggccagaataattaaagctgcatgttttcacagtttgaggttctgttaagtcaggaattaagtcattgtcgacacaagataggtcaatctcatttagtagcatgccattgtaaattaggtgatttctcatcactccttgctgctccatgatagtacaaatgcttgtcaaaagctttaatggtcataggtaaaacactaattatgtatcccacaatagttgttacagtaaggtaattctttgtgtctctagggtaggtaaatgtttcagttatatatttgcaatgaaaactgaggacagttacagtggctcatgcctgtaatcccagcactttgggcagctgaggtgggtggatcaccaaggtcaggagttcaagaccaacctgatcaacattgtgaaaccctgtctctactaaatacaaaaaaaaaaaaatagctgggcatggtggcatgtgcctgtaatcccagctacttgggaggctgaggcaggagaatcacttgaacccaggaggcgggggttgcagtgagccaagattgcaccattgcactccagcttaggcaacaagagcaaaattccatcaaaaaaaaaaaagaaagaaagaaaatcgggtaccatcctatcttgatgaacacaaatgtgtagaacctcaggatttactctctgttttcaccttaatttgcctatttatcaaatacctgtagagcaggaatgaggaaccacttctctgggagcaggatccagttctcaagtttgattttatctaatctatagagagttggtattctgccatgaaaagtaagtctttcaaattaatgtccttaaaatgcccttcatctggtccaatcagaacagagtaggagaaaacagtgctagagacacagattctcagttagactttctgatttaaaggcccaactccaccacatgatggagtgtaacctgaatgacttagtctctctgtgtgtgtttctgttttatctgtaaaagtggtataatactaggacctacctcatatagttcttatgaggattaatttggataatatttttaaaaatgtttggaacaatgcttggcaaacgaaagcaacataagactgccccttaaatgaaaaaatgaataaataaacaaagttcctcaagttttaagtacatgtaaaaagcttttgtgagctaatattttatagctattaaaattatacaaatggtacacatttattataaaacattcaagttgaataactgaaataaattactcataatcttacaatctggtattgatagtattttagcgtatttttaaaatttttgtacatcaaattagaatcttacagtttaactgtatattctcatttgtaatggtattgtcttatgtggaattctataagcattattccatagtcttacatattttaataatatattttttaactaattccttgttgctagattatgagctttgttacatatttagataggttccaattttgtcactttttatgatgctgtaataaacattctttatgaaagtctttgcccacttttggggtgatgagagcacctggaaatgaaactgagaaaaagagaggaacatgtaaattatttgatcagtaaatctataaatattatgccaatttacatttgcagtatcattattacctctcatggtgacaatgtaaccgaattttaccaaggtcaattttccttacctaacccacgctttggaaccagctgagccttctctcctccaggtctcttcccatgacctcttttccctccctctacttgtctttagtcttctctcctttgtctctccatctctgtattttcttcttttcagtcctttttatctgattctagttgctgctaaaaaaatatatatgtctcatgaggtatgttcttcccaacactcatagactttattctaacttcagagtaatggctgtctgcccactccttcctttgtaagtaagaatctgtgacttgaagaatcacattttttcactctggcatagtacatttgctagtggtcttaataatagtgggccactagaaaagtaagttttaattgtgtttttaactgtggagaaatgataagagatgtcttcgaaaatagcaaaattattgataggatgtttctgctgcagcctacaaagttagttacttttcactggagactgagtttattacatgagcggcctgtcttaagtttcttgccatctctcaagcacattctctaatataatttattcattgaagcatacaactgtgtttctgccttagggctttattttcatctcctcacaatatacaaaattaaaccccaaagacaatagcattatatgtttcaaataattcttcaatagatatttgtaatttatatttcatgcaatataacaagatgctgtgcattgattgagagcactgtagagaatgtaaactaaactgtaaaatgtgtccagaatatatttcaactaagatggttttatcagtctaaacttaaaatgtgtttcaaaaatcctgcaataccaggattctgcatctattgtgctgattttgctcacttctgactttgtaactttttctgaaggaatcacatttttaaaaatttttaaatatgtaattaacaaaaattgaatatactcaaggagtacaatgtaatgatttgatatttgtatgtacgtttgcaaggattatcaaaatcaagttaatacattcattaccactcatgctgtacattagattcagacttgttaatctaattggaagtatacatgatttgaccaacatctccccactttcctagccccttgaaactatcattctactttctgcatctatgactttgacagttttagattccacttataagtgagattgattgtacagtatttttctttgtttatcaagcttatattcataaaatgtccctccagttcattcacgttgtcacgaatgacagaatttccttctttttatggctaatattacagtgcgtgtgaatgtgtttgtgcttgtgtgcatacatgtcacatttttgttatctatacacctgttgatggacacttatgttgtttccatatcttggctattgggaataatgttgcaaaaagcataaaaatgcagatatcccttcaacatactgatttcagtttttttagatttgtacccagaagtgtgactgctggatcatacagtagttctatttttaattttttgaggaatctccaaactggtttccataataattgtatcagtttaaattcctaccaacagaggagtataagcattcccttttctctacagcctcccaaacgttgttgtttcttgtcttttgataatagccattctaacaggtgtaatgtgattgtcttgatttgcatttctctgataattagcaatattgaacacttgttcatgtatctgctggccatttggtttttcatttgtttgttttgttttgtttttgagatggagcctcactctgtcacccaggctggagtgcagtggtgcggtgtcggctcactgcaaactcaacctctcaggttcaagcgattctctttcctcagcctccagggtagctgggattacaggcacccaccaccacatctggctgatttttttgtatttttagtagagacggggttttaccatgttggccaggctggtctcgaactcctgacctcaagtgatttgcccgcctcagcctcccatggtactaggattataggcttgagccactgcacttggtctctgctggccatttgtaagtcttctttgaaaatgtgtcttcactttttagaaattgttttgtaattgagttccttatatattctagacattaaccctttatcaggtttaaaaatattttcttccattccgtaggttgccttttcattttgttgattgtttcctttgctgtacagaagtttttagtttgatacagtcccacttgtttatttttgcttttatttcctgtgattttggtgtcttatccaaaaaatcattgccaagaccaatggcaagaagcttttcccctaagttgtttcctagttgtgttacaatttcagctcttacatttaagtctttcatacatttggagttaatttttgtatatggtataagacgagggccaatttcactcttttgcatgtggatatccagtttttcaaacccatttattgtggagacatctttttcctcattgtgtattattaatggcattatcaaagagtagttgatcagaaatgcatgggtgggtgtttttctgtgctctgtattttgtttcattggtttatgtgtctattctatgccagtaccatgctcttttgattactacagttttataacatagtttgaaattcggaagtgtggttcctctagctttcttttttttttttttttcaagattgctttggtattttcatttatttggggcttcttcaatatttaatctgtaccttatagtttttagtgtatggacctttcacctcctaggttaaatttattcctgagcattttattgtttagatgctattatcatgggaacattttcttagtttatgtagattttatatgtagatttcgtatctgcaactttactgatttagttttctagttataaaaggtaaagtctttagggttttctgtatatggtattatgtcctccacagagattatttaacttattttccaattaggatgctttctatctgttttttttttaaacccaactgctctaacttggacttccatactaggttgaatagaagtgacaagagtgtgcacctttgtcttgttcttaatcttagagaaaacgaattaagctgttcaccattaagagtaatgttagctgcaggtttgccatgtatagcctttgttatgttgaagtatattcattctacaactattttgttgagaatttttatgataaaagaacttttaattttgttaaatgctttgttgcatctattgagatgatcatatgatttttagccttcattctattaatatagtatatcacactttctgttttgcatatgttgaaccatccttgcatctcaaggataaattccagttgatcacagtgtagaccttttaaatgaactgtttagttcactttttcagtgttttgttgaggagttttacatctgtgtttattagaagtattggccagtgattttcttttcttgtagcatccttatctggctttgatatgaacgttactggccttgaaaaattacattggaagtgttcccatctcaatttttgggggggagattttgagaagaattggtgttaattgtttgttcttaaatacttcataaaattcaccagtgatgccatgtgttttaggctttctttgtttttaatgggaagttttaattactgatttaatctctttacttgttattgatctcaaatagcctatttctttatgattcaatcttggtatattgttcatgtctaggaatttatctgtttctttgaacttatctaatttgttggcatataagagttcatagtgatttcttatgatactttgtatttccgtggtatcggttgtaatgttttctttttcatttataattttatttactttgttagtctttttttctttgttagtctagctaaaggtatataaattttgtttatgttttcaaaaaaactcagtttcattgatcttttctataggcttttctttatttctagtttttatcttattatccaatctttttcccctttatcaaggaaaacttctgataaggtttagctgtgtctgcacccaaatcctatcttaaattgtagtttccataatcctcatgtgttgtgggaggaagccagtgggaggtaattcaattttgggggtggttactcccatgctgctgttctcatgatagtgactgagttctcatgagatctgatggttttacaagaggcttttttctctttgctggtcttctctctcttgctgccctgtgaagaaggatgtgttgtttccccttctgccatgattgtaagtttcttgaggcctcctcagccttgtggaactgtgaggcaattaaacctctttcctttataaatcacccagtctcaggtatgtctttattggcagcatgaaaatggactaatacagtaaattggtactgggagaatggggtgttgctgtatagatacctgaaaatgtggaagcgactttggaactgggtaacagacagagcttggaacagtttagagggctcagaagaagacaggaaaatgtgggaaagctcagaacttcctagaggcttgttgaatggctttgaccaaaatgctgacggttatatggacaataaagtccaggttgagttggtctcagatggagatgaggaactcgctgggaactagaacaaaggtgacacttgttatgctttagcaaagagactggacgcattttgcccctgccctagagatttctggaactttgaacttaaaagagatgagttagggtatctggcagaagaaatttcttttatatgtatatatatataaaaaatatatatatatatatatttatactttaagttctagggtacatgtgcacaacatgccagtttgttacatatgtatacatgtgccatgttggtgtgctgcacccattaactgctgaagaaatttctaagtggcaaagctctcaaggaagcagagcataaaagtttggaaaacttgcagccccacagtgtgatagaaaagaaaaacccgttttccagggagaaattcaggctcactacagaaatttgcataagtaacatggagccaaatgttaatcactaagacaatggggaaaatatatctagaacatgtcagagaccttcatggcagtgcctcccatcacagacccagaggcctagaagggaaatattgtttcctggactggacccagggtccccctgctctgtgcagcctcgggagatggtgccctatgtctcagctgcttcagcaccagctatggctaaaaagggccaaagtacaccttaggccatagcttcagacagtgcaaatcccaatccttggtggcttccaggtaatgttggtgcacagaaggcaagaactgaggtttgagaacctctgcctagatttcagaggatgtgtggaaatgcctggatgtctaggcagaagtttgctgcaggggtggagcagtcatgaagaaccactgccagatcagtgtggaaggaaaatgtagggtcagagcccccacacagagtccccactggggcactgcctagtggagttgtgagaagaggaccactgtcctctagaccagagaatggtggatccactgacagcttgctttgggcacctgcaacagccacagtcactcaatgccagcctatgaaagcagccaacagaagggctataccctgcaaagtcacaggggcggagctcctgaaggttgtgggagcccaactcttgcatcaatgtgacctagatgtgagacatggagtcaaaggagataactttggaattttaaggtttaatgactgccctattggatttcagagttgcatagggcctatagcccctttgttttggccaatttctctcccacttggaatgggtgtatttacccaatgcctgtacctccattgtaactagaaagtaactaacttgtttttgattttacaggcttataggtggaagggacttgccttgtctcagatgagatgttagacttggacttttgggttaatgctggaatgagttaagactttgggagactgttggaaatggatgattgtgtttcgaaatgtgaggacttgagattttggaggggtaaggagagtggaatgatatggtttggctctgtctccacccaaatgtcatcttgaattgtaattcccataatccccatgtgtcatgggagagacccggtgggaagtaattgaatcatggggatggttacctgcacactgctgttcttatggtagtgagtgagttctcatgagatctgatggttttatgaagggcattttcccctttgcttggcacttctctctccttccaccttgtgaagaaggatgtgtttacttccccttccatcataattgtaagtttcctgggtcctctcagccctgcagaactgtgagtcaattaaacctctttcttttattaattacccagtctcaggcagttctttatagcagcataagaactgactaacacaacttcttcccagaatatacccagatataaatgaaatagataataaatcaaagtcagctgtactgagtttgaatgagactgatggtctcttgagcccagagtttagtttctaacagatctggaattgaatctaggcttcttccctagccatttcttggaggtagcccctttggaagtatgactagacctttccaatcattaatctctttgtctctaaagtaagcataatatctacttttttagggctgtgttttagtattaaggaaataacctgtttagctcaatgccaatcacactgtaaatattaagttaatggaaaaaatgctaaaaataaaattgataacaataatatagagaaccttttggcatggttgtctaaataagagaatagataaaaaaagaagtgcaaactatagaccaaatgtttggatctcatattagtttagcatttggaaactggctatagaactagacaattaatattctttgctaataatctataacatttgttaaacagttcgaattacagtagaaccaccaagaattctgaaaacccagtaagttaagttgatgacatgactggctgtctggatgctacggggcatgagctttagccatactcattaactttgataccccaaagtcaccccaaagaaatacaaatacagtgtattaggtatgcaatatccgcttcaagacaaaacttacagtcatttctggtatgatcaaattgattcccctaagtccttgttataggaaaaattatgacacacccacttatcagtaagacacgaatgtaacatttcctgagatttataatagttattgagaaaaggaaaagaaaatttatgaataatagaaataattttcctttatgttttgaaaaattaactcttatttttcagttatcgaacatgtaccttcaattcttcaatttagagtttatttatgataactaactttgatatcctctgagagcatgtctagaagatggcaaatgcttttcaccatgaattagtgctgaatgcagttttaaaaatcttaccttgttaatctgttagaagatagtagcaaataacaataccacattgcttatttgttgaatagcaacaatttcaataattcagtagaagacataagttatatgacagatatatataatcataaatctaatatatttgtaatgaagacaaatattagcttatatgtatgatgtttaatcttactttagactctaaataactgtgtgatattggaaatttactgaaattcgtaatgattatattttatttctttgtaaaatatagtaatttgacttaatgatctctatgattacattattctctaaatctggtaaaggtgaaactttagaaattgtgtgtgtgtctatatatatacatgaatacatgtgaatatattcatagacacatacacatatgtacacatacacaaacatatattcacatccatatatattttttaattgggtagaatatggagtgaggaaacttattgtattcacaaattgagtacttagtaaatatttcatagatttattaaataattttactttatgatatatattagcaagttccctgtgcttccctgtgcacgttttgaagattaaatgtagtaaaggatatagagcactttttttttattatactttaagttctagggtagatgtgcacaacgtgcaggtttgttacatatgtatacatgtgccatgttggtgtgctgcacccatcaactcgtcatttacattaggtatttctcttaatgatatccctctctgctcccccaaccccacaacgggccctgatgtgcatgatgatccccgccctgtgtccaagtgttctcattgttcaattcccacctatgagtgagaacatgtggtgtttggttttctgtccttgtgatagtttgctcagaatgatagttgccagcttcatccatgtctctacaaaggactttaactcatccttttttatggctgcatagtattccatggtgtatatgtgccacgttttcttaatccagtctatcattgatagacatttgggttggttccaagtactttttatatgtctggtactcatggtatgtgctcaaagattcagagaagttatagcacttcaatgtgagtctgatagtcacagatgcatcattatgaggatagtgtgcctgggatgaagggaaaggtagagaggaggcagagaagaaatgccctgagggtccagattggaagaggattcggtggagagaacttttcatttcaagaacaagagaaaaagagtagaaggaactcagcctgaaagtattcccaatcgaggacctcaccaactgactgcccatgccgggaacagttggccatcccacagtctaagagaaactaatgggcacacactgtaaaatgtaataggagtttaatgtaaatgggtatctagactttggaacttgggcgtataccactaaagatgttaacctaaggaaagtatagagttatcagtaataacatgtcagtttgtttcttgtttggttggtttgcttttaaacagtaggatagactgcttgctatacacatgttagaagctttgtagttgctaactggcaggcagtaaagcacggtggttaaaagtcatgccctgggtcaacatactagctgcttttcttactatccatgtgatctgtggcaacttacccaacctgtctatgcttaagtttctttaattgtataaaacatgtgcaatagcacttgtctcctacagctgtttcaaggattagctgagtttacctgaggaaaatatcatagataataagttcccaataaaagctgttactttaaaatcatttaattcaggtctggagaaaaacaaacttggaaaataccaaaattgagaggggaaaggcaggatgaaaatctcacagaaaataaatggttagagttgatggacgaccaggataacacagtgtctctgatccccagatagtatagaatagaaaggaaaaccctgttacataaacagtgtcaaatactgtattagactgttctcacactgctataaagaaatacctgggccaggtgcggtgactcacccctgtaatcccagcactttgggagactgaggcaggcagatcacgtgaggccaggagttcaagaccagcctggctaacatggagaaaccctgcttctactaaaaaaacaaaaaattagccaggttggtggcacatgcctgtaatcccagctactcaggaggctgaggcaggagaattgcttgaacccgggaggcggaagttgcagtgagccgagatcgtgccactgcactccagcttgggcaacatgagcgaaactccatcaaaaaaaaaaaaaatctgaaactgggtaatttatataaaataaaaagaggttttattggccatggttctgtaggctgtacagaaagcatgatgctggcatctgctcagcttccaaagaggcttcaggacacttacaatcatggaagaagacaaagagggagctgacacgtcttatttggcaggaacaagagcaagaggaagggcagggagatgctactcacttttaaacaaccagatctcgtgagaactccctcatcatgatgagaacagcaccaagaggatggtgctaaaccattaatgaaaaaccacccccatgatccaatcacctctcaccaggcttcacctccaacattgcggattacaagtcgacatgagatttggtgggacaaagattaaaaccatatcaaatactaaaatttaaagattaaaaactgaaatcagaaaaaataagccaactagaaatttgttaaaaaaagaatataagatattgattgaaaagtaagttattattctgtgtcacttccatataaaacattttttaattggcatgaatatttagagttaaataaatactagtagtgtggttaagggtttctgtactttatatttttcctcatttgtttatagtgttttttctcaaattttctttcttttctattaactttaaagattctattgattcttgtaccaatagagagttttaataggtttatgaattggcaagttctctactaatggatggtgagaatgattcatctttaaccccaaattcaaataatatcaagagactgttaaaatggtgcatgacgattttagcctttgtttcagtattaaactagtggcacttcattaatttttaacgggattcaatttgcctgttaagtagtttatagaatcatcttacttttggtttcctaagaaggccaaagtattttgcatactcctttctgtttagcatattttttccatgtctctccatgaaataaaaccacatttgacaataacttaagattggtattgtcaagtgtttgcaacctttaggggtcttttgttttaaatacctccatggaaaaagaaagcacacgatgcggaatcggactcatcagaactcaaactgatttctgttactagctctctgtggcctgggcaagtcacctaaactctggaagattttgtttttagcatgtgtaaaataggaaatttgataaatgtaacatttaagtgtattatgacatgtgaccactaaatgaaaacttttgttacaagtattttatgggaataatgactaaggattagcattcttgatatttaaaaagctcacaaattggataagaaaaacgatatcacaaaagctaaaaagagattattcagttaataattttattattagtgtatgtatgtaaaatatttaacatcactacttaacatttaaaaagtaaaaaccacagtgatattcattaaggtaggtaaatttttaaataatgataaatataatacaaaaaatgtggagttttattctataccaatcctgaatcatattatttataattttacctacttttaatcaatgtatattcagattcatattctgctttttaaaaataatttgaaaataatacatattatttatatcagctataaagtattctatatgatcattctatctcaagttacccaactttcccttactgatgaaaatttaaaagtttccagttgtagttgattatgaatagtggtagatggaagcaatgaacatattggtgcacattatttcctcatttaagggaagtgatgacaatggtagttatttctatagtaatgcagattccatgactgggaaattggagtttgtgaatcaaagacattattctatttttacttgaaaagagtgtgttgccacattatctcacaaaatgatacagtgaccacttcctccatctagaaaacttttctccttggctaccacaatgccacacactctcacagttttctttctctctcacttggcattccttttctttttcctctaaatagttattagacattggcacgtcccatcaagtcttggacagcacttctttcactagatcatcccatctaatctcatctttcaataccattcagctactgatgactcctaaatttatgtcttaatttcatcttcctgagacccaaactcatctttaaaaccgatatgggaacttgacacctcaagttaagactaaaacacagctcctaattttcatccccaaatctctttctctaatcgtttttttccgtttcaggaattgctactaactcacttcaagtttctcaactcagaatgtctagaagtcagccttgattccttcttttcacttgccatagtcgccaggagctctcaccctgaaatacaggctgtcaggatgttctgagaatactctcatatatccacttcttgatacatccacctcaggccaactcactcactatttttacttttccctgttattgttggaatatccatacaacttattcttgatgtagcagttatagtggtattttcttcaccaaataaaacaatgtttacattgtaatttgatcagaagatgctaaatagatatttcgagcagtgctcattgaggtatgtagagcatctcatgctttctgaattaaaagaacatgtacagtgtacataatatttggtcagggaccctaagactggtgagttttatgttttttcagagtggtaaattagttaatgcaaagcaggtgttcatttatagcttcaagtaggaaaattcactgtcctataaaaataaattttataagcactgtagctatcacaaagttaatattatgttttgaggaattaataaaaaaattatatagttagcaattgaatatttaatctcttgttcctgtagtatatataagtaaatataaaggaaaatggaaaaaatagacaaaacatacagacttttaaaacctcagacatttgtcagtttccatgtagttgagcggttttgagtgagtttcttagtcctgagttctagtttgattgcactgtggtctgagagacagtttgttataatttctgttcttttacatttgctgaggagtgctttacttccaactatgtggtcaattttggagtaggtgtggtgtggtgctgaaaagaatgtatattctgttgatttggggtggagagttctgtagatgtctattaggtctgcttggtgcagagctgagttcaattcctgggtatccttgttaactttgtgtctcgctgatctgtctaatgttgacagtggggtgttaaagtctcccattattattgtgtgggagtctcagtctctgtaggtcactaaggacttcctttatgaatctgggtgctcctgtattgggtgcatatatatttagaatagttagctcttcttgttgaattgatccctttaccattatgtaatggccttctttgtctcttttgatctttgttggtttaaagtctgttttatcagagactaggattgcaacccctgccttttcttgttttccatttgcttggtagatcttcctccatccctttattttgagcctatgtgtgtgtctgcacgtgagatgggtttcctgaatacagcacactgatgggtcttgactctttatccaatttgccagtctgtgtcttttaattggagcatttaccccatttacatttaaagttaatattgttatgtgtgaatttggtcctgtcattatgatgttagctggttattttgctcgttagttgatgcagtttcttcctagccttgatggtctttacattttggcatgtttttgcagtggctggtaccagttgttcctttctatgcttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatgttggagcttctgcacagcaaaagaaactaccatcagagtgaacaggcaacctacgaaatgggagaaaatgttcgcaacctactcatctgacaaagggctaatatccagaatctacaatgaactccaacaaatttacaagaaaaaaacaaacaaccccatcaaaaagtgggcgaaggatgtgaacagacacttctcaaaagaagacatttaggcagccaaaaaacacatgaaaaaatgctcatcatcactggccatcagagaaatgcaaatcaaaaccacaatgagataccatctcacaccagttagaatggcaatcattaaaaagtcaggaaaaaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcggcactattcacagtagcaaagacttggaaccaacccaaatgtccagcaacgatagactggattaagaaaatgtggcacatatacactatggaatactatgcagccataaaaatgatgagttcatgtcctttgtagggacatggatgaaactggaaaccatcattctcagcaaactatcgcaaggacaaaaaacccaacaccacatgttctcactcatatgtgggaattgaacaatgagatcacatggacacaggaaggggaacatcacactctggggcctgttgtggcgtgggggcaggggggagtgatagcattaggagatatacctaatgctaaatgacgagttaatgggtgcagcacaccaacatggcacatgtatacatatgtaacaaacctgcacattgttcacatgtaccttcaaacttaaagtgtaataataatacaaaaatttaaaaaaaaaaaactcagacatttgtcccaccttcccctgtttttaataatgctcgttgttttgttcctacagtgtctgagtattaagtattttctaatgagaccttttgtgaattagatggttaacgaaagagtgaaaacattacttatcaaaatactaataaatatttaaatataaatatacttattcttaagcatatttatatataaatattcttaagtatacacttaaatatatatacttaagtatatatatttaagtgtatacttaagaatatttataaatatactcattcttcagcatatttaaatataaatatactcattcttcagcatatttaaatataaatatactcgttcttcagcatatttaaatgtaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagtatatttaaatatgagtatactcattcttcagtatatttaaatgtaaatatactcattcttcagtataattacatgtaaatatactcattcttcagtataattacatgtaaatatactcattcttcagtatatttccatgtaaatatactcattcttcagtatatttccatgtaaatatactcattcttcagtatatttccatgtaaatatactcattcttcagtatatttccatggaaatatactcattcttcagtatatttacatggaaatatactcattcttcagtatatttacatggaaatatactcattcttcagtatatttacatggaaatatactcattcttcagtatatttacatggaaatataccattcttcagtatatttacatggaaatatactcattcttcagtatatttacatggaaatatactcattcttcagtatatttaaatatgagtatactcattcttcagtatatttaaatatgagtatactcattcttcagtatatttaaatagttgagtcagtattatatcttctaattaggtttctaataataatttcaaaaactatgacatgttttcttcccatttttttatggctgaatcaaaatgttgagatttataacttggaccccgtattctataatgtcacacagacatatatttttttaaattttaccttaagttctgggatacatgtgcagaacatgcaggtttattacataggtacatgtgccatggtggtttgctgcaccaattaatatgtcatctgggttttaagccccacatgcattaggtatttctcctaatgctctccctcccccagccctccaacccctgacaggccctggtgtgtgatgttccccttcctgtgtccatctgttctcatttttcagctcccacttatgagtgagaacatgtggtgtttggttttctgttcctgtgttagtttgctgagagtgatggtttctggctttatccatgtccctgcaaaggacatgaactcattcttttttatggctgcatagtattccaaaaatgtatatgtgacacattttctttattcagtctatcattgatgggcatttgggttggatccaagtctttgctatcataaatagtgttgtaacaaacatatgtgtgcatgtgtctttacagtagaatgatttataatcctttgggtttatacctagtaatgggattgttgggtcaaatggtatttctggttctgcatccttgaggaatcgccacactgtgttccacaatggttgaactaattttcactcctaccaacagtgtgaaaacattcctatttctccacatccccttcagtatctgttgtttcctgactttttaatgattgccattctaactggtgtgagatgagatctcactgtggttttgattttcatttctctaatgaccagcgatcatgagctttttttcatatgacaaaaatatcttataactaggtttgattctagtccagtatgctttttgttataatatgttacttaaagctcagacaggaaatgcaattctattttggggaattaaaattagtgatgtggtggtcataaagatgtgggaaaacttttaggatagtagaagctattgtccttattaaggtgtacaaagaattttggacctgttttttttttttttatttgattttcaattattttctctacattgtcattttagcccattgctatgtcaaccagtttcagcttgccctatgggggaaaaaagcctattaaagaaattctttacatgaagaattgatatctctgtgtttatgaatgtaacactttcagaagattgcactgaaagcaactatatttacaaggcttatctgtcctgtgtgtgtgtgtgtacttatcctaatgttgttaatgttgtttctcattcagagccttgtgaagtgggactgctacacacattttaagttaatatcaaaacacacccacaatgcttttggtgaaattgtttcatgttgccaagtatacatatgccaaaaatctcccctctttatcaaaacagatacgatagttacagtagttagtcattgaagtagctggatatgtgtgccattcaccttcataggaatcagagggattgtaagaatgaacttgagaactgcattcttgccatccaggaactagggttaggattggaataagtaatgtgtgtagcaagtgccagccaaagagaagggaatcactcactatgcatgagtcctggggaagatcagagcactcataaaaggcatttgagttagatcttaaagaatttgtttactatatttaaccatattgatcttgagaacaattcctttgtatttcttcctcaaaaatgaactaaagcagataaagtctttataacctatgttttcaagtatatgaaattactatatcatagtctgagaccaagtgtacaaatatgaaaagtggagatacaaagcaattttccacttactgcaagtcagagcaatatctgtctcaattgtcatgagattttacttgaacatgacctcatctttttgtcctttcatgtgtggtcgacctagcttcaaaatcattgtatagacagtacattttccttatattgttgcacagatcactggcaattttgcatcattgaatgcaacattgtatatcaaaaattggcatatataaattatatcactgcacacagggcagacaaatttgtacacattgttttgcatctatttgtatataccattgacattattgcctgtttaataatagattttgttaatgcacagataataagtacatttcttttttgctattctgcatttttttccagtgatgtcttttagagctgagcctctgccccagaaaataatgaagcttcagtaagagtccctgaggcagatggcatggagatgttatttgcatccctaattatttggttaataaacaataaactatatttagttactagttagaagattttcattttgtaaatgtacctctgacccttttctttcttaagtgaatgaaacagtaataaataactaaagctgttttttgcacaaaatgctagatagagactaggatttgagaatctatttttaaattcacttattgttacccacttagctaaaagccactatgtgagttaaaggaatatcctgctgtaaacagttccatttaaattcttaacatttctactttgaattgtggatcctctcagccagcttcccgggtccctttgaagcaggcctgtgccaagattccccacctctcatggggaactaagcaagtccattcttattcccagctcatcagaataccctgtccactcactctgctgacccacataagctgattgctccctgatgtgtggagaagtgattgtgataatgttcacaggaggggatgtgctaatgcatgagtgataactggagcccggtaaaacttactgagacagaattctaagcagaattccacactcctttcctagtgtggtccactctgagtgctagagttttaatacaatccaaggatttctccaagataattgttaatgacttaattttatgaggattttatttatgtaaacaatcaaataatttttaagaatgaatgaatatatgtatatatatatatatatatatagagagagagagagagagagagacttgagtaagaatatctgcataaaataaattaagccaagaataaaatctagaataaatacagtaactgctctggagaagtctaattctgctctactggagatacaatgagaaccactaacatgattaaggagatttttttcaattacaattcaatttgccttacataatctctgtcgttcttatatgtatgcagctggacccaagaattttccctcctgtttcagggatgttatttccaggatataattaattaatatattcattttttactttattcttatattcattttgtagatattgagtgcctattatgtccagagaaccatgctaggcagtggttattaaataatgaatacaaataatttcttgacttaaaaacaatgggcaatcctaagagtttacttagtacttgttcagggtttgctacaaattccatgatttaactgattttcttattgatatccattctttgatcttccctctaatagaggggcaatttggtaacctatatcactattgtatgtttgagctttgaagcattttgtagtctatatacttactttctgcatcttcaccgagtaatattccttgtgatctgcgtggacaagaatgtttttacttttttttttttttatatcagagagaataacatcttgagaatgatgacattttctggacaattccagtgaatgggcacttagctagggaagccaagaaattatgcctaattaactatgctatttccaaaattctgcagacttttactaagaatgcatgccagggatgaaaaaatacaaagtaaagcagtagatttgcacccagaaaactgacataacttttcctttctttgcaacattgatatttgccttcaactgatgaaggcttcgatcttgatttcaattagaaatgcagtgaacaaagagattctagggaatacatacaacatgaagctcctcagtcttccttacaggggagaactacacagcagcttccaaatagttgcaaagacgaacatgacttcagtgactttgactagattatattatttttattgcctttatttttcacacataagacttcatttctgtgaataaaatatatgacatatctggttttccatatggtaaaatctttaaagattttttgtacattctctaaatgaataaattggattctcaagtataaaaacatcataaaaattgcttataaaatattctaaaagaaaccctgagtagctggcatatagacgtgctctacaaatatttgctgaatgaatgaaccaggagaggtatttatagtaaataaggaaatgaccagactcattaacaataaaaattatatacagtcaagtgttacttagctgaaataacatggtgtaaataaatggtgtaaataatatgccccctatattaataaaacagatgaagcaaaactgaaaataagccaataagaaataaaatccacttgatagttttgctaatgattgtaacataatagcttgcattttaacttacattttaaataaagaacgcagtccaatctctcaaattatggaagtttttcttctaaaataattctgataactagctttcatttgaatatctccagtagtgaagagctcattacttttatgggaatccattctattgttggtaatagttatcctaatgctttaaaaatattacattgacatctgactacctgcatgttccttttagaaaaagtttaatttagaaaaagaaaaatactactacctgagataacacacaaaggtgtattttctcttggccacagtattttcaggacattaaaaaaataagattatacatcatttatactgtttagtaagtgagctttcaaattacaggtcatgtaagtgttcaagatgttctaatcagacctaattgtcactattttacattaaacttgtatacatgtctaatgtaaaacaatgtgtttaaaataatgtaaaataagggtatgtttgtttttacactctggctcaggctagcctctgtgtatatcactgtggcttctgtgtggagcaagaacttaatcaaatttggatttgcattcacattagtttcaccactatctaggctttacgtagttgtaagcaactgtttagcttttgggtctggctttcatttttcttgtctcttataatcttagggtaatatttgacattttaaaaacaaattaacatccttaaatcaaagatcttaaaatataattgttgtgaaattccctgaaaataatttacatattttttaaatacatgaaactaaatgacttgctgtaagtctgtttctcacaactgacactctgcttttcctgtgaagaaatacataaacagaagcctcagctagacagattttcttttgtttgcctaattgccagaaggttaatgattttcataatgccatttatgtctggatattatcagcactgtaaaaaaaaaagttctaataacttttgttagtgtagtctgcagaaccattgaaggaacaaacatattgtataaggaaactttttgttttctcagcaaagtgtttcaaatatgttaaaatcagctcaatattcagtattattatttggttaaattccagaatggaaagaacttgtagtaaaatgattaggctatgaacagacaaatgcaactgacaatgttaagtcgaaaagtattttttttttacttaattgaagcaaaatattaattttaaaaatatgagttagagctgaataatctgtagacataaaagcacgtatacttttagaatgtgtgatgttattgttgcatcactggaaaaccttacgtgtttattcttttgaagagtggaagatggaatttaatttactctttaactttctgttataaagcttaaccgtctttagtctcttcagagcaatgttacgagattgagtttccacatcattctggttattcttcttgaacacccttagttttaaaattatctttcttaaaagattgatctcataagattgaataccttgtcctatgttttatagcttataatttttcttttgtggactacctgttaaagtcttttacccattttttattaggtttactgattgtttcttattgatttgtggggcttgtttatacattaacaaaaatgaatatttttgttataggtttagaaatatcttctcccaatctatagttagccgtttaactctctgattcctgccttttgataatcgatgtctaattttactataatcgaatttatattttcctgtttagctagtacattttgagtcctgtttaaaaaatctttcccaaccacaaaaagatgctgtatgttctcttccagaaacttttacaatttgatctacacgttttgaccttgatttttgagtatggtgtggggcagaatcacttctagaacaatttattgtgggggaaaaggacggtgatttttgaaaaaggaaacaagaagagcttgtggattgctggcaatgatttctttatagatctgggtggctgttacactgttatgttcattgtgtgataattcctgatactagctatttatatgtttgtaatttgttcatttatatatatatatgtaaagactttataaaaatgcatgaaaaacatatctaataatacattgtaaatataatattctacttagatgtcataattttaaccctgtatattatttcataaagtaaggttacataattctttctaagcattagatacctttaatcatgaaattgataatgcgtttcttcaaaatgagtagctttgtttattgttgatgttaaaacaaactgtactggtataggttcaggtttccagccagtgaaaaacatttacatcattattcagtttgttatcctattaggtttcttttccaggtttatataattggcaaatttcataagcatgtctttcatgccttagagaataaaaatattaaaaatgacagtatacaggatgaaagcctgtggaacatcattagagagcgctcttcaagctgacatcaccattaatcaacgtatttggggcacgataactagccattttttaatctacctaaaactgttatctcccagcccacattttactagtttacatttgccagatattttgtcaaatgctttgcaataattaaaattgaagatacatctatggaatttatgctgttctattaaacaaggactcaattttataaaaggaaatccttataacctaccactattgcctcctctatcaccagaccccattcatctttttcctaaatatttacaactcacatgctagactttaaagaggatctctcttgttatttttcccagatgtaccaacttcactgtttttaaaatttatggtttttatggtttttagtttttgactatctttctttttttggcagctcctttaataaatattcaagaaagctaagattacatttatggataatgccagtccttggggttataatctgaattcgaatgcttcaaaaagttaaaggaacaggccaggcgtggtggctcagcctgtaatctctgcactttgggaagccgaggtgggcggatcatgaggtcgagagatcgagaccagcttagtcaacatggtgaaaccgtgtctctactaaaaatacaaaaattaactgggcatggtggcatgtgcctgtaatcccagctacttgggaggctgaggcaggagaatcgcttgaacccaggaggcggaggttgcagtgagccaggatctcgccactgcactccagcctggcgacagagcaagacgccaaaaaaaaaaaaaaaaaaaaaaaaaaaaagttaaagccactttgtctgtcttattatgtcttagcttgtctgaggaggtatttgtctatactcagttagtagttttgctacttctagaattatttgaaactgttgtctttgttggtagaaatgggtgacaaacagtactattttcctgtcattaaataatatctgatagtattatatcttctttcttctgttttgcttaaaaaatagctttcaagctcttttgtttgaaccttatttatataagtattaatttatcgatattttaggaatgattgggccactgccaattttcctactctagtttataacagatgttgattaatggatatagccctcttccctggctactctaatcaacaaatatctgcacttggttgaagcctgtttatccacttctcatagatcacatgacctccttgcagatgtttatcccccactgcaaataaaatctgagctcattaacgagttcattttagcacttattaagatgcctgttactgtttttgtatcaattagataattctccattataggcttaaactcatgttacatattattttcaatgttcagaaggtcttaaaattcatggtgtcatgtcttttttagttttgaataaaaattagtttttcaaatgtttatattctgtgcattggtcttagtctagaacttctcttagacttaccctagaaacttccaatttatccccaatatcttttaactactgcaaattttaacaggtttactgatgtataattgatatacattaacatatatatttatataaagtataatttatatatagtggtaaattttatatatgtacatattaatatatatcaatatacattatactatgtttagatatttaatctaatatattaatattaacttcaatatatttattatatattatattttatatattataaatttatatgaatatatacactgtataatttataaatatgtacgtgtgtgtgtatatatatatatgtcaacatggaaatattaccttttagctcactaattatttcttttcaggctggagtacagtggtgcaatctcagctcactgcaacctctgcctcctgggttcaagcgattctcctgcctcagcctccctactagctgggattacgggcacccgccaccacgcctggcaaatttttgtatatttttttagtagagatggggttgcaccatgttaggctgatctcgaactcttgacctcaagtgatccacccgcctcggcctcccaaactgctgggattacaggtgtgagctaccatgcccagcttagctcactaattatttcttagattatatataattggtagcctttcctcagatgagtttattttcctatcaaccaacttttgcatttctaaaactacttcatagtttcttttagtatccatctataaatgttttatttttccctgttgtaactgataattactgctatttttaatgaatagcattacctattttatatttttgagaggataaagcctatttatctccactagccctcaattgctattacttatggaactaattggtgttgaacttttgactttgttgacttcgtggcattggatttcattcctgtcatttgaaattttcatttgcatgttcttcttgacagccagtctctctctttctggtctctctttctctttcttctctcttcctatctcctctcatctcccctgttttttgtgctttatcattttgggactttctctactcaagtcccagaatgtccagtctgaaagtgtaccttacattactcgcccgatgcctgtgcctggcagtgtttttagggaatcatgtgtctagtcaccaagccagtgaatgcctttactcagctcagatatgcctatttgctaacctctttgggcatacagcctcatataatccatatgtttaagtgagtaatcagctttcttcagtctcttttcacaaccaggttagccgagggccagtctcggtttgcaaccttaaagcaagctttctgtagctgatacacacagggaacttacattaccaatattccgtagtagtcaaatgcccaaatgcctttgtatgtccccagatccggactctgtctggcctcggcttcagccccactcattgctttgcatgtttgttgcatttcttgtgcatagagatgtttatcttattttttgatcctggctatgtcttttcaattttcttcttatctatcttatctaaaaatacagtgtatttgaagcagaagggggtctcaaagcctgaactcataatgcaattttgcctggagtctccttttcaatttatttttttcagctgatacttatttctcagccagttattaaaggtagttctaaccctaattgaatttttttttcaccttgtatttttgctaaattagaatccaggcatatagtctctggtggtgttaaaaccaccaacttgagtgccgcgtttcttcaggagccatttatcactacaacagaaactccatggcctctctaaaccacccactaaattcctcttttgtctgacttactgaattacaaattacaaagcaaaaataactcatattagtccagagtactagtttcttcaattattcagattctctattgtaatggatcactctaggagcccacatagaatggacacgtagaatacaaacactgtatatctttacagcatacgtgtgctcacaccatatactacacacacgcaaatacacagggggaggaatatctgtgtatgtgtgagaataaagagaagagtgaggaaggaaagacagatggaggatgggaggggtgggaaagggaagagagagcacagaagaagagagagaaggggaatgaagaaacagcattcttattgtttcgagactagcaagagttccataacaagtatacatctttcaagttacttcaacaatacactagttatttgctagatgttttaggcactattatctctaggcaagtgttcttcttaggaactaagagtttatgactgttcagcatctccacttcttctaactcctctttgacgtccaaccactttctttgagctgctacaatacattgggaacttttttgccctcttatataccacattccagaggtggttgtgatgaaagaggtatcattattaatcctcggatcaatagaggttacacatttcacaagccaagtaaacaaagtaataaacttccccgaattgcattgcttgatagaccaaagagaaaaagggaacttttcatcgatctttccaccatgttcctcatgaaagactgacttttgccctccccttgaggttaatcactacagtattctctccacatatatttctgctaagaaatacattttgacttatatttcttctgattttagatttttgctttccttaaagttaacaataaattctattttgctaaaagtaatgagataaatgggattaagcagctgtatgttagttgcttgcttgctgaaagactggaatgcagcaaacaataagtaactgaagaaaatttattctggagcattcattagcaaaacagaggaaatagtctaagtttcaccaatcaatcagacattttctcacctgttacctcattgtattaattgctcgttgacttgagttcactcaatcactctgttgcttttggtaatacatagaactctgtatgaaattggctataaaatttcttcaaggtttcgaactgtatatctaacaggtaagaaaatatatttgttaccccacaataactgagtatattgttgtccccaaaattaacctacagctctttcaaaattttatggaattctaggtaaaataggaagatgaatgatatatgacaataaggaatattatatattaacactacaataggaaaaaaataacatataaaaaacacactacaaagcaggtataagtaactcattgttagtaaacagattatcaggaagtggtcccaagaggtactgcagactagaatctccaggatacacatcctgagatgaaaaatagcatctaggaagttaattaggagtgttttggggatgaaaacctgtggaagagaaaggaatgaaacagaaattagttacagggaggagtttaggtgaaatgcagtttcaatgaagtctttgaccaatccctgcagggagctctgagactgtgaagacacctcagagtttctacaggttggggcagggtactggctttttatagccccaggttgaccagtcgttgcagttgcacaaccccatgaaggtataccatctacatgtgcctctttttaacccaggaaattcctgaagaggaattacagctaagtactgtatcatagaaaaaatattcttgtaaaagtgtgaattatatgataatagaaactgagaagtagttacatcgtttgcacatatattccatagatagcacccatataacctatgcaaacacatacactagatacttaaatttttccaaatgttttgtgagatatgatttcgatatagtgaaaggtacagattttaaatttgtatttttttttaagagattaatcttgggcagggatcaacaaacttcaaccctctgtccagctacaagcttttgttaataacacttcattataacatggccatactcttttgtgtatgtactgctcttcatactataatagaatttggcagttttaacagaggtagtatggtctacaaagccaaaaatacatagtatttaaccttttacagaaaatgtttgctgacccttgatctagggtttgctattttcaagtaataccacctcatatgtaaagttaagaccacagcataacatatttcctgtccagactcctatcctttgtactattgtagttgcatatctgacttccacatttattataaaccctgttattcatcattactgtttgtaagcactaaattatcttttaatgaaatttaaaaacatgaacaaatattttatatgtacttaacatgtttagcattttaagcactcatttcgtcatgtaaatatgagtttcaaaatggtaaacttcccttaaggtgaaaaacttatatttttatagtatacacataaaagtgatgaattctcccagcttttgtcttgaatattacgttatttttatatttaaaatatatttttgctggacatagaatttcaggttgccagctttttttttatctttccttttcatcatgtctgttaggttgtttcattgtcatttggcttgcattatttctgctgagaagttgtaaccctctgaatacctttaagattttctctttagcatcgtctttcagcaaataattataatgtgccttattgtattttcccttgtatatctcctgcctggaattcaataaacttctcacatatctgagtttatatatttcaaccattatttcttcaaacatattttattctgacccaatctctgtcatctctgcttgtagtactccacttgcatgattgttagggcagttatcaatgtctcacaacttactggaataactgtttattttttaagccttgtttttcctctctgagcttaatttagatgccttatatggccctacattctagtacaatgatgttttcttctgtgtctcatctgctgttaagcccatccattaaattttctatttcagatgtaattcttactcctaaaatttccattttgttctcgtttgttgcttttctccttcaacattttgcatttttaaaaaatgtttatatgttttattttagataatagaattaataattactgtttttaaagtcctggtctgctaatttcatcatttctgttattttggggatacatttccattgatttttttctctctggttctaagacatattttcctgcttgtccaaatgtctagtatatttttcagttgatatacttgacattatggatgcaatgttgttcagtttctaaatgtttatgactttccttaatggagtgtcaagttttgttccatcaaaaaattaatttttggtcagatttatctttttcagtaacctttgctcaggtgtgtccagactagccctcatattaggactaaaatatccctacatataatgcatgacttttatgggatgtctactgaatgcctggagggattcaacaaggtctctcaattttgtctagtctgaaatcaaatttttcccagctctgtgcaacctctggttattgttgacttcagaactccctttacctggtcttgtgcagtcttgatctaaaagtgcacagcatggtgtttcttctgagtccagattgcagagacacattcatgactcccttgtagatttctaaagcactttacacagctgtgccctctctgggactctgtcctgttaattccagcttctttagtagctttgaattgtaatatgtttccgtttcaatgacactactgcactgctgaactctgtttgggatcatcttccatatgccatgatccagaaagtgaagctagcagaaagccaggaagttggcagggctcaccttatttgtttatcttattttatggatcacgtactgcactgcccattgtccagtccctaaaacagtgattttttaaaattttattttattttattttttgagatggagtcccactctgtcactcaaactggagtgcaatggcaccatcttggctcactgcaacctctgcctcccaggttcaagcaattctcctgcctcagccttcccagtagctgggattacaggcacctgccaccacgcctggctaatttttgtatttttagaggaaatggggtttcagcatgttggccaggctgatctccaactactgacctcaggtgatccacctgccttggtctcccaaagtgctgggattacaggcgtgagccactgagcccagtcagttattttatatattttttagttttgtaattttaaaaaaagctattctatcatagttttaagcaaaaataggccatgtaaccattattatttgaatatctgtgatgatttatgaaatgattattatgaacgtcctcatagaataaattattttgccagcctttaaattccttatttaaaaaatagtacacacgttttgatatactgtacattggataatctattgaatatttttatatcattctctttagtagctgaactcactgtaaaaattatagtgcctcttagcactaacattatgccatattttctgtaacttattttgtgtacaaccctagttattttaaatattactgtaaattaagaatattgatctatatgagtgccatttttctaacaaatgtttttacattcttactatttgctgagcaattcttatattttgccaaaagagatttaactttgtttagtatctaatttttctagaaatatgacttacaagaggtattgactgtatatcttctaagtgttaaataaacattcttcctgatttcctatatacttccctgtacctctcagtggtacaggaaattaatgtaagattaggttcattttaagaattgcaaatatttttctactttacttcacaagaaaaatatattttagaattgtgtataattgcttgtttttaatttataatttattaaatgataaagtttacatgacagaaaaaattggatagttacatacatttttctcatgattttagctgaagagtttatggtaaattggtcaaccctcagccaattagactttgacatgtactaataagatctaattgaggaattatgaagacatttgctcaggagaaaatgagcacataattacaccataaagaggttaaagaatcaatgttaccagctggaagaatattagttgaagtcccaatggcatctataaaggatatttcataatatatctgtgaaatagagcactgccaagaccaattaagatatgtagaatattccattgtcagttgtacaagttcaaatttaaatattcattttcccatcttacctctgcccatcttcaggtgctgggggatggtctccatcagacagcgaccattatcaatggcttcaggttgactttggcaatcggaagcagatcagtgccattgcaacccaaggaaggtatagcagctcagattgggtgacccaataccggatgctctacagcgacacagggagaaactggaaaccctatcatcaagatgggaatatctgggtaagtcattggcaggaaagcaaagacacagaattggattggaaatattagaaaatggtacaggatttactaagcatatatagttatcaatatttatgtattcaaatcattgggaaactatttattcatcattgttgatggaagaaagtttcttcaggctgtaatttctatccaatggttaaagcaatgattctagatctggactatgaatttgaatcacctgaggaagttttaaagcacgtagatgaaaggcaaacccggatcaataagaccagaatcacgtaagttgaaatagtgattaatgatactgataacttttctgaagacagcgatcttcaattgaaggaaaatattgaaattatgaagaatataatttagagaagtaagagcagtgatagatgttaagaaaagaacttgtccattttataatagtgtcttaaacacttattacagatctatgttcactttattcctttattatgaaagaagagaataaagcttaacccatttgttcttaaaatgtctctattaacttaaaaagttgtatatattcaatcaaatattcaccacataataatttgaataaattatttaacagtaaaatttaagtgttctactttgtttaattattttaaaaagcaggcatgaccaaaatcaagtgctgtcatcaatattaaaccagaagaagaagaagaaaaagaagatgaggaggaggaaagggagaggatgaaagggaagggggaaaagaaggaagaggaaagggttcacttttaaaatcatgtccttcacagtattagttggagtgctggatatttttaactttatcatgaatcactcttgtagactttgtattttaaaagtccccaattattttttctaagtaacaagagtttataatttctagctaaagtggatgttcatttctacagcagtatgtgaaataaggatataatgtcctgataataaaaaatgtgtctacttaagtagaactttagaaataactcctttcaagtcataattatatggaaagaatatttgtgtattaggatgtataagttacggaaagcaagtagtgggaaaaatgcctctttctaaaatgtcttcatctcgcaattgagataattcaaatcctcaggcataatttatagaaaagtgcttatcaagcctgaatacacagtagaattagctagagaactttaaaacatatagacccttgtgtcccaaccccagagacttgaatttagttggtctaaggtgcagcctgggctttgggattttaaagctccgatggtgatgctaatgtacagtgaacaccgaatacatagtttagattggttttcagtctacagttaagaaggggatagaggaagtatatgctgaaaatgaagaggagaacagaaaatttgaaagagttgcccttaaaatttggcagagagagagaggggaagacggaggagtaagggggttgggtggggggaaggggagggagaaatcaagtggccaaccaaccaaacagcagaccaaacaactgagagtaaacagtgaaggcttggatcacagacccttctaacacccagagcactcattattttctaactttctatggtttctaaactaagatcaaatgagcatgttggtaaaattgcttgaggggtttactttctgtgatttctaaactaagatcaaattagcatgttggtaaaattacttgaggggttacaagtcagactctgaaatactgttctctatatcagaacagaaatactgttcacatttttgtatttgtaaagtcttcatctcaaaattaagagtgttcaaatctcctctcctctcataatgtgccaagatagtaataaagatagctgctaaaatacttgaactttaatgtatctgtcaaatactgaacagttaaggacggctaaatgcagagacataaggaaaaaaggctaaggaggataaaattgttcagcttgtcttggagtcttttttttttttgagacggaattttgctcttgttgcccaggctggaatgcagtggtgtgatcttggctcactgcaacctccgcctcctggattcaagccattctcctgcctcagcctcccgagtagctgggattgcaggcatccaccaccatgcctggctaatttttttttgtatttttagtagagacagggtttcaccaggttggtcagtctgctcttgaattcctgacctcaggtgatctacttgccttggcctctcaaagtgctgggattccaggcgtgagccactgcacctggccttggactcttgatattacatagaataataatggttgagtcggggagacaaggatgtcatgtagtgaaaacatcacaaattatgaagatatgctgggtctacttatagggctctccatcttaaggtgataaaggtgcatttctattgtcttctccctttctggtgttcactttgtttcttcctttcaaatattgtgtttcttattaaaaatcagtatgctacgtgatgagtgattattagtagtgagctcattataaaattttaaaaatcaaaacaagttggagactatgttagtctgttcttgcactgctgttaagaaatacctgagactgggtaatttacgaagaaaagagttttgattgactcacgtttccacaggctgtataggaagcatggctttggaggcctcaagaaacttactatcatggcagaaggcaaaggggaggcaggcatgtcttacatgccgggagcaggaggaagaaagagacgggggtgtcacatacttttttattttttctgagacggagtctcgctctttcgcccaggctggagtgcagtgacgcgatctcggctcactgcaagctccgcctcccggtttcacgccattctcctgcctcagcctcccaagtagctgggaccacaggcgcccgccaccacgcccggctaattttttgtatttttagtagagacggggtttcaccgagttagccaggatggtctccatctcctgaccttgtgatctgcctgcctcggcctcccaaagtgctgggattacaggcacgagccaccacgcccggcctgtcccacactttttttttttttttttttttttttttttgagacggagtctcgctctgtcgcccaggccggactgcggactgcagtggcgcaatctcggctcactgcaagctccgcttcccaggttcacgccattctcctgcctcagcctccccagtagctgggactacaggcgcccgccaccgcgcccagctaattttttgtatttttagtagagacggggtttcaccttgttagccaggatggtctcgatctcctgacctcatgatccacccgcctcggcctcccaaagtgctgggattacaggcgtgagccaccgcgcccggccctgtcccacacttttaaacaaccagatctcctgggatttcactcactgtcaggagatcaacaagcgggaagtccacccccgtgatccaatcacctactatcaggcccctcttccaacactggggattacaatttgacatgagattttggtggggacacagacccaaaccatatcagagacacaatctaaatattgcaaaatatatttaagtaccagtaagcctgccacataatgattacattatttaataatctgtgacagaaatgttttaatccttactaatacaaaaaaaaaaaaaaaagagtccaatcctttgacgtattctaaaagagttaaagttcgttgacttctaaaaattcttgaatattttagggctacgtcttatcattcattaagtgattaaaatttagcatttacaaatttcaaaaaaaagtactcttggggattaagtttattaaaaatgatattaaatactagagttttttaatccactactgcttaacattatgtatactggacttgaagagaattctgatatagagaagattggatggctttttgatggaaaacaccttacaagatgtaaaaatttatgtatttttgaaattgtttttactatccattttataatgattgtttacctgagaaatatagaagataatgtatattgaatcacatgaatataattttaaacaaatgtccatggttatgtttttctgattgttggggaaatggacaacataagtaattttttatagtattcttattaaatgttcatatggacattccgagttattttatcactgttggataatatattaaaataagcaaagaacaagtcatatataagcaaattatgacagtttcacaaggttttagagtcatgaatcttgcattagggagtgagaatggctcctgaaaagattcctaaagaatggtttatctgaatatttaatattcaaagatctgagtttctaaatgggcttaactagtcaaaccttccattcctctttgatgatactgagcataatagaattctttatattttacaatataatttccttctatttagaacctcttttccaatgtaataggtaaataaaattgcccaaaaaatcattacatctacatactccaccaactctaatttgcatgattatcttgagatgttttcaagtttcctaagtataatctgttagagagagagagaggaagtattctgtataagcattttgtatcagaagtccattaaacattatattaaataagaattccagcaggcttttgctaagaggcctgttttgcttgggaaattcaattactggattttgaatgcagatattcggagccaaaataggaaactggagtaaaagcagtggatgccttctttacacaccactattattttgtaggataggaacatactacaaatttaccagtcatatgagcgcagtttttgtttttctttaaaaaacacttcctaatcatgaaaacatgcttgtatattctcagttatttttaaaaacagttttgatccattttgttaattttaagtaggtgttagactgaaatttgttaccactgcatctattaaatggagaattctacagaacacagctgttttatcatatttaaattatatggttagatacttatcaagaatatagggataaacaaattcatattatctaagaagtattaaatagattacttattttcaaaacctagatctccttgtcacatatacgcttttcccatgtacaaatgcatacacataattgtttcaataaatttaaaacatttcaaaaatctagaagacaaatacaatagttggcagtttcatttatgaaacatttggattttctgaatagcaaggcataagctggaccacgtattccctactttctttttaattacatattccatcaaccagtatttataaaataaaagttctcaaaaacatccttttgagttagcctgtaattagccatcaggcaagtgaaagccaagatatggagtcgaaaggtctgaattcatgtatcttgtttcatttgtttgttttataaacttggagatctgactttatttctctgttcctgaaatcctaatctgagaagtagatataattcctattgggatatttaagtgagattatgtaagtaaagaaatttttcaagctattaagattagaaacatgtgtgtcatcaattcccaattttagaagcattctccaaatctagtgtagtatgttttttcagtgacaatagtcagtaatgacaattttcagaatttttagtcaccctctatgtttttcagattccctttacctctttttactcttattcatgattgaaaatatctgacaatattttagattaaggaaatgttacttaaagttggaggtagaatgtatgcaaatctctgtcataattttcgattaacacatggtaaatacatgtttagatagtgcagtgcaggctgggtcagtgaggcatgacaggtagacctagctctgtgccaggtgccattgcagtgcttgtaacaaattatctgttaccatcatgatggccttgtgtccaatgagccatttaaggggacactgtttagaaatgaatggattgttctgtcctttcttttcagccatttgttatagtggttgcactaattttccaaatcacttaaaaatctgttcccagtataaatataaaatataaatgccattctgttacagttcaatggtgtacttagattctttcaaaatatctagaattttgtctgcatgcgaaagtcaggatgacaaccatcctgtcgcctgcccctacatcttccatcggataataacttctacttcacttaggacatgaatgtgattcttttccccaaaagatgagtattacccttgcttctttatgtaaacatctacattcctgctgccatcagttatttgggtaaaggatcaggcagacatattcataataattttatagatagcttattgagaaataaaacacatcagaataatctgcatcaaacaaacactttctaaaattatctttgatataaatggggtaaaaatcttcagaacttgtatagaaaaaaaaacaatttccaaggcgatttcagaataagctccttatttctgtgaaatagatttttctgtttatactcctcttaggctggataatatttttaaagtctcatgaattttaataagttgagtggatattccagatccttttgcatatactgtaatgcatctactagtgaattttgatcacctttctaaatacacatttgtatggtgagattctcattttcaaaggtcatgaggtttcttgggacaatttctgagactcaatattgtacataaatagaactgttctaacaaatatggttatgtgtttaatatttttctaaaatttggaagataaaaataagatgctgttgataatattgaatatattattggcatatattatgagataaaggaaaatgttataatctcataagatttcttacaggctgtaaaataacagtatatagttcttcacagtataatgtatttttcatctatgagataaaataggatatatgtaattattcttctaatgtttaaagtatccatgaaacaagatttgttatcaattatactaatattttcaggtgttttattttacattgaactcaatgctaattttttttacgttgaactcaatgctaattttttttacattgaactcaatgctaattttttttatcgtgtcaaggttggatttaggttacctgaggctaaataactccaagtaaatacatagttatataatgtgttgataaatgggtacctacaaataatttgaataagatatcagttccttcttttaagatgtatgtttctactctgctcaagtggtaacttagaggaatactagtatgcttattttgggaaatttagggcacagtaaatcatgcttcttatgtgcctggagacgcctgagaggccgtggaatgagtaattctatgttacactctggaatcagaccacctaggcagattatacaattttggtaacatagatctgtgtatcttcacgcagattctttaagctttctgtgcctaaagttcccaacctgtaaaatgggtctagtcacttacctgaatagtatttacctcaatggaggttgtaggtattaagagaaaaagtcaaacaaagggtttagagcaatgtctggaacatattaatcactcaattattttatacatttgtgatttctaggtgcattaacatagtatattggctcttttcttgaaaatttaaaatagcctgttacttccactttataataacgtttttctattagtgtattggtgtgtgtactgtattacatacatctgtgtttcccagcctggaatgacaaatgactcatttggaagtataattgagaatgctaatttatgccattcaaatcttgggcctacttattatcacatcgagtcctatgccttgtcatatgaattgtgcctggaaagttttttcagatatatattttttaatgaaacttcagtgaaaatatgactaggatgttttcattagacttagtttaataaattcacttgataaagtgcgttaacttcggaaagaaataacccatttttgtctacagtacttctctgtgtcttcttaggccaactgaaaagggtaggataagaagacttgaaaataggcttataagtattaactaaaacagtttatgctggttagccatgaaaggacaaatcagctgcaccaggaacatccaggagcttgtcagagatgtagaatctcagaggcttaacccagatctactgatcagaatctacagtttaggaagactcacaagtgattcatatatacctccaagatagagtgtgttgcttttgatatttgaagaactctcacgagaaagaggaataagcatcagcatttgtgtttccaaaccagaaggtagaattagaataactggaatttacagtgcaaattgcagacagatttatcgtgaaaaaagagtgagctttgataaataggcactcactgagcacctactacttattgaggctagggataaacagaccaaaacacaagcataattgctgtcttctaggggtcaataaactggtgataaggctaaacatatacaattataagtatattgtatgactgttcaaatagagaggtgcttgcctaggttgttttgggaacactaggaaagtggtcttattcagagtggttgggtccagcaaaggcttctttggagctacctactattggctaaataggtaaggagttggtcactcagagaagaggggcaggaagtcattccaagcagatgaatcttctgctgaaataggtaggaatggagagtgggattctataaataactgcgtttttcctgactttctgacatgcaacaaaataaaaagctgacctttatctatttatttagagacagaatctcgctctgttgcccaggcttgagtgcagtagagcgatttcagctcattgcaacctctgcctcccaagttcaagggattctcctgcttcagcctctcgagtagctgggataacaggcatgcaccaccatcccatgctaatgattgtatttttagtagagacgtagagacggggtttcgccatgttggccaggctggccttgaactcctggcctcaagtgatacacccacctaggcctcccaaagtgctgggattataggggtgagccactgcacccagcaaaaagctgactttttaaaataaaaaaaactctgaaattatatcctgtgaatcagtaatgcttaatttatataatgtaaatatctaattttggaagaaccttggagtttatgcagtcgcctagggcacatttttatctctgtgccattcatcatatagagctcactgcagagcacaaaacagatgtttatgagtttacaactgaactgaagtatctcattctgtagatgaataagctgaggctgagaaccatgatgtcccttaaactggaaccttgaatccaggtatactgacctcactactgaatatggagccaaatacttattttggttcagcaagaagttccattactataatgaacccctgctcattttgagtaattgaaaatactattgaatacatacacgatatttatagaacaagatagcatgggctctggaccggacctcaaatatctgaactctgctccaacactttctcgtggtgtgtatttaactatgttaatcaacctactatgggtcttagttgccttaggtgtaaaagcgatataattgtatttaccttatgcgatttttgtgagaaataaattaatcaaaaataaattgtttagaacaatgccccataaatatagtctcttcttatcgtcctcttgtttcactttctcctatttatcagtattattacgaatgctatcattaatgtttctcaaatactatattcaaagtgatataaagaatgcaagtaagtagttaatagtaggtctagccttgagaataatatattttaattggaaggacagcaaaaatcactacaataactttaaacaaaagcccgggtcatcttgcacagctttcaggatgcttatgcccctggacaccgtgaagatacccattctatgtgtttcacttatgcatactgttttccaggtagctaatttagtcagtgttgactttgggagagaactactagaatgttaaaatgtcttggcaaataaatttggtttgcttgagttaaatagcttaattataggctgcagtgaaatgatcattctggcaaaaagatatagtgctgacaggctgtctgaaaggttcattcaccatctatgccttttcagaagtctagagcaagagtagagaatagactttggcttctagaaaaaattctgtccatttccaaatgaaaataatgtttgagataagtatctgcatttctccgatgaacttcaccaatatattttgatgagacagtgaatgggcctattgtaattgcaatttaaatgctttataatgatattaatatgcagcttggaagatgtctgtgaaaactcctgtgatttagcagagaaattcagaaaacttcagctgcacaaattaataaataataacagccaaccaacacttattgggggttccttaagtgtttaatgtgctttatatcatttaatcttaaaaacaactaatatgtgaggatatagattattatttttatgattaagccctatttttggctgcagaaattgaggattagagaaagtacaactttccctggggtacacggtgggactgggtaatggatgtgttaactaacttattatggtaatcatttcacaatatatctctgtatgaaagcaaaaaaaaattgtaatggttgaataaatatcacatttcctgttttaaggaacatacccgcaaaataaaatacaaataaaaataaaaaaaactaaactaaactaatcaaacagtggagctaggataggaaaccaaagctacctaactaaccagcctgtgttccttgccactatggccctggtcagccattcctttcacaggcaatgtgaaacttagtgatctctgcatttaaactgtaatatagcgcttgtatataagatgttggtattttatttattttttatttttatttttttgaaacagagtctcgctctgtcacccaggctggagtgcagtttcccaatctctgctcactgcaacctccgcctcccaagttcaagcgattctcctgcttcagcctcctgagtagcttggattacaggcacctgccaccacacccggctaatttttgtatgtttaatagaggtcgggttttgccatattggctaggctggtctcgaactcctgacctctggtgattcactagcctcggcctcccagagtgctggaattacaggcatgagccacggcacctgggcttttttctaattttcaatacaaaaattgaggttcaggatcttacctaaggtcacagagcttaaaagttagaagatcttggtctttaatgctattgttggtgttgctgttttcaatttttaaagaaagtactatttacctactgtattagtttgctagggctgccatcataaagtaccataaactgggtggctcaaacaacagaaatttactctctcacagttctggaggccagaagtccaatattgaggggttggcagggttgactcctcctctgagggaggtgagggaacagcctgctccaggactctctccttggctcgcaggtggttatcttctccctgtgttgctttatatcatctttcttctgtgtgtgtgtgtgtgtgtgtgtgtgtgtgtgtgtgtgtgtgtgtgtgtgttttgatggtattgctctgtcacccaggctagagtgcagtgatgtgatcatagcttactgcaaggtccaactcctgaacccatggatcctctgtctcagccttctgagtagctgggactacaggtgcatgtcaccatgcccagataattttaatttatttattttttgtagtgatgggtctcactttgttgtccaggtgggtcttgaactcctgagctcaagcagtcctcccacctcggcctcccaaagtgttaggattgtaggcatgagtcactgtggctggccttgtttttcattttatatggcattcattttacaaaaaatttatttgtttagaatccactttactctggtatgacctcatattaactatacatgtaaagaccctgtttccaaatatggtaacattctgagacattgggggttggaacatgaacatatgaattttggggggacaaaattaaattcataacaactagtaggcaagtactttataaagttatgacattaaaagttatttgctattgctagggtgttgataggggtgtgtctggtaagtaagaataaggatgatcttgtaagaaagacaatatcttctaggaagagttgtgcatcaaccttcattaactcagaaaatatgcttgaatcaaacgactacttatatatgactctctgcaatcatttatttacattcaaaactccaaggaaacattttcagaattattctatcctagatagcaaatgaaccaaagacactttaagaatcaatctcccaccccgtccccaaagaaatgtttggccttaaaaatcatgtcctactttcaaactccatacagtagtttattctgcactaggcaccatttaacactatcaacatcatgtaattctttgagatatagtaattatttattaaaaactggattccagcaaacatgcattctaaacaatgatggataatttttctatcagcaaagaaaagagctcgcccagagccaaaacagctttccccaattaaaagttgaggttgaattgctaatttcatttggattatactagtatctgcttgaaaatggcaggtttcattagttctcccagtattcttcagagaaggttaagaaacacattccctccacttcagatatgaaaactgagttgcccagggtgaagtcgttgtttatcttatgcacttagcaagcacaattgttcattctatacgcacagtgactgtctcgtttgtgtatttttcagctttgttacagtatacaaattggaaaacagagctgtgtatgacagcctagagcaagagaaaaagactgtgaatttatcataaagtcattcaggctctttacattcagcctggaacaaacaagtatttgataaaagaaaccagaccaatacaaaagaaacgtccagtccctttggaaagattttgtgattatgacatagcaggaatatccaatgagtttttcacatgatatgttaaataaaaaggtatgattacatatctttaatatgacagcattttcttgaaatattaatagaagtattgcactttagctttacttaatgtaagcaggaatgccaatgatgttggtttcaaattttaaaatcaaaaccaaaatatgattattcaggtatattttatgttaggatttgggataactgattgtgaaataagacacaggcacatgtacacacacactctctcaactcttactacacactaactattaatctccccccaaataatatcaaacctatggatatttaatggaatttaacctatttcttagcttattcaattgaagtgcagagatgtttggcatttttactaaaatcaaatatcattgccaatagtaatcaccatgcactgagtacttacctggtaagcactttttgtgtcaattactgtaacaagatcctgagaggtaagagaccaggctttttccttggctttatgtcccactagtctttgctttctctattataccatatttaagaagatatcatagtttttgattataggtgagttgtctgaggggtttattttgtcctgttaaatgctgggtctcatcagctaggaaagtgccttgactattgaatgtatttagtaagtacttgttaacagatccaccaaattgtggaatttagtgaacattggaatatgcagctataattaggtttacaatttataaacaataatgtttattatcttaatttatacttaataatattgagaaatactgcatgtacctacatctattagaagtcaaactgtccaaaatggcatgtgtgggaacacatgaaaagcctaggatttctataggagagaaaacaacagagtttgcagcaacagggagatgagaaggaggctgggaatactgactgtagcagcaaagcttatcctcccttcagacctggaggcagcttgatgctgctgagtgtaatggcaaggaactggtgccaaaggcatggatgtgtggcaatctccaatccaagctggaccagggtccatgtggttagtaatctagatggtggtttcctctgttgaagggtcatggctagaagaggatacaaagaaattttagaagtgttgataattctttgtttcttgacttaagtgcttcttacacttgtgcaaatgcatcaagctgtatgtttatgtgtgcttttttcctatgtgtattaaaattcagtgacaagttgtaaaaacaaattaatcagacttggaatcaaggtacacctctgatggaagaggaatgaaagaaaccaggaactgttattggaatagctctctagtaccaaagataattgtgggagaaaaccagtgggccaggtgaaatggtaaccagagagcttagcaaagggtctttaagagcctacttgcaacatatagggacattatgttactctttatgtaaattcagcatgatataagtacacgggatctactcacacttagtacatagatacttagtatagcacatagtattatttgctgatgaagagggtatttctaaagaaatatgtttggatgtcattgcctctggtttgaaaagaaatgaatgtatatgaaacaggcatcattgtgtgcagttggcatgcacagggaatgacaggtaaaccaagctgtggctactcctacttgcttttgattttgtgtttgttagtattatttttgttgttgttgttctatttgcaggatgaatgcctaaatttattaatcttatttttgtattataattgccatctatgtataattgatgctaacagagaaaatttccatgtctataatatctaccaattaaaattgagaaaatatagaaacaggcaaaaacatgaaaaggaaactcaaacaaaatatataaaattgtgtttacatgcatacaaatgtaaaatgaaaagagaaatacaaattaatcctctatggggatactatatctcaccaatcaggttggcaaagaccgaaaaggttgtttatacactcttttgggaagaatctggggaaacagcattctcatatactcctgatgagcatgtccaatagaacaatagctatagagggggattggcaatacccagcagaactaaaaatgcatttattcttcaacccaactatctcaatactaggaatttagtctaattatacagctccaataacataaaaagtcatacgcacaaagttatttcttgccattgtatttgtaattacaaaatattggaaactatctttatgatcaaatatagattggttgaataaactaggctacatatttgaaatagatacacagcagctgtgaagaaaaccgataaaatataagttgacatggggtggatttgctggatatattgtttagtgaaaaaaagaaaagtacaaagagcgtttattgtatgttaacttttgtttaagaaagaagaaatgaggaaacgtatatatggttgaagcatttctgaacatatttaaatgtactgtaaattgagcaaatgagtgatatgtcaattgtgttgggggccaaggttctcaccatgaaggaaataagaaacatacgtggaatgagagaagacaagaatgaagcctacttaaaaatatatgtgtgtgttaatgagtatatatatatatatatatatatatatatatatatatatatatatacacacttacatactacatgctaagtagctctgacagctggatggatctagaaacaaaaatattgcagtaacactaagcacacctaagatagactttaattattaatacaattatcatctaaaagaaatcagatctagttagaaaaattttaccaggttgtggtcgagaaagaaacttgttaaattaaacacaccttgttataccagaaagaaaggaaaaatgatggttaatacaaaattacataagagccaacttgaaataattcatattggtcaaacctggacaatttgaacaccaaaatagttaaggacagtaatgcattgcacacctttagagaaaaatagaaatgcttaagtctatagagatgataggtaggtaggtagacagacagatagatagatgatagatatagatagatagatagatagatagatagatagatagatacatacatacatacatacatacatacatacatacatacatacataggcaggcaatagatagataaaatgaggcagaagagaggcctcttgcttatagtagaatacgaacttctgactaggaaacgtggaagggtgctggaggtgggaactcaagtcatcatttgcaaccatcatagtaaatactagttctggcataagacattaatggtaataaaagtagaggatacggagagttttgatggggagaagtaaatttgtatagtcttaaagtgtctcttacaaatcacttattagttgcaagggaaatgaataatatttacacaagagaaattaaacatcttgagtgggtaatcaaaataaaaattacagatgagaagcagacactgtgcgcctccagaggcagtggactgagaaggacccaacaccgtgcatgtagtgtcccatgaagaatgtaagtggatgtaaacattatgagaaaacaaaagtcaaaccaaaattgaagaatattctatgaggaatgttctactaaaaagataaaggagaatacattgtctatgtatcagtgtgataagagacactaaaaggctaaggagttattctaggtaaaagaaaattaaagggacatgatacctacctgtaatacgtgatcctagcctggatcctgtcttggataagaaaagatgccctaaagacataattgggtcaatggataatattgggatatggaaggtttattcgatgtagcaatgttaaatttcctgaaattgataactatatacttacctacatatgtccttatttgtatgaaatgtacactatttggaagtaagtgaacatgatatgcaacttattctcacatggttcagaaaaaataatgtgtgtgttggggtggtggaaaaaggagagagaaggagagggagagagagagagagagagaatgataaaccacatagcacagagtaaaatagaagaataagaataaagagtaaaaggacaagtgttccttatactattattgcagcttttccataattttgaaattatttcaaaagaaaagttaaacagatttaatatttccctgaaaatccagcattagaaacacattaccacagcttgtattcgtttgtttgttttaacagggtattctttcaaaaccagattgccttatgtgagtatataaataaacatactaatcttaaaccactaattgaaatctgtattagtatatttaattggatctttccattaactagctaataagtggtgttctccagaaaatagagatttgacttgataaggcagaggaaaaagaagttagaccaagagaacgactgagaaacaatgggaggggcaatgagggacgagagagcctccatcccgtgtgggtgtctgaattgacaggagcacgtggaatataagaaaaaagacacaccaatctatcaatagacagtgttatctaggactattcctgatgtaagtgatgagtagtcagctgctgttttgtgtttggttctatatcatatgttcaaagatactaccaaagatgtacacatagaacactaaactgtggaatcatatttgtttcacaggatttgtaaggtgaagggggtgataagaatttcctgaaagtcaataaaactgtgaatatgctttcaggcatggagaactcaaaagcaccaacaagtcacacttatcagaataagtttgaaagtggaaagaaagaagacgtgacattagcttaggacaattggatatttcaaaacatatgtaggaaaaggtgctaagggccttgacagaaggaaataaatcacaattagatcttgttctggaaaaatctgctaagatctacggtggcaactcaagtctgaggaggacatgaaggttttctcttgccagaggagtacttagtgttccttggagagagttgtcaggcaaatatgatatacagattctctgcactcatttgttctgtgaagatatcaaaaagaacctgcctaaatgagaaagagatttttatctagtggaatgggcttgcactaaatgttgtctagtttccctgccaacactgacattcttgcattcatcctaaggtaaactgttttaaaaagtttgcaccaggcttcgtggctcatgcctgtaatcccagtactttgggaggccaaggcgagaggatcacttgagcccaggagtttgagaccagtctaggcaacatggcaaaaccgtgtttctacaaataatgcaaaaattagccagacatggtggcatatgcctgtagttccagctcctcatgaggctgagatgggaggatcacctgagtccaggaggtcgaggctgcagtcagccatgatcacaccattgcactccagcctggggcaacagagtgagatcctgtctcaaaaaattaatcaattaatgaactataaaatttagctaccccatatgtaatatcagttgctgaaaggtagtcatatttataaatcacatttcatttttttgcatttttattataatgtaagcttattatttaatattcttctcctttagatataatttgtcctacatcatttatttgaagtaatgttgtacatgtcagcataaatgcctttctttcatccttaatacattcagaataccagggagaatctggcattggagaaatgataatgtaagggttttacatgacacatcaggaaattcccaaactttcataagaaaggcccaagtgctgacactatatgttgactcaggtcctataaatgaaatcttaataaagcaattgagattgagaataaaggtaaaattttgaggcaatataggcaataacattagaatttcagggttacttcagcagagattagaaaatgtgtttcaatttcctcaacagagaacaagtcaaatcttaaaagaagagcagagtcaacttttattttaaagagcatcactaaactgattaatggcacttaaatgtgtctgttgacagaacaccagtaacagtattatgcattagcccctatagttattgaaggagctgcatattttttaaaattccagctattaaagtcaaattataatccttgttgggtgcagtggctcacacctgtagtcccagcactttgggaggccaaggcggttggatcacctgaggccgggagttcaagaccagcctgatcaacctggagaaaccctgtctctcctaaaaatacaaaattagccaggctgtggtggtgcatgcctgtaatcccagctacttgggaggctgagcctggagaatcgcttgaacgcaggaggcagaagttgcagtgggccaagatcgcacaccgttgcactccagcctgggaaagaggagtgaaattccgtctcaaaaaaaaaaaatatatataatcctaactctgagtctgagacctaccctgactctaagcttaattccacctccaacccaactcaattgaaaacaaaaatacaggaaccacaaatcataagtgattgaagaagagaaaaatattgcacgtggtatctcagtgagtaaatagaaggaaagagaaccaaagatagagtaaaaggaaatgtctaaattcagctgccgggctaggaaaatatgaaagagaaaaatttaaagaaaaccaatgtggtcagcagtaagaggaaacctagagtgggggaggaagaggatcaattgctttaagaacaagagacttgagattacctttagaggtgggttcagctcaaaatgtgaaacaagattttaaatagagtggtaaaaacagaatgacataaatacaaaaatgtggtaagacttttatttaacaaatatttatcaagtttatttttattgttcagatgttacaatgagtaatggatatatatagactccaccatcatgaccctcatggagattagagctagatagaatataaaggtgtgattatgcagtatgtttttaaaaagtggttgagggtggtgagacagagggagagaactaaggcagtggtagacaagaagcttgcacaccagggaggttgctttcttttttatcttttataggccaggcaaaagtggaacatgtctgtaggtaagaggaacagtgaatgcaaagtctctgagggtggcagggtgtgtggcctggagctgagaggacaaaggcatttccattgacagagatcctgctatgtggcaggcagtgtgccaaataccatttggttttatgaaagttctagaacagcccctgcagttcaataagtacacaaactagatagggacatatttatctgaaagaaaaatggatcatattgatctactcatccctatgaagactgaaaagaggatagtctattgtggaaaaattattttaaaaattaatgttagtttaaaatgtattgtcttaacctaaagaaagcatctacattcatttaaagtatttatcaaatgattgaaaaaaaatttcttggaacagaaaaaaaaaacgcattattgacattctggttttatgggtccaagctgttaaaatatgtataccagggtcttaaggatagaatgagccctagaataataataacctcctttggattaagataattaataaccatgatgtctatttgtttgtctgcttttgtaccccttcttcctactggatgccagctctcatatttatcactgatagaacacaaatggtaaaattataggctagaatttttttcttgttgtttgcttcttttcacattatatggatttccgttttaatttattttcttttttctttgtttgtttggttttttgttttttgagaccaagcctcatcctatttcccaggctggagtgcagtggtgtgatctcgtttcactgcaacctccgcctcccgggttcaagcgattctcctgcctcagcctcctgagtggctgagattacaggctcatgcccagctaatttttgtatttttagtagagacagagtttcaccatgttgtccaggctggtcttgaattcctgacctcaggagatccacctgcctcggcctcccaaagtgctgggactataggcatgagtgtttttccttaccctttcattttcttgaacacattttaaaatttttaaaaatttacaattacaatgaactgatgtttaggtgctcaacaattttgtacagttgtcttatttaataaaatcgatagaaaacttttagtgaagaataaagtattatactaatgcatcataatttctattaatctgacacttagagattgtgaatccaattcacaatccaagtgtacattgctgacacttggagattgtgaatccatctcttagcagggggtaaccataaaattcccctcctaatttaaaaactatcattataaaaaatcagcattcagtgagataggtctacaaacataaactgcttctcagtatcctacaggcctgattttcttcatcagccttgtcagggttgtgttacatcgcttcatctgactacatgaatggctaaagaaaaaataattatatgtaatttgctggattttggagccatggcgccttataaatatttaaaagatatcgtatttagcaatctgaacagagatgtatactgataatgcttgagaccttggcaactcaattaacctctgggcattggatttggaatggagggattattattcattggcaattgtataaccactgtaattaaaaagcacttgccaaccttttaattattaatcctgtggttcatcctcttgtataaaggctaacatgcccattttaccagttagtggattggggaaaatgaagggaaaatgatagatgcaggcgcggtcgatggcaatgttaagactttagaatgcaggactttttccacctgccagttcgttattcattctgattagaatcatttattctatcttaattaattctgtattttgagggttaaagtacttagcgtttgatatattgaattaattctttacttaaatctcatgttgcattccaaatacgttcaattttgtaacataaaaagagctgtagcatttggacctttcttaatgacaacaaaaacgaaaaaagtgtagttttggcaacttttggatcataacatgctatttcctgaataaatagtgataaatcacttcttacacttccttgttaaaaaaagaaaaagaaagagactcaaatgtccatcctatgacatctgggcacaaaaaaacaaaaaacaaacaaaaaaaacgctaatgacactcaatgcaaaatattcagcctccttctgaatgagaactaatctttatgcatactatttgaatgtgtaccctgggggaaaggcataatgttacttggctgtctatcaaagatatcacagacaactctcaaaggttagagcagatgcttttaatcagatgctgttttcattttttatctgagttttcttaaactaaacttggctaggaattcaaaattctgtgaaacatacatatgcactcatatttttgcacttgtgtgcagccagacacataaacatcgccctgtctgtatggttctttatggtacagtgttatagcagccactccagggtgtaatgtggtcattctggttcccccagttattaaaagtgttttgaacagattcagtaataaaccagtgttatagtcacttttgtgcttgagtcaaccttcatgcatatagatttccacttaatggcaattgtattggatttatatgttcttacagtgacctcagatacagaaataatgagtgatcttattaatttgggacctgtctaatgtgggttttgaaaaataatgatttgataacttaaaaactcctttagatcagtaattatgtcaaagtatagaatgaagagtgaacctgtatttaaagaagtgacaaaaaatttttcatatttaagtctttaaatgtatctcccaatagtaggcatttatgactgtactgaaaagtttaatgttttctcaaagaagtaaatagcataagaaaatagttttaaaaaggagctttattatagtattaactaattgtttgtttataagccttatctgcttcaacataatcatgctaccaagaactttattcaattgagatgaagagttatcaatagctgataattatccaagataagaggtatgtctttcatatgactctatgctttaattataacattagtcaaatgtccacatggtatttccacagttaacttgtaaaatgagaatagccttgattcaaaataactaattaaatacagaatgtgattcaataaaagtcactgattgggtaattaagagaagaattagaagacttgaatgaaaatatataatacttgtaatcctaattagtactatgctatttgcttccccttccattactagacatttaccaaccaagtatttaaccttgaaagaatcaaagaagcttttctgagctcatactagttcccaaatagaagctaggctatttaagatttctaaagattgaagataaaatacttgctagcatgtccttgaaatggaattatggacaaaaagtgttagttgctattatataatgaaaacacaaatataaggagtaaatccaccttaagcaaaatgtctaaatgcttagctgtatttatcaagtgcttttcaatattttttcttcctccttttctgccctctttgctattgatagaggttgttgttaaaggtatagttgttttcttcttcagttttatttttagaattaaaatgctctaagtaaccttttttggtggccattatttgacattttaaaatatgtacctttctatatgtataatatcattcagtgttttattcttctctttaataatgtagagcattagcatatttaccaagacataaaaattacaaaagaataaaattagagatctatatttataatgaatatagacacaaaaattaattagaaaagtaaatccaataatttttatataaagacaataccttatgaataagtggtatttatcccaggaaagtaagtttggttcaatattttaaaaaatcagtaatgcaaatcatcatgattatggcaacagatataaaaaaatcatttgactaaatctgacattcataaaatgacaaagtgttcttaacaaaaatggactggaaggcaactacctcaaattcataatggtcaactataaaaactcacagctgatggatgcagcacttaatgttaaacaatagaatattattgatttttgaatgagaaaaagatatgtttttacattttatttaatattacattggagattctagccaatgcagtaagaaaagaataaacagaagcataaagattggaatagaagaagtaggcctgtctgtgttcatagatgacataataatttatttaggaaatcctaatcaatcttaaaaacaaaactactgaaagtagtcaggctgggcgcggtggctcaagcctgtaatctcagtgctttgggaggctgaagtgggaagatcacttgagaccagccttggcaacataataagacctttcctctaccaaacaaagcaaaacaaaacaaaacagaacctgcagggtggcaggctcctgtggtcccagctcaagtggtcccagctcaagaggctgaggtaggaagctcatttgctcccaggagttcaaggttgcagtgaggtatgatcttaccaccacactccagtctgagtgacagagtctatctaaaaaaaaaaaaaaaaaaaaaagtataaatttaacaaggcaacaggttataagattaatacaaaaaattctatatgctagcatcaaatattcggaaaatgtaatttgtaaaaggaataccatttaaaataggaccaaagacttgaaatactaacagttaattataataaaaattatactgacattctttactgtaattaaaaatactctgtaagaaactaaataatagctaacacaatggagagatacataaggcttattaattgtaaaatatgttaacttgttcactatcttcaaattgagtaggtttttaaatttacaaggtgattcaaagtttacttgtactgcaaaaggcctaaaataatccaaactgggtttgaaaaaaattggaggaaatacaagaatttcaaaaattactataaacttataataaagatagtcttgtatagctgtaaatataaatatatagatgaagagtccaaaattgagtccacaaatagactcacatatatatggagaattaaattttaataaagccaccaatatgattaaatgcagaagagaatagtcttttcaacaaatggtgttagaaaatgatatccatatggagaaaatgaacactgctgcttcacattctacacaaaaatggatcatgtacctaaatgtaggcaccactagttttaaacctctagaagaatataaaggagaaaatattcagccttgggataatcagccatttattaggacaaaaaagtattagccataaaaatgataaaagcataacacagagaaatcaaaatcttctattcttcaaatgacacactaagaaaatgaaaatcaaaccacatgctgggaaaattcattcacaatacacaaatacagtaaaagccttgtatacagaaacacaatgacccgttttccttgaaaaggaatccttgtactagtcatactattgtctttgcgtctgcttctcagaagatctaaatgaatacattcttcttctatttcttatcacatatattattctcagaagatccacccatttctgttattattcagaggtgccatccaaacataataacaaaatgttttacctactgaattcagtgctatttgctgtatcattccaatgttccccccgacagtttctcatctgcctgttttactttttgaaacattgggatccaggcttcaggttgatgtatctaaagtacatatacacatgcacggaaagtccaagataaaagaaatattatcaataggaaatgaaaattccaaacctttaatattaggtaattccatataagcctttataataaaatatttatctcattgttttccaaaataatttttatttacattattttttacatttcagtacatggtaaagtttagaagatttgatatttgagaaagggtaaacagtctttagctcctgcatattaataatttatttaaccactgacactaaatatgatgtgccaaataagaaaacaattagcaataatattaacattcccactgttttctcatggttaaaaataaaaagttgtgctttatttctaatttgtgatggaaaggtatgtccatgacttcacatatgattgtacctgcataacacatttggctggcacggcaagtgggagctgaaatcctttttttcaccatgtttcactatgtcaaatttaacttttgacaatttaattggaagaaatccatgtactttcttaaatatgtcttgaatattcagggaacattatttgtaatagagcagagttggaaacatttgtctatcagtacaatatttctgcaatcaattacagtatactcacatgatggaaaacaatgtacctgataaaagtaaacaagatagatgtataatataccacggtagaaacataacttcgatagggtctttcttctaaaacattgtaatatcatatatattacatatcattttataaacatagattatttttatatgtagatgcatataacaacctagaaggatatatggaaatctcttttttaatcttttactttaggtttggtgggtacatgtggaggcttgttacataggtaaacacgtgtcacaggggtttgctgtaaatatttgatttcatcacccaggtattaaacccagtgcccaatagttatcttttctattcttctccctcttccaaacttctgtcctcgagaagaacccagtgtctgttgtttccttccttgtgttcataagttcttatcattaggctcccatttctaagtaggaacatgtggtatttggttttctgttcttgtgttagtttgctaaggatgatgacctccacctagtccatgttcctgcaaaagacatgatcttgttctttttcaatggctgcattatatttcatggtgtatatttagcacattttctttatccaatttgtcattgatgggaatttaggttgatttcatatctttgctatcatgaatagtgctacaatgaacatcacgtgcatgtgtctttatggtagaatgatttatatacctctgggtatatacctggtaatgggattgctgggtcgaatggcagttctgttttttagctctttgaggaatcatcatgctgctttccacaatggttgaactagtttacacccaccaacagtgtataagtgtttccttttcttcacaacctcatcagcatctgttattttatttactttttcattgtagccattctgactggcgtgaggtggtatctcattgtggttttgatttgcagttctctaatgatcagtgatagtgacttttttttttcatatgctcgttggctgcatgaatgtcttcatttgaggagtgtctgttcatgtcctttgcccactttttaatggagtcgtttgtttttctctcataaattttaagtttcttatagatactgggtattagaccttcatcagatgcatagtttgcaaatattttctcccattctgtaggttgtctgtttactctgttgatagtttcttttgctgcagaaacgctcttaagtttaattagatcccacttgtcaattttttcttttcttgcaattgcttttagtgtctttgttgtgaaatatatgcccattcctatatccaagatggcattgcctaggttgttgtttaggtgtttatagttttggattttacatttaagtctttaatccatcttgagttgatttttgtgtatggtgtaaggaaggggtccagcttcaatcttttccatatggctagccagttatcccagcaccatttattgaagagggagccttcctcattgcttgttttgtcatctttgtgaaagatcagatggtcgtagatgtgtgggcttacttctgatatctctattctgttccattggtctatgtgcctgtttgtgtaccattaccatgctgttttcattcctttagccttgtagtatagtttaaagttgggcaacgtgaggcctccagccttattctttttgtttaggattgccttggctatgcgggctcattttggttccgtatgaattttaaaatacttttttctggttctgtgaataataatcttggtaatttgacagcatagcattgaatttgtaaattgctttgggctgtatagccatattaatgatattgattcttcctatccatgagcatgggaggttttttaatttgtttgtgtcttctctgatttccttgagcagtgttttgtaattctcattgtagagatctttcaccatcctggttagctgtattcctcagtattttcttctttttgtggcaattgtgagtgggattgcccttctgatttgcctgtctgcttagctgttgttggtacccagaaatgctaataatttttgtgcattgattatgtatcttacaactttgctgaagttgtttatctgctggaagtgcttttggtctgagactatgtgcttttctagatatagaatcatgtcacctgcaaacagagatagtttgacttcttgtcttcctatttggatgtgctttatttctttctcttgcctgattgctctggctaggacttccaatcctatgtggaatacaaatattgagagagggcatccttgtcttgtgtcagttttcaaggggaatgcttccagcttttgcccattcagtataatgttggctgtggttttgtcatagatagctcttattattttgaggtatgttccttcaatacctagtttattgagagtttttaacatgaagtggtgttaaattttattgaaagccttttatgcaataatttagataatcatgtgttttgttttttgtctttaattttgtttatgtgatgaatcacatgtattgacttatctatgttgaaataaccttgcatcccgggcatgaaacctacttgatcatggtagattcgctttttgatgtgctgctggtctcagttttgtattagtcaggattctctagagggacagaactgaataggatgtatgtatatttgaaagggagtttattaaggataattgactcacatgatcacaaggtgaagtcccatgataggccatctgcaagtagaggagcaaggaagccagtagtggctcagtccaagtcccaaaaactcagaagtagggaagccaacagtgcagtcttcagtctgtggccaaaggtccaagagccccttgcaaaccactggtataagtccaagagtcccaaaaccaaagaacttggggtctgatgttcaagggtaggaagcatccgtcatgggagaaagatgaaggccagaagactcagcaagtcagcttcttccaccgtcttctgcctgctttttctagttgcactgtcagccaattggatggttcccacccacaatgtgggtacgtcttcctctcccagtccactgactcgaatattaatctcttctggtaacactcagaaacacccagaaacaatacttcgcatccttcaatgatcaagttgacacttcatgttaagtttatcacaaatttgcaagtatttttgctgaggatttttgcatcatagttcatcaatgatattggcctgaagttttcttttttgtgtgtgtttctgccaggttttggtatcaagatgctggcctcatagaatgagttggggaggagttctccctcctcaatattttggaatagtttctgtggaatggtaccggctcttctttgtacacctggtggaattcggctgtgaatctaccaggtcctgggctttttttttttggttggcaggctatttattactgattcaattttggagctcattattggtctgtttggggaatcattattcctggctcagtcttgggaggctgtatgtgttcagcaatgtatccatctcttctaggttttctagtttgtgttcacggaagtgatcccagtagtttctgatggttgtttttatttctgtgagatcagtagtaacattccctttgtcatttctcatcatatttatttggttgttctctctttccattagtctagctagtagcaaacattatgaaaatgaatttagacaagatactaactttcaatgtgaatacttctatatattcaaagttttaaacaaatatgagtttacttataatcaaatatatgttttgtaaattgctgtgtggaaatcagaggctgctcatttctcattcaaactaacttaaagatactatgttaaatgttctacaatcataactttaaagttgttttctctaagagtttgaaaaagaaccagtatttttgaggttgtgtcaatagagtcatgattaataacaagcataataaaaatttttattaaaaataagcaattaaatattcttcttttactatattaatgctcctgagaattataactttctaaacaatttaaatgaaacatgagcttttaagcttatagtaggtgctcaaatgtttaggaaaaatgaatgccaaaaatagctatattgtttattcagtggaaggaaaaaagactaaacataatttttacacattgtctgtttatacattactttgctaaaaacttacaaatagatggactcatttattttagagatctgtgtgtgaaatgtattgaaatggattataacatttcccaatgggacacatctaccagcaaagcatttcaggagtgattttatgtatatgtgacgaattaggcaacttatgcttgaaaatatcagaaatattaaacaggcacatctaggggcatttaattcttaccaattttgttttttcctgtctcttaagaaataagagcagggtgtggtggctcacgcctgtaatcctagcactttgggaggccgaggcgggcaggtcacctgaggtcaggagttcaagaccagcctggctaaaatgatgaaaccccatctctactaaaatacaaaaataaggcgatcctaatggcaggtgcctgtaatcccagcgactcaggaggctgagataggagaattgctcaaacccgggagatggcggttgcagtgagcctagattgtgccactgtactccagcctgggtgactgagcaaggctccgtctaaaaaaaaataaataaataaattaaataaataaattaaaaaatgatatagctacatgagctcagtcatcaatgataggctagaaagagtaaattacaaataacaaaaattactatatttaacaattattgtaaactttgacatccatcttcttataatatttgcaataaaatatattttcaatgagatagtgacatggatgtatttttggttataaatcatatgatttattatttcaaaaaaactatccttaatcattaacagtaatgtctttacattgagaaactatgcaaatctcagaatatttgtctcctaacatgttttatgagcataacaaattcaaaaaacacagaactataactcttttgttttacaacttgatacatcacatattgctattctccaaagatttccttcctaattatgttttcttctacataatattaaagttcattgacattctcataatacacaacaggatgtctgcatgaaaattgcctgcaagcaatgttggctgatgggagaatgctagcttatattaaaaggtaactattatggttttatcaatagaaagaaaaagagttaattacattggtacttatctctttcccttttgggccagttaaattattgaattttttttttttttttttttttttggtaaattgaattcttcatgggaaggtacgtcatccacctgtatgaaaacagatatcacaagaaaaaagtatatatagaccaccccccaaaaaacaaacttaataaaactatgtatttcaaatagaattatttttttctggttgaaaaagaaagttggaaacaaaatctgtgacaaaacccaggctttgcctgtactttaacgtaaaccaatgctgcactttatgcttactattttgttgtcttgtaaggagaatttctagagggtggttgggttccatgcaacttaattgtaagtgtcagctgaaagacctacaaagacattgtcagttattgagtttcttatcaagccaataatgtggtacggctgttgtactaataatgaagttttaattagttctcaaaaatactgagagcttatttaaggcctccaaattggatagtgcatgcttagcttgaaggcatcaatgcatcccaaacatatcaaaataactgtcaaacacattgtatacacattaggagataatagctagaaggcttaacatctatcttagaaatactgtatgcacaaattgttcaaggaagttctttctacacttaaatgattgtcttcagaatattgtattttataatttaagcaaattgtcatgcaaatggttcagtgttatctgtttatctgagggtcagtatagttgagaaaattcattttagccaatgtttatcgttattccaaatgggagcattctctattcataactatcccaacatagcacctgcatttttacttataaatacttattgcttgtttccaatattttactgcatgagaaattgtgccagatccctcttccctaatccatgggtagttcaaagatactaacatttaagaaacagttgatttaaacttctaccattggagaattgttgatgtcttttcaatgcattgggtggatttagaccactgcattcttatatgcctgtctattaatgctatacaagatgtctggtttaaactaacattactggaagtaaccctttctaccccatcccatctccacccacacgtctacaaaaagaattttatgcaagacagattttgaagcacatagaggaggagctaacatgagttgctgctagaaaaataatagctgtgttatttgtactgacagtttgtatttcttctcaaatcatttattttcacaaaattggtctggctcttattttttcaaaggacgtaagctacttcattgttgttgttatggatttctgatataatgacattaattacttgctgtgtgccagggacttttttaggcttagagggtgaaagtgtagaactggaagtgcatgcgattcagaggctgcacagtgaccctctgtgggtaagaagtgggctcctagagtatttgaattatgaatgcaagtgggtcaagggaatgaggaatggggtgtatgagaagaataataagcatggagaataggacatatggcttgtttcggggaactacaagatgtttcctatttctgtatcacaattacatgaggataaagggagaggcccaaggatataatgattacaatttgagggggaagtgtttactacattcagagagcctgggtcatattctgttagtacatcatgtttttcgtcaaattttgagtgactattatgtggaggtggaggatcttcttttgatattgatttaaaaatattatttacaaagatattatatattttcttccaagaaaatatagcttatattatacctacaagagttcatgatttgtagggggcaccaaattaagtcggaaatgctaaaatgtcacacatttcaggagaaataaatcagaaagaggtgggtttattggtgaaggatcaatttgatgcatcaaaaagagggttactcttaaattctcgggagaagtgaactcaggaagaaggaaatatcaagtctgacgttaaaatctgatgccaggaaataggaacttgtatataaaagatcctgaatatagctgatgtttaggaaaagtttattaaagtgaattcacctaggatagaaaacaatatggtataattagtagttaaaatgaggatctattagaactttgtctagataaacaaaagaaattaattcatgtttattttttatttttattttattttatttttttgagatggagtcttgctctgtcaccaaggctggaagtgcaatggtgcaatcttggctcactgtaaccgctgtctccagggttcaagtgattctcctgcctcggcttcccgagtagctgggattacaggcacctgccatcatgcctggctaatttttgcatttttgtagagatggggtttcaccatgttggtcaggcttttcttgaactcctgacctcaggtgatccgcccaccgtggcctcccaaagtgctgggattacaggcgtgagccaccacacctggcctcatgtttctttttataacagaaaattgtaattgtgtgactgtgtaacaaaattgtaattgcagctatacttcagttcttcacttaaattgtttgtcaagttttgacatgattctttcaataaaattgtatgataacacgacttctcattctgcttctgtggcattatcacctgaaagtcatttctgcaaagaattatttcagagtcttatcagtttcccaattagcgcttttgtttattttatattcaaaccattttatttttaaaagcctattgtgcaatcattcttgccaatttctcttgatcagaataggtctaactgctttgcacatgttttgaactgttctacatcaacgtcattaactttggaaagacctccttcttttgtaaaatttgcaatttcattattcaatttacatttatttgcattataagtagcgaataactaagaatatattgacatgaaagacagacataggctgaaaggcaaagacaggctctagtgtaaaaaggcagaaaaggatgatttaatggcatctgagattgtaagtggcattttgttatacatattttcatgagaagctgaatttggttctctacacaaacttataactgaagggattcagataaataattctcctatatggagggcctctggaataaacaagattatatcttaggatctgactaaaatggcctcaatgttccccacagcttgattaaactttacacaagctgctgcttaaatctaggccctgacctcccttttcttagagcattccctttagaaaactagtaattgtaaatcctttctctgactctttgagatgtaaatcttttttgaaagtgctttgccagttttaaaacacgaaactgtctttctcaaaagacctggaagccagctcttcgaaatgtaaacatcaatgaagacagagcccctgtcttccagcttctgtgggatagcaggagcctacatttgaaggatgctttgctccaaggtgtaaaactacctcctaagaggcagtttgcttttggcgggggggcaaagccagttaggaaatactggtggcctaaaacccaggtcctttatgacctaattctagctttataaaaatttttcagcttggccaggtgtggtggctcatgcctatgatcccagcactttgggaggttacagcagaagggtcacttgaggccagtagttcaagaccagcctagacaacatagggagaccttatcttaaacacacacacacacatacacacacgcacacacacacacacacacatacacagcaaaaaaaaaaaaaaaaaaaaaaaaaaacaaaaaacaaaaaaacgagaagaagaacaaaaacatctttttgggggcaggagttgcagtacagctcactttgacttttggcttccctcctctcttacattaaactcctggcctgtttaactttgtttggcagattgttttggttttttgctttgacagatccaaataaaataattaaatcagtcaggactgagagatctagatgcatgttgactcttagggagttcatgggatcgtcaccaaatctattcttgcatcacctgaatcttcccaggttgaagatgagagcagacactgaaggtcatattcttgctgctggcttgtatttgctgccaagtcccccagggcatgttctttttccttctgtgaatcaggtcggatttcatataccattttgtgttatttattttggaatttttctcttaaaatagctcctccgtaaagaaagcatattgttcatatcattgtgattatgatttcagcaaaggagataaaactctataataaaataaatgtccttcctagaaaaatatttgagttgaataaaacttcagaatactgccaggaatattgtaactttcgtttgcctcaaaatgctattctgatccttcatctttcattattaatccattcaacaaccatttattaaacccttacatttgtgccagaaccttctagacatactgatttaaaacatgtattctcaagttgcaaaatcgccctccagatcaccctgggtcattggatcaacgatacaataatgtgtattgttgattatcaggtcaacaatgatccaatacacattattgggtcaaaattgttgacctaattcacattatatgtgtttttcactcaaaaagtctggaaggctcagaaaagactggaggaaatgcacattttttcctctgtcatacccatgcatattggttgttctagattagataattaagtagacttagtgcaaaaatcattttattttcatatttcactatttaggttattggtatatttgtaactttttacttttaactactgctttaagcgtttttcattgatgacattaagcatgtaagaaatgatcttaatggttattttgactatagatatcagtgtctttctcattatgtgctttgtataagaaaggacataaatatcaagcaagaaataacaaaagcattgcattcagaaacaagaacatacaagttaatgaaaagaaggtaaaacataattttttcgaccattaaaaacataggaaaggggccaggcatgatggcttttgcctgtaatctcagcactttgggaggctgagaggagaagatcatttgaggctaagagttcgaaatcagcctgggtaacatagtgagacccccccatctctataacaaaacttaaaattagcctagtgtggtgccatgtgcctgcagtcttatctgctggagtggctaaacctggaagatgggttgagcccacaaatttgaggatgcagtgagctatgattgccccactgcactccagccagggtaacagaacaagagcctgtctgtaaaatatatatatatataaaatatgtgtatatgtgtatataaataatatgtgtatactatatatgtgtgtgtatatgtatacatatatacatatgtgtgtatactatatatgtgtgtgtatgtatgtatgtgtgtatatatgtgtatatgtacatatacatatatgtatacatatatatggacttttaaacttttttagcagctctatggctttcagtgctatttggatatttactttgaatgaagcaagattatttgagaactgtttatatttcatgatgtcaccttccatgatagtttttctattataggagattctcagttcattacccgaccatgatgacaagtgaaaactatgaattattttcactaaatcaagtaatcgactttcataaaatacagttcattaatgtttcctcttcagcatattgttttaagatagtcctaagtcattttcagttctttaacataataaaatactcaatagaatacattaaaagaggattcagaacttgtattctttcattttaaaatgtctcctggaaacacaatttactttattttggtgtttattcatgggccaacgtcccctaattatgatagctgtatcttgaatactgttaatgcaaccacttcaatttgagtggtagatatcttctatttattcttctagatccactctccacattttttaccatagtatttggcaggctgctgacttctgtcagtgacattaattgacttcttgtccttgatcttcttcttccatttggccagtggcaaaccctgggaggagaggggaaggaagaaagtgatgatgtattatcttttttttttttctataatgctaacttcattttgctagtcacttaggaatatttttttacagctgaattgctgagtaagactctacattttccctttcccacaagtactcttgagtttttttttttaataagattataccagccctatgtttatgttagaaaagatgacctaaggtaggagttagaaaaccatatctttttaatatcataaagcagacgctgtcattctcttttgaaaaaattatttcactagtttaacttcactctctgaatgaagccctaactcttttaattgccaggaggcccttcataaattgacagcgcctgtttctctgaccccatttctgtggacctcccctgccctcactccactctaagtacatcagctttctcgctgcttctcaaaaaagatgagcttttccttgcctcctgacctttgcaactgtttgccttacctgccgatcttcttacgctttcttccaccctctccactccccattgaaatgtccaactcaaagcagctctgaccactttcaagaactcctagtatctctctaaccccttattttgttttactttgctataatggacacttaccttttgcgaactttatttgctcatttgtttaatgcctttcttcaacaaaatatcagttgtgagggaaaggactgtctgggttgctttcaatcacattttcaaaccaagaaacactccaggcttgtagtaactgctccataagtatgtgtggaatgaaatataatggaaagcagatgccttcataggttgactgaggcagtgtctgtgctgccatttcattgccctgtggcaggcatcattttcccatcactgcatacttgatttgatttactcttctgactattaattctagttactattatcaatagatgttggcatagatgataaacttcctttccactctttctacatttaaaaccattctggattttttaaaattagaattaaatgcatccagttatataagatattcccaacttttatatatcatgttagtaaacatgttttaaaattattttaatgttacatttgataagctgtcaagaggcagtgttgaacaactttatattgttctcttttctattaattatccttcattttctacaagatttaaataaaatatataatattaaattagcatttactatgttacagacactcttatgagtgttttacaggaattagttcatttaagtctcataacactccatgaagtcagtactctcacttccaagatatgggaattaaggcacaagtaatttgtctgacaaatgcctgggtccagaacctggcagggactgtggagctgagagccttctcccaaaatgagaacagcttgtttctacatcttagctcatgagctcacggtcagtgctcagtgaatgttatttttctttataataataaagaaaataaagattgtattagtctgttttcacactgctgataaagacatactggagactgggtaatttataaagaaaaagaagtttaatgggctcacagttccacgtggctggggaggcctcactatcatggctgaaggcaaaaggcacatcttacatggtggcagacaagacagaacaagagccaagtgaaaggggtttcccttttaaaaccatcagatctcgtaagacttattcactaccatgagaacagtatgtgggataccactcccatgattcaattatttcccacctggtccctcccacaacacatgggaattatggcagctaaaatttcaagatgagatttgggtggggacacagccaaatatatcacagataataatgaaaagtttatgtcctccacaaattcacatgttgaaagcctaatacctattgctatggtatttggaaacaggagcctatggtgattaggtcctgaagttggagccttcgtgatgggattagagcccttatagaaagaaattcataaaagctcctttatgctctctctttctgccattcgaagaacaccaagaaggtagccacctgtaagccaggaaaagggccctcactaggaacctgaccatgctggcaccatgtcggcaccatgtcttagaattccagctttcagaactgtgagaaataaatgtttgtttaagccaaacataaatacaattaaataaaacttaaaattaagtaaataaagatcttacctgagtagaaaattctacacaacagtggagttgaaatatgaacccagaggccacagatgggagctttttattacttcattatgttttccctctttatcatcccaactaaaccatttaaggagtatattttctaatactttgatgacaattaggtgtgcaagtacaaaactctgctgtgctgtgcttggttttcccatttatatattagtagaaggagaaaaacattttgtcatctctttggaaactcaaacttacagagggctgaatatttgttttattatcttttaatctgttgtctacaaaatctcaggggatgaaatattatcctcattagattcacaaggacttactaacttcagaaatgtcttcagagatgtgtttgcagaattgtggctttgtgtttgcataataaaccagcagcatttaaatgacattcctaaatctgttgaagctataatgtgagcaaaattaatatctgagagatgtttataaggaattatttttgttaccagccaagtaattattggcattgagtagattccaggaaagtcttttaaaaatccttccagaattttgagccaagtctgcattctttgcactgccatccaatagaaccctatcacatggaacaattctaattccacacacgttactctagatcttaggtattttaacctacaggaaaagccaataaaactgtattggttttctcaagaataaactgaataatctcaaatatgtaaaccaaatttttcatgttttatttgtaaaagcaggttatagaattggatgatctctaatttttcttagagctttaaaattgtgggatttattaggatatggcaaatattttcatcaaatacagtatcttatggaaacccagacatcataagaagtcctacttacaaaatcatcttaaggccctgcctgatttttagcccagtctttaattattcatgtgtgttccatttatttatttattttgggtgaggaggtgggggtcaagaccctggattgggatgaaacttcaaatgctactattggttatgttttgctaaaaatggatgttttctgaaaacatgaaaaatttatgattttttgacacaataaatggaaaatatggatatttcaaaaactaagggaaaaaatagcaaaaaatatatacaagttttacccccaagagttatgatctctgtcacttgtgcttggtgaactgatccctataattttttttttttttttttttacaaaatataaaaacacattatcttcttttattatttttctaccttttattttagagtcaggggatacatatgcagctttgctacaaaggtatattgcatggtgctgaggtttgaagcacaaatatattcgtcgtctagatagtgaccatagtacccaacagttagtttttcaactcttgcctcctccttctctccttcctctgctggtctctagtgtctgttgttgccatctttgtgtccatttgtacccaatgtttagctcccacttataagtgaagatacgcagtatttggttttctgttcccgcattaattagcttaggataatggcttccagctacatccatgttgctacaaaggacacggtttctttcttatggctatatagtattttagtggtgtatataaaccatatttccttcattcaacccacctttgataggcacgtgggttgattccatgtctttgctatggtgaatagtgctgtaatgaacatatgaatgcatgtatctttttggcagaatgatttattttcttttgggaatatacccagtgataaggtttggctgtgtccccacctaaaatctcatcttgaattgtaatccaaattataatccccatgtgttaggggagggacttcatgggaggtgattagatcatggttccgccatgctgttctcatcgtagtgagtgagttctcacgacatctgatggttttataaaggcctttcccccctcttcaccctgcatttctctctcctgccaccatgtgaaggatgtgtttgcttccccttctgccatgattgtgagtttcctgaggcctccccagccatgcagaactgtaagtcaattaaacctctttcctaagttacccagtcttgggcagttctttatagcagtgtgagaacagactaatatactcagtaatgggattgctgagctgaatggtaggtcagctcctagtgctgtacaaaaataagtagcatttctgtacacaaataatgttcaggctgagaaccaaatcaagaatgcgataccttttacaatagctacaaaaagaagaaaatatctaggaatacaactaagcaaagagctgaagaatctccacaaggagaaccataaaacactgctgaaagaaatcagagatgatgcaaataaatggaaaaatattccatgttcatggattgaatcaatattgttaaaatgaccacactgcccaaagcaatttacagattcaaacctattctgatcaaactacaaatgtcactttttgcagaataggttatgtactttttaactatttggtgtgttacataggtaccgtaactgtaaatttgttttatgtagttgtttatatagttctaaataactaatggacttgaattattttagccatggatatgcatttgtacattgtatttttcaaaatttttatttatttcaaaactgaaatacagcatattattctttacaatgttatttcacaatattccctataaaggtgtttccaataatttcagagataacttttaaaattatatttaagctcctggcacatacttctgataattgcattgcctttctcttttctttagttgctagtagtaattctcaaaaaatacgtttttttctatgtgttcaaatttgcagttattgaggttttaaagggaagatttacacatgtgtgtgcacatgcatatttaaaagaaaacagtttttattttcattggaatattctcataagaaccaaataaactttagcttagaaatttaggacaacgaagagaagattttgcgagaactcagcaaatttaagtgtttctgtctctgctccattcctttcaaatgcataagtacatacagccaatacacacacattatcatttgtgaaatgccatcttgttaggttataataaatgtactaaagagttaagaacatcaggacagaatgtttaaaaataatggctctaaacaattgatcaaaacactattttagtataaaaaattagtttctccaatttctccaaaatcatcttatagattatttagaataatttcaagctgtttttttaacatcaaagagaatgttaatgtaagttgttccactttctgctaatatataaaataatcatattatgtttgaagtgtcatttattagtttttttggaagaagccatagtttatgacctatcttggttactattgatgttcaatgaattttaagcatgtaaatagggcattttcaatagaaaagttcatctgatttctaactattattttaccagtaacaaactccgtaatataattgtccctgggtatatgcaggggatgggttccaggaccgtctgcctataccaaaacccaaatattcaagacctgcagttagctctgtgaaatccaggtatatgaaaagttggtgctcctgatatgtgggttttggatccagaaaatactgtatttttgatccccacgtttggttgaaaaaaatttgcatataagtggacctgcacagttcaaatttgtgtgtgaggttcaactgtgcttcttttcttgcatattatttatttgcaggtacattgcagctaaaattggaggaagaataaatttgacaggtagcaatggaatagtggaaagagtggtccctattttggctgttactactatacagctccttctcttcttgggcatctcgaaacctcccagtgccatcttaagaactgagtgagatgtttcctactcagtatgtattgagtatcagctatgggttagatgctgttctaagcatggagagtacaatgttccttgaggtagatgaggtcccatacatatgggatttacattcaggtgatgaataggacattgcactacaggatggggctggagggcccactggagcataagtagagtgcaacagaagacttcgaggagaaagcccatgtctaactggggccaaaatgctgatgagcaggaattagtcaagcaaaattagtcaaggaagggaggggaagtagagagtaaattactttgtaaatgataggctgctactcaaaataaaaagtacaataattattatcattctaaaaacttgtagacaaaattataatttgcttttctagctcccttaaaaatttttacagctctcaatgtcatatatgcctttaaaggtaagtctctacaagcctaatcactgcatttgataagttcaagagtttataatcaatggtggtctaatgaaattttttaaatgcatgtgtatctcccagacccccaaactaaaaatttcatggaaaaatatgtttacatgttagatgagttatgttaactacttatgtttagccaactagttgtgtggtttcttggaaaactattttcagaggacatagaaacaatgtaaataaaatgaaattataatttgcttccgaaatgttaagttactcttaacgtctttggatatttacattgttgattccaataaaataaaaaacctgcagcttacatcaaataaatcttttattttttgcataagaaaatttttaaaaaatgaattattaacaagttagtggcaagaaacgagaataccagggatccagtagtctaatgtaaataataatataggggaatgtcacatgggtaattaactttgaggcatttcctgggatttaaacagtgttaggaaatttggcaaaacaagctcttatatagctgatgtaaaaatgcacacacgttggcattgtttgaattctgccacttcctctagtttgtccttaaaaaagcaagagcaatacatgataattatagttaatataaatggatatctttaattatttaagattttaatcttacagagaaagtttcagcaattatttttattgtcttcagaacttctttttgcaaggaaagcaattagttggacatggattgaaacgagccaataagaaaacttaagtgattctatttgtcatgttttcaattaccgtattgtcttggagtgtgctctgccagtattttaacaactgacttatcacttgaagtcaaagattcttttcagcatgaattgtaaactaagcatttcaataatatgtgagtgtattttgcacaggatagaacttgtcgtgtttcattatgctctttaactctgaatatatgtaagtcggtgtgtgtgtgtgtgtgtgtgtgtgtgtgtgtgtgtgtgtgtgtgtatgtgctttccctttacatttttaagatttcaagaatagactaattctagtacaaattactctaaaacgattccttgtaaagttaacccaattgtttctctggctgcttttataaaaatttgaaggtttattcacccctcaaccctgcaatcaaaactgattttaaaagagcatctgaagcctagagctggaggaatgttttttcatgtgttttattttggtaattactttcttaatttgtcaggatttttctgactctaaggttttcccttatgctatcaattttttgttcagttttcttaaaaaaaaaaaagaaagaaatatctttataccaagatagcaccaatctcactttcaaagctgccaaaatttgccctcctacattcttttattgtttttaatgtttaattctaaaacagacaaagaaaaaaattgcagcactataattctttttggtagatatctccaatgattcacatttgtgccctggtatattcaataagactactaatctttgcctcacagatccatggaaagaataacatgggaggctattgggactgcctggactgtatgtttttttctgtttcttaatctaatattctaccaatctctctttaaaaatgttaattgatgatcacatctttttctttttaggcatttcaaattttgtaacattagtattctgtatgcttagtgtgccaagtaggaatctgcttaaaatcatcaggaaattttcataccaacgtgttcctcagtaccaaaattgtacaatcatcacatggaataagtttatctagtatagcctcctatgtcatgagtgaattctctttatgcgtgaacacgaaatggatttttctgtatttgcttgactaacacaagtgttataaactcatcattttcaagcaactcttcttgctggaaaacttttgctaaattcctgtaatttgccagtgagtgacgtctgccctgctgctcagtggatcataggaaatagacctaatatttctgccatgtaaaaacccttaactcctttatggtgtgtctgtatcccctcatgcttctctccattccccagtctccttatttactcttctatccatcagactaagtattcataaaaatcttcatttttttctatctcagatatctagatatctacatagtttttttgtttgtttgtttgtttgcgacagtggagttttgctcttgtggcccaggctggagtacaatggcgcgatcttggctcactgcaaactcgcctccccagttcagacaattctcctgcctcagcctcccgagtagctgggattacgggcgcccaccaccacacccaactgattctgttttatgttttgttttgttttgtttttttgtatttttaatagagacaggtttctccatgttggccaggctggtctccaactcctgtaatcctagcactttgggaggccgaggcagcggatcacctgatgtcataagtacatggtttttatttatctcatttaattgtaattattttacattaatatcctgcagcctgaccttcattattaataagtatgagtaaagccattgaatcagtttttctttcacattaccatttatttttctgtattttttttctaaaatttctttcagtaagaaattttgttgaaatccaggcatacggtctatattcccctgtattttctctaattgccttgtcaaaacaaacaaaagaattaagttgagtctggccttaataaactcaggctggcttcctgatatgctttttttctaaggtgttaatgcaaatttagcattttattctagatgagattgtattcacagatgtacacttcacaggtcatttccttgaccaccctagcatttcttgtataacctacaattagtcaaaaagaatttatctaagttcttttcttatgttagggtgtccacttttagtcttagagatataaactgacttagggttgttctgtatatgtttatgttatctttgataaccttgatttttagctctgactaccaagtatttaagtccaaaatttatttacttagaaaatctagccaatgaattaatctatcatccattgacattagatcattagcctcaaggaccaggtttttgtgtttttttccctcttcttactcaaacagagttccaaatctttgaaaattatataatatttctttaaacaatgttatttacaacatggtatcattttatttaaccttcattaaatatactttggttttattttgggcagaacctgatgatatctgaatagtagaactcgtgtggaaattttctcaattttataacgtttctatttttttctctccagaatattttatacatatatggctaacaaattaattttaccttactttctatcacttgttaattaactttcatttaccttttattgatatattggtaacaattgtattttactctatcatttcatatgtaaggtaacttccacatcatgtgtttttccttatcaaaaatttaaatttaactatattctaatgctttcctttttagttatcattaaattgaaataatcaagaccaccatttcctaggacctttttcacttctattctgcctacccatttttttttcatcttgataagaatttggtccagattatatagtatatacatacactgaaatattattcagctttaaaaaacaaggaaatcctgtcacttgagacaacatagatgatctggaggacattatgttcagtaaaataaaccagacacagaaagacaaacactatatgatgttacctacatgtgggttaaaaatagtaaaactcacagagagtagaagagtggttgccaggggataaggggaaggggaaatggggatatgatggtcaaagggggcaacatctcagttatgcaaggtaaataagtcctggagagctagtatcaagcacagtgcctatagctaatgatactacgttgcatattacaatttcctaagtagatagttcttaaccacagagacacacagatacacacatgcacacacagaaaataatagagtgggaggaaacattgggaactgatagatatgtttattgccttgatggtgatgatggtttcaccagcacacttatccctaaactcattgcattgtttacattaaatgtgtacagctttttctatattaattatacctcaataaagcagtttttaaaaaagttttaattagttgctttttctgtttttcaaaaaatgttataagtatagctttcttatatatatttagatatttcttcctagggtcattgaatctaaaatatgtgtaaatcttctttgatacagagaaactccagaaatatggtagaatacagcaatagacttcaggacggaggccaagtgtaaatttaaactctactgtttattaaatttgtggtcttgggtaagtctccttaactctcagatgcaagtcattcatctgtaaacagtgagattcatagacgtgtcttcccaatactaagctgtattgtgatatgacttaaacctctatattaaaaatgagctgtaatttgctttaatttactattttattctgcatggtcttcttattttaaataaaatgtacatttccattattgttttttagttgaatcgaaaccactgaatcttgatcatatctaaaattttacttttacatcttcttgttaaaattacaataccttgttcttcatcacttattcctagtgtatagactacggagaacacagaaagttttctgaagctccttcctattatattatcatataaattaccaggcatgtctgtcttgatcatactttcttcatcaatccccatgtctttcttggtatcctgttttataattttatctaggacttttttctcactccgattctaatttagatttgagtattattgatgagattggaaattctccaggcaggcattttctttctcgtcctcattaggagctctcaggtgccctagccaagcgtctatcacttgggtatattcatggtacagaaagccaaatcacattatgtgctgccagccagcaactgagacagagatccaagctccacagcatcccttatcttccaaatttccaactttcattggaagcaaagatgaaaatgccacctgtgtcccaaggtccttcatatttaaaaagtgggaaaatgtattaaagatatgccctgattttgtcttctaccacgacacactcataggctatcttcagatctcgacagtattttatgtagaatgttattttatttcactctcttcaaagtagtcagttgaagctggtatcgctgtcctgaccacaagtgagaaaataagcagagttgtgaagtgctttgcccaaggacccacagatttttaaaagtagaccagatggagaatccagatcaggtttcagccttcatttccagccagcttttcaacatagacatggcaccactttttaaaattttcctgtcagctactgattatattgtgtatttcaaccagagatgccatgttttgaaatatttgtctatcaaacaaaccacatctgttgagttataatttattttccacttttgctaatcaagcatgtatagcttctcatcatcatttttgatgatcatgagctaaaaaacaagttattaaaaataagttaaataaacctaatcaaaataaatgtatcttggtatttacatcagtcattatacaagtaaatgcaaattttctttaggcttttaaacattttgaaaatgacaatggctttgtttccaacatgagtgaaccagtttaactgtggtttacatcagcctgtgtaactatgatcatacatcattacttgatattagccctggaattaaaagacagattacccagcaatcccatttctgggtatatacccaaaggaaaataaatcattctaccaaaaagacacatgaactggtgtgcttatcacagcactatcacaatagcaaagatatggaatcaacccaggtgcccatcaatggtggattggataatgaaaatgtgatacatacatatatatctcatagaatactatgcagccacaaaaaataaacaaaattatgttccttgcagcaacatggatgcagctagaggccattatcctaagtgaattaatgctggaacagaaaactaaataccatacactatcatttatacgtgagagctaagcattgggtacacttcaacataaagaagggaataatagctagacactgtggactactaagtggaggagacaggaatgggttcaagcctaaaaaactacttattgggtactgtgatcactatctgggtgataggatcatttgtacccccaacttcagtgtcacacaatatacccatgcaacacatctgcacgtatacccccgaatgtaaaagttgaaattatgaaaattaaataaaaataaaagacaaatttgcacgatgttttacccagtatgttagctgaaaatatgtaatgttttaggtgaaaaaagtcagaagttatgcaaaagataaattacacagaaattacaggcatacatgaaatatcagctctgtgtatttttttggcagtcccaagtacctgaatgaatatgaacagtttttgttcttattttctggtgaatgattttttacaataatatgacattatgaaggatcttctaacatgaacataacaacagcaaaaatgggcaaatgtctcaaggttgttaatgacaaatacgtggtggtaatcaatcagtgtcagctcccactgtcaccagctggcatagcaggcctcgtcaacacagcactctaagaaactacaatttacctatgaagttggcacaagaaatggtatccatttttttattcttgttataacttttgtatttctgacaatgtttgtgatatcattttacatgaacctcatacacattctactactcattggcacctcttcccacctattaatgttttggccaacataaaattactggttatctattgctgtatcatgaaccactgaaaaacttagtagctttaaacaacagcagcaatatttattttactcatgaatttacaacttgggtagagttggtggcagcagttcatttgtgctttgtgtgccatcagctgaaatggctcagcttagattgaaggaacttcttccaagacggcccactcaatggctggcaagttgatgctgttatcagctgagagctcatctggggccttactttctcctcatgtgggcatttccataggttactgagactttgacagcacagtgcctgatcccaagtatgaattttccatgacacaggaagtgaatgcagccaatcttttaggtccagagccaagaaactggtaacctgtcacattccaatcattccattggttgaagcagccacaaagccagctcagttttaagaggcagagacagacttctcctctcaatgagaagagagccatagaatttgtagccatcttaatttattatgataatgttatttttatctcaagtcaagagataagagacaaggaagtataatcggttatggtgactgcctatctagtcttcaaatatttagccaacatgcatcaaatttcttgccctacaggaagccaagaattatatcttagctgggcgtggtggcacatgcctgtaatcccagctacttgggaggctgatgcatgagaatcacttgaacctgggaggcagaggttgcagtgaactgagactgcaccactgcactccagtctgggtgacagagtgagacactatctcaaagaaaaaaattatactatatcagttctttaatgatttattttttacattcaaatgattcaatgttactcaataagtgaatgtttgcaaaattattccagataggtataaacttctgatcgtaatcttcttgaggactccaacttgatatttaaatctctatatgcagagacaactcatgtttttgtaaacatatataaattcataggaaaagccatgataaataatagtgacagtaattggtaggaaaaaatatatattgtttgtaaagatgttttatacatatggacttttgtggtctgatatgcatacagttaacaaatgcatttattttatatctcttgcattgttatctatttctgtgtcagaagaaagaaggcattttgccccttttgttctttctacctaaaaccagtatataatgagctatttcattttttcctagtcacgatcaaagcataatttcagtttaattttgagttttaaattttatacctttgacagattccttctgaaaagaatttatcgtgctgaagagagttataaaatgcagtgattaaatatatataggtaaatagatattttaagataaatctatcatatatctctatatagagatcatttattacatatatacatatatgtatatatacatatgtgtgtgtatgtatatatgtgtgtgtgtatatatatacatacatatatatatatggagagagagagaaatattttgtttttccctcaggagggaaatgcattttctctcctggagcagaagcatgtacaggttaagaaaaagatattctaagtgggtagaatagatgactgactattcatctgttctagcttccggtcctgcaagaagtttggtgaatgatagctgaatatttgaagactggatagaaagctaccataatcagccatactgcctgtctctttaggatagtcttcaaggaatccagccatttttcctacccactgatgttgccaccttcagcaattatatgtgtgtctatgggttgaggaataatccactaagcgcacatcagttaacaaatgggtgactttagaggaagaagtttcaatagaagaagtaagaagatgtcaaagatgacatcctgcctcttgtggaagatgggtacaaaccgagctatgtaaaaacctaggagagtaatattctggctatcctttaagactatgttcttgaaatatttgttaattagttatttagagaagacagtggatactgcctatagaaactgtgaaaggaccactggttgctcactgcagaggtgtcgagccacctgttgtccttcacttataacacacctgccatttcctggccatttcctaccatacaccaagcaacttttggacaatttcttccaaatacttatactgtttactggaaagggcgtaaaggaaacaatatattctctgtctcctatgtttccaatgacatagtaatgccttagaaatatttcagtgttttaggaaattgtttcttaacccaggttagtatacagaataagggccaaattcctttatatgggaaacaatacccttcgaaatctgtggcttatatttccaaattaatcttttgctcctcttcatctggcactctttgcttcagcatttttaaaactctgtgtgttttttgttgttgttttgtttttcttgtttttgttttgttttggttttctcttgttttaactagttgttttcttatgcttcaatcttttgtacatgaattcctaagcttgaaatgctgctgcccctgtggttcgccatgaaaaataattcaatttaaagtgataactttaaacaatttccttgacctgtgtatctcttttgttgggtgcttttgccttttggtctgcatttttttattaacttgtacatacctctgtaagaacagatagtgtaaaatgttctttaatatttaatttacttttctaattctttgaagaaaactggtgtttcatgtaggttaactttacattcccatcagctaccatacaatcgatatccaataaatatgaatgaacagtgtttgctgatggccgaccttgactgaagaatatttaataattgagtggttgagaattctgaaaaactttttgaaaacactatggaaattgtcagcctcaatgctggccttcataagcaagtactctttgcttaggttactacattctcccaaccatttgaaactgctgtaagataattatttagcatttatattatgcatgggatcccatctacagggacagtttttccttcttgtactgcagtatttcttatgctataatgaaagaaaaaattattctaaacctgtacgtttagcttaagattaatgtgtctttatcttatctaggtgttttaatccccttccagccttctttccctcccttcctacatccttcccttccttccttccttttccttccttccttttttctttccttccttattcttacttccttccccttccttctttccttccttccttccttccctcccgccctccttccttcctccgtccttccctccctcccttcctttctctctctttctctctttcttttttcctatttccttgcattgcaaagccttccaaataaaactaaatttaatcatgaaattcacacaggatatacagttacaaataatggattaggatgtaattagctatatgtgtgtgagtacaataaaatctcataatcaaattatgtgtatctgtagttgtaaaaacataacattgaaacaccatataaattaatttagagccatttttgatatttttgttagtatgtaataattgttcatatttatggggtacatctatgggatataatcacgtggaaatacataaaagtattgctagcttactgatggctcttagacaattacatggcaccatggacacataacttctccgaaaaaggagtttctcttttgaaatgtgagatgcaatgggagaccctcaaatggtcatatctccaaagttaactcattatgtcattgtctcaaagtacctgaataaagctattttgagcttcagtccccgacggcataaattctcattttcacatgagtggttgcaactattcatatgtactaagatttactaaagtatctttctgtggaggattattataaaatattgcattttctcaactactggcaatctaagtacaccatacttaagaagtcaagtaagagttttggataatcgttttccttcctccagaaactttatttttcttttaaatttaaggtgatttattgggatatactattatctaaaatgtcaaatgcagacaaatttaaatctgagaaacaaaataagcttcagagtggtgggataggatgcagaatcacatgaatccagaatgattgatttaaatacccagcataacctcatcttagttttgctataaatacaacaattaaaacaggctcatttattatcacccccaacccattccaaacttgcatacacccttttaggcaatgcctgattcctggtcttgcaggaaagacttcctcttcaactcttttacttgggtgatgcctactaatccttattatctccactaggcagtctccctaattccccaaccacgtgtacatttttttttctgttccccgtagtatcttgtgaatatctacctctacatttaacagtttgcattataataactattttttaaatatttctcagtcactatactctgaactgttgagagctatactgtatgtctttataaatagaatcaatacaattttgttggctgatcaacaaaccaggcaatatcaaatattatgttggtgcaaaagcaattgcaaatttgccattatttttaatggcaaaacccacaattacttttgcaccgacctaatagaatagaaactaagcccaagcaaagtacaataagaaaatataagcttttgcttaaataattctgataattagtttattttcttctgttacaatataattttactttagtaagtaattttactttaataaaattataactagtaaaattataatgtttaggcaaatataaaatatttttaatgatgatttatttaacttattaattaatgagggaaattttaagataaccaaactgggctaaattgcaattaaggatttagataaagagtatttaatatataatgtaagggcaatattttgaaatttcatacaaaactgaatgatgtctgacagagaaaccgtatttctctgcatattgccctggacagaaattagtttcatattgaacacaagtaacctcattttatgagggcatctctcactagacaaaagtcaaaacgtcactcttactctctgccccacagaggtgtaacataatctagaaattggaaaatcaagcccatcattacactgagatactactcagtgtctattttacctgttttcaacttttacgtaacttgtctgacatttaagttgaggttctcgaattcaaatgccaacacatatcagaaggcagttgaagtgcaacaataaggtaggccatgtttgaacttggaggccagcatattctggtgctttaggaaaatcctgatatcagaattctagtgtaaagacttgtgattttaagatttggtcagtaatttaaaatattttaagactctaggccaaacaaagctctttatggttcgtggaggccaaaagccaccagctcgagacctacgttgtagaatccaacaggcaatccagcttccctacagaaactggattttatacactgatttcttgctcagtacgcagattttttttttttcttggcctttaggaaacacttctgctgtggaaaccttttgagagctaaacttttcccttacaaatttgtctctgccctttcttagtacacatcagtgatgatatttttctctagagcagtatcttaaaaagtcaatagcctaccacccactctgcagaatcaattgaccatagttaaatttttaagttagcctcattttttcaagactatcagagatatatttgtctaagtttaatgtgtttttttaaaaataattttgtgtttccttaggaattagataagaaaaattgttggagcatgcctcatttatccccctagaattttaattaaggaatgtttatatatatttttaatatctaaaaacaattcagtgaatgccgtttacaaatggtttgtgatatatacatttcactagcattccagaaatgtgttaaagcttctcttaatgattcctaaaataatcatagaataatatacatggacatcatagtatattattttgatcttttgaaaagataatggaaaaattgatatgcaaagttaactacaaacagtatataacttattgtcaattctgcaattatcttctggattttaatatataaatacacaataatttctgaagttttagaaatttacaaattaaaaaatagagatcacctgctgtgacagaattggccaggaaggtaaaattttaaaaatagttttattgttttcaattggtttcttagtgagcacaaaaatatggagcaaagacatcactcaggaaggatctaagctatatatgtattgattaggattctcaaaatacagaattttctgaacatttgctttccctagttaaatgagagtttcaaccactttattttaaattagttgtgcaactggtatttaaaaaaacaataataataataaaaaaaaaaactcttcttactgcctaaggaaatggcatctattgtgtgtgtgtgtgtatgaataatctaattgagtgtataaactaccacattataaccgcaagctgtattgaaaaataaatatcagctataagactatgttaacttttgtctttgtggtacctaatctccaaagatggcctcagtgacagagtcctcacagtcttcatgtttttgtgtggtttcttccgatactcaatttgtgacttgtttaaccgattgagtacatgcaatgaaaaaaaagacactttgactcttgcaggtgtagaccttaaaaggggccagccctctctactttttaacataatgtctgatctgccactttttttctcattaaaaaaaaaattgctatctctaccttcttcctcccattgcaaacgccactgaaagtgatttttgtcaaatttacctgtcatctccttgttttaaattcaatgaaaccatttaagtgcataaattattcaacctttgtgtggcactggaaactttcttttattcccagtttcttaaaatagcctctttagtttcttccagtttttgtctttgtccagttgttctcaccctgtttgtggattaccctcttccagagaatgttggtattctcatagatccactatctgctttctcttcttattccacacattctcaagtaattttatctaggcccatggctttaatctcatgttgctgacttcccaaattccatctccattacaatcccatttgcttagttccagaatttcttacccagttgccaacaagacaagtttattggacttttcttcggggtcctgaaaccagcatactcaaatcgcattcattcctgtcctcagcacattccaggtgagagccccgaaacctcttcttattctagaaatagaacatctagttgaataagccagaagccaagattcattcctggctcttctctctttcactttccctgcatgcattgaacctgtattttgtgccctttgttttaaatttcactttaacaattcagtttatttctacctaacaacttgtaataaaacaggttggtgtcatggcagagaatgcagaatagtcagtagttgagttctgctcaaaccaattccagatagataggctcacggaagaagaaccaggaaatccaagggataggacaggtcctcaaatttttctctgcctcagaattgtctcagtaatatgcattcaccaacatctggaggacccaaagttagctaaggagcagataatctcaaggaatctttgtcagaaccatcctccaaaacaagtgcttagcaaactgctctatgtgacagtgcattatgataagagcaagtggccctgtttatgggagcttttggatattaaccagtatctcatcccttaaagatagatgtccctataagtgattgttgaaggtggaaagttagaagtaagcaatagtttgagactattttaagtttaccctcaacgagctggaaatcagttatattttatttggtatttactcatttttcaccattatgtaattcaagctataatttcagtactacttgttgttaactacttgctatagacaagtagataagtaaaggcctaaacagtatctcaaaactaaaagaggagatttcctaagtatactgtcaggagcttcctggccatcgggatattttttagtgttgtcctgtagcatagtcaatcaccaaattctgtcagttctgtcatcacaacatctctagagtaaatgtaatacattattcatttttctgttttagtttaagccttattacgatccaactcaaattactcgaataattttctaaatagccttcctgcttctagtcctgaccatctgcaagtcaattcatttgaaagtttttcaagagggaaagcagtttacttaaccatgtctccactccacagcttcaccccatccccaactgttctaaaccttgctctgctctctaagataaaatctaaatgtatttgaatggctgatagggccttatccagtcaagccctggcctatcttgctagtcccatctcctgccactatttctattcccacttcatcatccactcctctcccactcccagtcccatacctcctgattcattctgcttaattcctgtgtttctccccagactccaatgaggcagtacctctgtcagctttctctgaacctcattaggagtctacagagttacctattcatattgctatccgagcgcagaatacttactgaatttcattacactcctatgctcacttggctctctcttctacctgcaccgagtctcttgggaatccagaccatcttattcattcactgcttagcataattcctgtccctagtggacacgtaataaatatcagttaaatattcaatgaacaaatgaatcctctgtcctcataatatactgctttattttatattctaagactatgcttcagaaaatatagaaatcaacaatgctattctgattaaagtagtaataataataataataataataataatgtttctttatctctggacctaagatgtcaacacaggtaaaacaaaagctattttttaagatattaaacttaggctaaaaaacagaaaaatccacttaatgcaaacagcagctacttatcaaaatataaataaaggaatattatggagaaaataattctctagtgtgcttaattcacccgagcctcaacagtttctgctgagtaaaagctataatgcccaatgaagttttacatttccatagaaaacaaaaattatttccagatgtttgctaagaataaaatatctgtatgtatgcataattggtatcaaaaagctagcaaaagcaattaaaatagctttctgtataatttctcagatattatgaatacatggatgaatacacagggaaagaattaaagagcattacactttgtcaatgttctaaataatggaacatgcaatatatgtcctagaaaatggaatttgacttaaacggcaaaataaaagccaaagaggatgaaataaacagaatcactttctaaaatttcatctctgttctagattccttatggaatttgcagtaggaaaaacttaaatatgcaatgagtatattaaaatccaaaggaaatatcagtacttacttggattggatatcaaaaactaaaagacaaagtcagttgtattagatggctggggaaatatcaggactctgaaaaaaattatttttgctaacaattgtattgtttattcttctacttttactaatgtgaactttgaaggagtatatttgttgctctttgagccctttacagtttttcttgcatatatgctcctttttttttttttttttttttttgagacggtctctggctctgtcacccaggctggagtgcagtggtgcgatctcggctcactgcaagctccgcctcccgggttcacgccattctcctgcctcagcctcccgcatagttgggactacaggcgcctgccacctcgcccggctaatttttctttttttttgtatttgtagtggagacggggtttcaccgtgttagccaggatggtgtcgatctcctaaactcgtgatccacccgtctcggcctcccaaagtgctgggattacaggcgtgagccaccgtgctcagccatatgctccattttttactttatcttcctcaggagcagtggctggcagtgagtgtaggggagattgtggctttcatcatatgctctcctgaactactcataatttctcacttttaatccctcttctgaatctaaagaatgcagtgcttttgaaatatactttgtttcttcatccatatttcaaagaagctatattacagtaacgtacatttcttctagtacttaaataactggaacttatatgacacttgggacaaaactggttcatactgaattttgctataataagaaaagagttatggcaagtttccaccacattgtaatcttatatgtagaaactgtataaagggtatgcaaaaacagtatgcagatgaaaattttcacaattcatatgcaggacaaccacctgtggctttcatcactttctcttcatttaagctaacttcccttgcaaacttccatttccactaatgccagagacagtttaaacgagccagtgaacgttaacctagtctcttctggttaactggagccctttcttgtaaatgttccgtctcatgagctgctcctcactttcttatccccaccaataaagtagctgagagcatgtggctgccattgcagcctcagggcagtgaggatgaaatctctgtttcccgagatgggccctcgatgacatggtttttccgacgtgtggtaaggtcatgaaacacatgcccagcaaatcacatgatgtcattgtctcctctctaaccacactgactcagtgactggtcagaactactcgagtagagcatgcagactgcctctggactaccagctgattttactggtcctcaaatgacatatctaccgatattgggagcaagagttggaacacatttttatcaacttcacgttggggcaacattcaagactgtgatctatgggcttgtaccattaaacagggtattgttcagttcaggtaatgccagactcacttctgtggattacacactggccatgcacagtgcgatcaaatatcggaccttgaggggttggataaaatcctgttttgtcaccagagatagcttgagaatcattttcttatgagatatacccattttcacagctgtaaacaccattactatgctgaaaactctctaatttataactctaccccagatctgtcttctgagctcccaactcagcaaattgcatactcaataatttcatttgcatgtaataagctccccaaacttaatatgttaaaaaccaaatttctgacccccactccaacaaaataaaacaaaatgaaactaaaacctgatccttctcagtctttccatcttagaaatgacaactttgttcttttattcatacaaaattagtgaattcatcaagaagatttttatcttttattaccaccctggtccagatctgacctctctctatcctcctgttgcaatctcctttagaaccttaggcaaaggaatcagcggatctcacagacctagagaggagaaaggtggtcaccagaggcctgcagagagagaggaaaggatgggcaaagagaagatattaatcaaaggttacaaagattcagctagactgggggaataggtttggctgatctcttgccccgcatagtgactgccattagtaataatgtatatctccaaattgttaaaagaatagattgttaacattttcaccccattaaaaaagataaattggtgaggtcatagaatatgttaatttgagtttttctctactatatatgtaaatcaaaacatcacattgtacaccgtaaatatacataattattatatgtcaatttaaaataaagttaaatttcttttaaaagtataaattagataacgttaattcaacactcacaacccttcattgctttccatgttacttattaaatagctcaggttctcaaaatagcccacaatatcttaatgatttcaccaataagcaagcttttcagccaccctgcctctaacttactcgtctccattcacactggcctcctggttgttactctagcatagcaagcacacctctgctcaggaaccttatatttgctgttgcttctccttggacctctatacacgtcaccttttcagatagaacatccctgaagaccctctatagaattgtggccccatacctgtactcggtccctgtaatctcgccacgaaatgtggcaggtttacataatactgtacccttagtgtctagaacaatgtcaggtatttattgagaagacattcaaactttgttgaatgagagaattcatctttgtttgtttgtttgtttgagacagagtcttgctctgtcacccaggctggagcacagtggcgcgatctcggctcactgcaagctgcgcctcccaggttcacgccattctcctgcctcagcctcctgagtagctgggactacaggcacccgccaccacgcctggctaattttttgtatttttagtagagacggggtttcactgtattagccaggatggtctcgatctcctgacctcgtgatccgcccacctcggcctcccaaagtgctgggattacaggcgtgagccaccgcgtccggccgagaattcatcttttgagcatggggctcagctcttgtcactgactgtgaatcgtattgtgctgctcacaaagttcaatggttttcttaatgtggaataattttatgtatgagcagatagaagggaaccaagagtaacatctcaagctcacctaccttgaaaagtccctttgtccttacaccttaccaccgcatactggatgtggcaatgaagtagaacaccagcctagtgttcctcaacctcagcactatgacatttggggacagataattccgtgtagtgggagattgtcctctgcattgttgcttagccgaatccttcccataggcctaacaggtgccagatactagtaacaatgcctacctccgcccctactcacgttgtgacaatcaaaaatgtctcctgaacttatcaaaagttccctggagtcgggagggggaaattgcctctggcctagaagatcttggatgcctccttagcctttgagggatgtgaggatttcatcaggagttttataatttggccttcacctaccacacctttctgcctgagactcagagaactgggaatctgtcctcttaggggctccggttttatccacattctcatcacctcacctttaatttccttgatacagaattctttctacattctcttcctatttggaaggacttcccctttcatcctcttacgagttggttccagcagaagtttggagtaaaattctttgatcagagttgcctgagtctggctcttgatttataaagaaagtgtatagaatttagaaaatattttgatcttccacagagactagctttccccaagtctttttcattcagagactcaaagaagtctaatgtgacagtcaaacaacttttctttgtagctgtcatttgccctccttctaaagcatgggacctcagtgggcaatgagtgataagccagtgggtgttactgtattagcagaatgaaacctataacaatttttaacttaatacaataaaatttggtttacgaaggaggagccaagatggccgaataggaacagctccgggtctacagctcccagcgtgagcgatgcagaagatgggtgatttctggaaatcatctgaggtaccgggttcatctcactagggagtgccagacagtgggcgcaggccagtgggtgcacgcaccacaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgagctttcagaccggcttaaaaaacggcgcaccacgggactatatcccacacctggctcggagggtcctacgcccacggagtctcgctgattgctagcacagcagtctgagatcaaactgcaaggcggcagcgaggctgggggaggggcgcccgccattgcccaggcttgcttaggtaaacaaagcagccaggaagctggaactgggtggagcccaccacagctcaaggaggcctggctgcctctgtaggctccacctctgggggcagggcacagacaaacaaaaagacagcagtaacctctgcagacttaaatgtccctgtctgacagctttgaagagagcagtggttctcccagcacgcagctggagatctgaaaacgggcagactgcctcctcaagtgggtccctgacccctgacccccgagcagcctaactgggaggcaccccccagcaggggcacactgacacctcacacagcagggtattccaacagacctgcagctgagggtcctgtctgttagaaggaaaactaacaaatagaaaggacatccacaccgaaaacccatctgtacatcaccatcatcaaagaccaaaagtagataaaaccacaaagatggggagaaaacagaacagaaaaactggaaactctaaaacgcagaacacctctcctcctccaaaggaacgcagctcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaaccggaagaaagggtatcagcgatggaagatgaaatgaatgaaatgaagcgagaagggaagtttagagaaaaaagaataaaaagaaatgagcaaagcctccaagaaatatgggactgtgaaaagaccaaatctacgtctgattggtgtacctgaaaatgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccgaagttgaaatgaaggaaaaaatgttaagggcagccagagagaaaggtcaggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaagcctgccctaaaagagctcctgaaggaagcgctaaacatggaaaggaacaaccggtaccagctgctgcaaaatcatgccaaaatgtaaagaccatcgagactaggaagaaactgcatcaactaatgagcaaaatcaccagctaacatcataatgacaggatcaaattcacacataacaatattaactttaaatgtaaatggactaaatgctctaattaaaagacacagactggcaagttggataaagagtcaagacccatcagtgtgctgtcttcaggaaacccatctcacatgcagagacacacataggctcaaaataaaaggatggaggaagatctaccaagcaaatagaaaactaaaaaaggcaggggttgcaatcctagtctctgataaaacagactttaaaccaacaaagatcaaaagagacaaagaaggccattacataatggtaaagggattaattcaacaagaagagctaactatcctaaatatatatgcacccaatacaggagcacccagattcataaagcaagtcctgagtgacctacaaagagacttagactcccaaacattaataatgggagactttaacaccgcactgtcaacattagacagatcaacgagacagaaagtcaacaaggatacccaggaattgaactcagctctgcaccaagcggacctaatagacatctacagaactctccaccccaaatcaacagaatatacattcttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactgggtacataacgaaatgaaggcagaaataaagatgttctttgaaaccaatgagaacaaagacacaacataccagaatctctgggacgcattcaaagcagtgtgtagagggaaatttatagcactaaatgcccacaagagaaagcaggaaagatccaaaattgacaccctaacatcacagttaaaagaactagaaaagcaagagcaaacacattcaaaagctagcagaaggcaagaaataactaaaatcagagcagaactgaaggaaatagagacacaaaaaacccttcaaaaaaatcaatgaatccaggaactggttttttgaaaggatcaacaaaattgatagaccactagcaagactaataaagaaaaaaagagagaagaatcaaatagacacaataaaaaatgataaaggggatatcaccactgatcccacagaaatacaaactaccatcagagaatactacaaacacctctacgcaaataaactagaaaatctagaagaaatggacacattcctcgacacatacactctcccaagactaaaccaggaagaagttgaatctctgaatagatcaataacaggagctgaaattgtggcaataatcaatagtttaccaaccaaaaagagtctaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaacagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaactcacaagggatgtgaaggacctcttcaaggagaactacaaaccactgctcaaggaaataaaagaggatacaaagaaatggaagaacattccatgctcatgggtaggaagaatcaatatcatgaaaatggccatactgcccaaggtaatttacagattcaatgccatccccatcaagctaccaatgactttcttcacagaattggaaaaagctactttaaagttcatatggtaccaaaaaagagcccgcatcgccaagtcaatcctaagccaaaagaacaaagctggaggcatcacactacctgacttcaaagtatactacaaggctacagtaaccaaaacagcatggtactggtaccaaaacagagatatagatcaatggaacagaacagagccctcagaaataacgccacatacctacaactatctgatctttgacaaacctgagaaaaacaagcattggggaaaggattccctatttaataaatggtgctgggaaaactggctagccatatgtagaaagctgaaactggatcccttccttacaccttatacaaaaatcaattcaagatggatcaaagatttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagagctaatatccagaatctgcaatgaactcaaacaaatttacaagaaaaaaacaaacaaccccatcaaaaagtgggcgaaggacatgaacagacacttctcaagagaagacatttatgcagccaaaaaacacatgaaaaaatgctcatcatcactggccatcagagaaatgcaaatcaaaaccactatgagatatcatctcacaccagttagaatggcaatcattaaaaagtcaggatacaacaggtgctggacatgatgtggagaaataggaacacttttacactgttggtgggactgtaaactagttcaacccttgtggaagtcagtgtggtgattcctcagggatctagaactagaaataccatttgacccagccatcctattactgggtatatacccaaaggactataaatcatgctgctataaagacacatgcacacgtatgtttatcgcggcattattcacaacagcaaagacttggaaccaacccaaatgtccaacaatgatagactggattaagaaaatgtggcacatatacaccatggaatactatgcagccataaaagttgatgagttcatatcctttgtagggacatggatgaaattggaaatcatcattctcagtaaactattgcaagaacaaaaaaccaaacaccgtatattctcactcataggtgggaattgaacaatgagatcacatggacacatgaaggggagtaccacactctggggactgtggtggggtggggggaggggggagggatagcatttggaggtatacctaaggctagatgacaagttagtgggtgcagcgcaccagcatggcacatgtatacatatgtaactaacctgcacaatgtgcacatgtaccctaaaacttaaagtataataataaaaaaaataaataataaaatttggtttacaatcttcaagaacattataaccattatatataatacatggtaattttcaagtatctcaaacacacatagaatttcatagagaggtataaatatttatgccaaaacacatggtataatgatttctttcctttgattaagaggcatttttatagtgatcattattaaatgaaataaatatttgcatgtggtacagtatacaatcctttcattacgaaatgttattttaaaagtatgtattgggtcctgaatcacgatgttttaaaatgtttgattttaatgagtcattgaatatgtattagcttttatgagatgcacatatttggaatatggctgtattcgtcagcataaggatgatttaaattttcttaaaatagactattaggatgcagatgttcttgctgacaggtgcttctaaagcattaaaaatacatgtaaccacagtgcttttgacaatgtaattctgttgccttcacacctattaagttgagcaatttcccttatttttctcaaacatgcatactaataaagtcatctatcagtgtttacatatatctaataattggaaaattacattttttatccataataagaaaaaagataaatacaattttgtgggaaatgctatgttagctctcaaataatgtaagtttagcagggcctcagggtaacaatgttttaaattaatcttttggtactatacatcaatttatattgaaatcatcaatttatattcaaatacctgtagtgctaagaccatgttttatttgtaatatcccctttaaacctcaagaaagagtccttattctaatctcataatttagtgataaaatgtatattcactttcccatttgtggcataattttcttagatgtcaaacattatttttctagactgtgaaaaacaaaggctttagtactatttatttgactgcgggaatgaaaataacattgttgagtatctgccctaagccaattactgtgctaatgacttttcttttagaatattgttgcctctttattctcttaatcattttaacattctttattttgacccactgcagtaacatttgatatactcatatgttatacgacaagtaaacatttcatttgctcccttcctttgttgatttcataatttcatgttatatgtagatgatgtcttcaggaaaattaatgactcctttattggttaatggagtttatcacttttcataagacaagtttaagtaatgtctatagattctgggttagataaatcagcaaagtttcatagagaaagagggcctgaacctcgaaagttaattatgctttagaaggcaaaaatgagcagcgggtcttttcagaagcgcatagggaatatgtaggattccctaggtactagtagttggccaggttagctgacgtgcatggtatctgtaagagagctgcgaatatggaaagaggatgaggctgcaacattggtgccttcttcattcagagaaggcactggaatgccaagctaaggggtttgtgattttcctgtaggtcctagaaggtgaaaaagtttgatgaaaatttttacacagagaagagaaagtgagtttgttatttcaggctgctataacaaatgatattagactgagtggtttataaatgagagtaatttatttctcacagttcttcaggctgagaagtctaaaaccagggtgccagcatggttgagtttttggtggtggccctctttcggcaaggagactgccaacttcttgttatatcctcacatggcacagagctcaaagaagcaagctttcttgggattctaaggtcttaatcccatgtgtgaaggctctacccccatgacttcatctaaaccctattacctcccaaagcccctctcctaatggcgtcacatagataagtggggtatcaacatatggattcttttttttttcaataggtttttggggaacaggtggtgtttggtgacatgaacaagttctttagtggtgatttctgagattttggagcacccatcacctgagcagtgtacaccgtacccaatgtgtagttttttattcctcaccaccctcctaccctttcccctgagtccccaaagtcccttgtaacattcttatgcctttgcatcctcacagcttagctcccacttatgagtgagaacatacgatatttgattttccattcctgagttacttcacttagaataatggtctccagtttcatccaggttgctatgaatgccaatatttcattatttatggctttttaaaagtaatgtttttttaaaacattatttatgctttatggctcagtcgtattcatatatatatgaatacacaccacattttctttatccactctttgactggtgggcatttgggctggttccatttttaattgtgaatggtgatgctataaacatatgtgcaagtatcttttttgtatagtgattttttttccctctgggtaggtacccagggcacgattactggatcaaattgtggatccacttttagttctttaaggaatctccacactgtttttcacagtagttgtcctagttttccttcccaccagctgtgtaaaagtgttcccttttcaacacatccacgccaacatctattatttttttttaatttttttattatggccattcttgcaggactaagagggtatcacattgtggttttgatttacatttccctggtcattagtgatgttgagtattttttcatgtgtttgttagccatttgtatatcttcctttgagaattgtatattcatgtccttagctcactttttggtgggattgtttttttgtctagttgatttgtttcagttccttgtagattctggatattagttctttgtctgatttatagattataaagattttctcccactctgtgggttgtctcttcactctgctgattatttcttttgctgtgcagaaagaagctctttagtttaattaggttccatcaatttatctttgtttttttgtttttttgttttttttgcattttcttttgggttcttggtcatgaagtctttgcctacaccaaggtctagaagggttttcccaatgttatcttctagaatttttatagtttcaagacttatatttaggtttttgatccatcttgagttaatttttgtataaggtgagagatgaggatccagttttcttcttccacatgtggcttgtcagttatcccagcaccatttgttaaatagggtatactttccccactttatatttttgtttcctttttcaaagatcagttgactataagtatttggctctatttatgggttctctattctgtggtctacatgactgtttttataccagtaccatgctgttttggtgactatggccttatagtataggttgaagtagggtaatgtaatgcctctagatttgttattttcacttagtcttgctttggctgtgcagattcttttctgatgccatataaattttagaactttttcttctagttttctgaggaataatggtggtattttgatggaaattgcattgaatttgtaacttgcttttggcagtatggtcattttcacaatattgattctacccatgcatgagcatgaaatgtgtttccatttgtttgtgtcatctatgatttctttcagcagtgttttgtaattttccttgtagaagtctttcacctccttgattaagtatattctaagtttttttgttcgtttgtttgtttgtttttgcagctatcgtaaaaggagttgagttcttgatttgattctcagtttcatcactgtgtatgtatagagctactgatttttgtacattaattttgtatcctgaaactttgctgaattcatctaccagttctaggagctttatgtatgagtctttagggttttctaggtatagaattatatcatcagcaaaaacagtttgacttcctctctactgatttagatacactttatttctttctctcgtctgcttgctctggctaggacttccagtactatgttgaatagaagtggtgaaagtgggcatccttgccttgttccagttctcagggcaagtattttcagcttttatccattcagtataatgttgactgtgggtttgttatatatggcttttattaccttaaggtatgtccttctatgccgattttgctgaggattttaatcataaaaggatgctggattttgtcaaatgttttttctgcatctattgagatgatcatgtgattttcattttaaattctgtttatgtggtatatcacatttattgacttgttgatgttaaaccatccctgcatccttgttatgagacccacttgatcatgatggattatctttttgatatgctgttggacttggttagctagtattttatcgagaattttttgcatctgtgttcattaaagatattggtctatagttttccattttgttatgtcctttcttggttttggtattagagtgatactggattcaaagaatgatttagagaggattccctctttctctttctctttctctaaaaatattgtcaataagattggtaccaattattctttaaatgtctgattgaattcaactgttaatctatctggtcctggacttttgttgttgttgatgataactttttaattaccatttcaatcttgctacttgttattggtctgttcagagtttctatttcttactagtttaatctaggagggttgtatatttccaggaatttatccatctcctctaggttttctagtttatgcatgtaaagattttcagggtagccttgaatgatcttttgtatttctgtggtagcagttgttttatttctaactgagcttatttggatcttttctcttctttttttggttaatctcactaatagtctagaaattttatttatcttttcaaagaaccagctttttgtatcatttatcttttgtattttttgtttgttttgatttcatttagttctgctctgatctggattatttcttttcttctgctgagtttgggtttggtttgttcttgtttctctagcctccttgaggtgtgaccttagacagtctatttgtgtctttcagactttctgatgtaggcatataatgctatgaatttccctcttgtcactgcctttgctgtatctcagaggttttgatacgttgtgtcactattatcattcagttcaaagaaatttttaatttccttctggatttcattgttgacccaatgatcattgaggatcaggttatttaatttccaggtacttgcatggttttgagagtttcttttggagttgatttcaaattttattccactgtggtctgagagagtacttgatataattttgattttcttaaatttgatttgtgtcttatcatatgatctatcttggagaatgttccatgagctgataaatagaatgtatattctgcagttgttggttagaatgttctgtaaatatctgttaagtccatttgttccagggtatagtttaagtccgttgtttgttgactttctgtcttgataacctgtccagtgctgtcagtggagtattgaggtcccccagtattattgtgttgctgtcaatctcatttcttaggtccagtaagtaattgttgtataaatatgggagctccagtgttaggtgcatgtatacttaggattatgatattttcctgttgcactagtgcttttatcatgatataatgtccttctttgtcttttgatatggtttggctgtgcccccacccacatctcatcttgaattgtagctcgcacaattcccacatgttgtgggagggacccagttggaggtaattgaatcatggggtgggtctttcctgtgctatacccatgatgttgattaagtctcacaagatctgacggttttataaaagggagttttcctgtacaatttctctctttgcctgctgccatccatgtaagacatgactttgcacctccttgctttccaccatgattgtgaggcctctccagccatgtgtaactgttagtcaattaaatctcttttctttccacgttacccagtcttgggtatgtctctatcagcagtgtaaaaatgaactaatacgtcttttttaactgctgttgctttaaagtttgttttctctgatagaataatagataacccagtgctcttttggtgttcatttgcatgaaatacctttttccacccctttaccttaagtttatgcaagtccacatgtgtcaggtgagtctcttgaagacagcagctacttggttggtgaattattcattatgccattctgtatctttaaagtggagcatttaggccatttacattcaatattagtattgagaggtgaggtattgttttattcatcatgttatttgtttcctgaataccttggtttattttcattatgttgttgttttataggtcctgtgagatttatgctctaaggagattctattttggtgtgtttcgaggatttttttcaagatttagagctccttttagcagttcttatagtgctggcttggtagtagtgaattctttcaaaatttgtttgtctgaaaaagattatctttctttcatttatgaagcttagtttcactagatacacaattcttgcctgacaatgtttggtttaacgaggctaaagataggactccagtcccttctagcttgtagagtttctgctgagagatctgctgttaatctgataggttttcctttataggttacctcatgcttttgcctcacaacttataagattatttcctttatcttgaatttagataacctgatgacaatgtgcctaggcagtgatccttttgcaatgaatttcgcaggtgttttttgagcttcttgtatttggatgtctagatccccagcaaggtcagggaagttttcctcagttattccctcaaatatgttttccaaacttttagatttctcttcttcctcagaaacaccaattattcttaggtttggtcatttaccataattgcaaacttattggaggtttgctccttttttaaaaattcatttttctatttctttgtcagattgggttaattcaaaagccttgtctttgacctctgaggttctttcttctacttgtttgattccattgctgagacttgccagtgcattttgcagctctctaagtgtgtccttcatttccagaagctgtgattatattttattttttgctacatacttcactggagagttttccattaatatcctgtatcatttttttgacttctttatgttggatttcacctttctttggtgtcttcttgtttagcttaatagttgaccttctgaatggtttttctggcaattcagagattttgtcttggtttggattcattgctggtgagtaatgtgatcgtttgagggtgttaaagaaacttgtttttgccatattaccagaattgttttctggttcattctcatttgggtagactatgtcagagggaagatctgggactcaagggctgctgttcagattattttgtcccatgggggtcctcccttgatgtggtgctctcctcttccccttagggatggggcttcctgagagccaaactgcagtggttgttatttgtcttctggatctagccaaccagtagagctactgggctccaggctggtactggagagtatctgcaaacagtcctgtgatgtgatccatcttcgggtctttcagccatggataccagcagctgctccagtggaggtagcaggggagtgaagtggactctgttagggtccttggttgtatttttgttacatgctctggttttgcttttgctcgcctccagccaggaggtggcacgttcaagagcacatcagctaaggcagtataaggaggatcaggcagtgggcggggcatacagctcccaagagattacatcctttgtcttcagagttccttgactgtcccatggagcctgtagcagcagtctacctctttcaaagggtctgtggattcttttggctttcctggtatgttcctgcagtagttcttggagcacaagtttacaatgtgggtctccacatgctgctctgtccatctaagtgggagctgcaagttggtccttcctcctatctgccaattttcctccattctcaacatatggattctgaggagatgacaaacatttaatacataataataagatttaataaaatcatgattttataagcagatagaaaagcctgacaaggggaaatattactaagagagtacatctcaaatgttaccataaaaatgtgaaatactggccaggcgtggtggcttatgcctgtaagcccagcactttgggaggccgaggagagcagatcacctgaggtcaggcgttcaagaccagcctgggcaaggtggtgaaactccatctctactaaaaatacaaaaattagtcgatcatggtggcaggtgcctgtaatctcagctattcaggaggttgaggcaggagaatcacttgaaactgggatgcggaggttgcagtgagctgagattccacgccattgcactccagcctggaagccaaaaatgaaactccattaaaaaaaaaaagtcaaatactgaaggtgataaataggttaattaccttgatctaatcatgccatattgtattgaaaaataataacatcactttttgtcccataaatatacacaacaataatttgtcaatatataattaaaaagaaaaagtgatttctagaagatgtttggaaggaaatcagatggtaaatcatatttactatgtctttaataatttcacactgtagccgtttcatgttttaaaaattgtaataaaaataaaaagtatagttctatacttaaattttttcattgaatgttgaactgtccactatgagggttgtggattttagttaatctttcactttggaaatgcctttgcagactaaattttgtttaagtgcacgagttgtgagtaagcctgaaaatagtttccttttttctaattttgcataaaagtgacataaatgccagctgctgcagctcagagcaaagaaaacagataatagatacaggaaccagtaaaacaatgctttcagagaatagtgctgtaaagaaaataaattaagataataaatggtagggcatattttagggcaatgttatgtaattagtaaaaaatggacattccactgaagctcaaagagctacatgttgtatgattccatgaatatatcttctagaaaaggaaaaattataagaacacaaaacagatcattggtttcctggggcatgcagcagcagaagaggtggactaccaagaggcacagtgaggtgttatgggagattagactgttctatgtcttgattgtggtggtaattatattatgtgtttctcaaaacttgcagaattgcaacataaaaagggtacatttttactataaattaattaggaataaaaactaatgaaaaggaaaaacaatgtcctgagaacaggatatatgacttgagatgcgaatgatgaatcccaggcagatggatctgcaagtgaaacctaagccagaacatccttcgtttgtttgagaaacaggaaggcaagagtcgtgtattagttctcatgcggctaacaaagatgtacccaagactgggtaatttattttaaaataggggtttaatcgactcacagttctgcatagctggggaggcctcataatcatggtggaaggcaaaggaggagcagagtcacgttttacatgacatgagagcttgtgcgggggaattcccatttattaaataatcactactacgagaacagtattggggaaatcacctcacgattcaattatctccacctggccccacctttgacatgtggggattattgcaattcaagatgagatttggggtggggacacagccaaaccatttcaggtggcctgagtctcctaaggaaagcaagggtgggaaataatgagatcaggtagcagatggaaactgaacacgaagacatagtactgtgcctgaaataagcttctgtgaattttctgctaatgtagaaggtcattctaggtcctagacagccttgaatctagaggaagaaagagatgacagaagctagataaatggagtaaagaaaaacatccgttgaatataaatccttccttccatggatgccactgccacccataatagaaaatttcatctcattgtaccctttcagaatgatagatatcacatcagacccacccagtaataatgccagtagtctgtttatatgacatgcacaatcattttaaaatcatacacatatatatataaaacaattgtctgtttaaacttaaagataatattgagatatattaaatgtacatttctgccctgtaattccttcacatgttatatgctatgggcaaagaaaacttaataaaggaaaaaaaaaaaacgccactttcagccttttcagttttctcttaggacaaaattgattttgcttttattgacattgtatagattgtgtcaaatttgcatagtaattctaagcctttccagttaattgacttttatatacaatacaaaaaagtccccccatgtcctgaacgtagtggtgaggcaagtcatttgagtgaacacctgcactcctgtatcaatatatatggttgttttgggaggttaatcaatcaatattttaaaataaaaaggtaaagaaaacaatgataaatatcctaaagacctatgaataggtgagaattgaagagaggcagtatggaattgcagtgtatagtgagaattctaaagttagaaaaacaggattcaactttcatatgccacatattagctctgcgattgtaaaaatgttacttaattcctctgattctaatttctcatttgtaaattggaagtaataataaaactatagggtttctttttgaaaataaaatgagatgcagcatttaacacattgcctggaacaggttaactgttagtttctattacttagagcagcacattgagataactcattaaaatatatctaatattttttactctacgggaaatgggagaaaaaaagacgagtatgtaaaaggttttacttcttaagtgtattactagagtaaagaccacaggaatgcatgcttgacaacataagggaaaaatgttttcaatcacattttaagacagcatagctgatgtagaagggtctagaaaagtcatgcagacaaggtcatgcagaaaattccagccttgactcttttggctgggtgatctggggcaagttgcttaatcttttaaagctcagtttcctctctgtgttttaggaataataaaagtactttccttaaagggtggttgttgagaattaaaagagaggatgtttagcatagtgtctggtacactgtcaaggtttaggaaatacagggataagcagaacatgctggtatgcatgaaggtagcatttacttaacacatgttcactgagtgtttactatgtatggggcattgtgatgaagtttgtaagaaacatcaagatgcacaaggcatcatctctgctattatacagcattcactactttagaaattgatcttcctgacagaagagattgggtttcgttctctgtattctcattgcttggcacagtcgctagcatataatatgtgcttagcaatatttttaaattgagtaactgtaatgataaatacacacacctcctttctaatgaaaactgagtttgaggaaagaaaaattgaattcccttcaagggagaaagagatctcactctttagtggctgttttacctgcttccaacagtattattgtttggctgcttttatttgttgtccgctactcctggtggattttgctcctgttattatcgcattcgtcattataattacttctgacccaaccacaaataggtcctctaatttgatcaagatctctctcgatctttatgcaccaagctcatttatttagtatattggctttcaaagtgtagtgcctggataaacagcatcagtatcacctgggacttgttagaattgaatattcctgggacctatcccagacttactgagtcagaaactcaggaggtgggtcacagaatctgtattttaatgagccctcccagcaatcctgatgcactcaaacatttaagaactgctttcatagcttcccccaactgttgtctctctcttaaagtatatgttttttttcttctgccgcggttcttggaataaattatagaacttgagctgaatgaattcttgtaactaaactgaacaatgacatccctgccatgttctgtcccaatagtgggttccacagagtgccaggctgacactcaggccttgtcaggtttcttgtctctagatccatttctgacctttccaagttgtcacctataaaattagattttttttaaatttttatctttctttaagaaagttgatcctggtgtctagaggtctaattctgcaccacagatcagtttcactgtctggtgacttaaagagtcttaatgctgttggactctgttatgttattccattcactgaggtaggcatggaatccctacagcctccctctctgattcacaaatcacaaagtatttagcaatatatggtagatttataatgttcataacagttagtcaatgtgagacattcagcagccagagttcactttccttaggaggtcagcagaggagacttcttggtgatgtcatcacacttgtcttgaaagacctttgagggccagccactattactaaagaaaaaagtataaggtgataaatagagtaatagtgagataaatatatcactctattctcaggagagtaggaagtcagatgatcttacctaactatttgacctgacactattttttgaaaaaaaattctaatcttaattgtagttctcatttaaagacctgaagagttttttgtttgttcatttgtttttgttttttatatttgtgcttaagctatttcaaagcttatgaatggaaattattttataaatcttttgattcatagaagtttcaacccataacactgaaggaaaatattggcatgccaagaattgtgattccatacaggaatagaatgtcatgcaaaaaaaattaaaaatgtatgttttctgattaatatgccatattcttattttcctggacctttaaaaatcataagaattgctatggatcagcctcacacaccactctttggatggttgtaagttctagtagaagtacatagtgctgacccttttaaaatttctctgttttacacagagaatataataatatatgcacccatattgacttctcttacattttttttctgaaaataatgagtacatctactgttgaagcaaatgcaaagattaatcacttgtaattttcccatcatatatataaatcgcacctttatttctggctttcacagaaagtaagtttcaaaatgagtttcaataaatacatattatcaaagttaaacatgagaatgaatttactttcattaaaaatcaatgttggacattattattaagaagagcaaggtgacaaaaatgtagtggaaatcaatgttggacattattaagaagagcaaggtgacaaaaatgtagtggaaacatccaaatagtcaaatgatctattgttatgaatttacctacgttaaattgatcatttgttaattatgttgttatgttaattatattatgttaattatgttgttaatttgatcattagtgagggaggaagatccagtagttaaagaaggcggggatgctaactgtccttgctatgtagtatgtcacaaggaaaactggtctcagagcaaataacattaaaagcaggcataacaagtgtcataccactctctaagctctattaaattccagatcctgttctttttgatgctctgacaacaccttgaatgtttacttgagatataattcataatattgtagcagcaacattcagctaaccttttggtcaaaatcagggcacatacaaaatctccaaataagcttccgaacacactgacaattcaattctcaaggttaaggtgacaatccagagggctgtaagttattgagatctctgggtccctctacttcattcttttgtgcagaagcaattgtatggcacttctatcttgtccaaactggaagaccagccgtttcactattcaatttgaaagtatgcttatgttatttatcaagcctctagccttgattggagataataatactcaaatgcttatagtagctgactgtggtacatggcctttggattacaattctttagttgctagctaaccaatctttcagaatattttattattaaataactaaccatgaattcttatatttctgattagtacgtttcaaattgtatattaaaaccaatctgctgtgtacatttgtgtgtgtgtgtgtgtgattcattgacaatataacaaaaattttaactttcttgaaaaggatactcttctcctctaacagtactcttctttagtctgtttttagctgtcagtactttgtgtagaaaaatttcctctgatatttgtttataattccaactgagtttatgtctgaatttgaactttttaaacttttccatgaattagactgtgagtttcctaggtagtaagcttttgagcacttatcgtgatgcctgacaaattacagatcctcaataagtagttgtggaatgaatgaatgaattcttgaacgggcctccttccacaattttagtactcagtctattacccaggcttgtgatctctgaaatattttgtagcttttgaatgttatctaacaaaacaatttttaaaacaatcaaaatatttaagtgacttttgttacagtaggaatgatataaagtctatgaattaaatttcacctaaatataaatattacaaagttgtaagggagctcttctagaacaaaaccaaacaaaaaagtagtttatctgtatacaatccaaaaatatggaaatcacttttcttgttcaaagataaatacattatcaaaaaatgtgatacattttagagcttctattgctcaatggatatgggaataaaataagaaaacacaaataacttcgattcagcctttaaccccgaagccacatgtttccactaacaagaagaaatccttgagagaaactttcagcaaaaagaatgttgacagaagagctttgagttagtcctgggtctttgcttaatgagataaagaagcaatcttggcagacaacttactgtaaaattccaacagtctttctcttttcatgtcatcaaaactttaattttctaaatctgtttactgggaagggcaaagagttctcctgtaagacttagatgtgtattttaagttccaagaactgatgagttataaccttgaaactgggaaagctttcacatttcttaaaatgtattgtagaaaactgttttttagtctcttaaagttgaaaactgtatttgctgaaagaggttggttttgcttaccatcatgtggcaatttatcattgaccatgacccagtgatctagctatgattaagtaaatctgatttaaaaagtctgcagtttctccagaattagaaatatatataatgatatttcccttgaaaaacttattttgtaagtaaaagcagtatctaatagattaactttaaaacataatgtaaaatctttttgtgtaaatacaatatacaatttgtataaagatatacaatatacaatttgtataaagatatacaatattactcctggaataatagcatgcatgcactgcctttttttcgttaaggtaacacatttctatgacatttttaagaagaaattgttttaaaatatctatgctaaaaacatcattacttttcttggtcctaaccctgatcaccagtctctggaagcaatcactttcactttaaatgtgtgtgtgtgtttgtgtgtgtgtatgtatacatgtatatgtcttgggcactttcttcagagaatttcacaggtgtaaatggaataatcaggacatatctatatctctttatatatttctatagagagagtgtgtgtgtatacatatgtatatatagttacagtgtatatatagagaaagttatataatgtgtgtgtatatatatatatatataaatatatatatgtatatgcatataattttccttataaaatatccctcctgtagtcctccatcctcctgtttctacctgcattcttcactgcctgggctggctactcctggtatttctctttgtcattgccctgattatgagaggctaaacaaaagtcatagatactttgtaaaacaatgaccagtgtaaaaataaaaagtaaacaagtgtccaaaagttctaatgggtgaataatattcaactgtattgttttaccataaattttgcaataaaatccctgtcattatcatttaagttcctctttacttactaacatttctctaaacagtcttgcataaaattgatttgtgtaattttctaagcactgtggatatggatatgtttccatggcaaaattttaatgttggtcgttctgggtgatgtgttcataggctattttattttaatgataaaatttgttcaattcgggactcgcagccaagatggccaaataggaacagctccggtctacagctcccagcatgaacgacgcagaagacgggtgatttctgcatttccatctgaggtaccaggttcatctcactagggagtgccagacagtgggtgcaggacagtgggtgcagcgcaccgtgcacgagccgaagcagggcgaggcattgcctcactcgggaagcacaaggggtcagggagttccctttcctagtcaaagaaaggggtgacagaaggcatctggaaaatcgggtcactcccaccctaatactgtgcttttccgacaggcttaaaaagcggtgcaccaggagattatatcccgcacctggctcggagggtcctacgcccacggagtctcgctggttgctagcacagcagtctgagatcaaactgcaaggtggcagggaggctgggggaggggcgcctgccattgcccaggcttgcttaggtaaacaaagcagccaggaagctggaactgggtggagcccaccacagctcaaggaggcctgcctgcctctgtaggctccacctctgggggcagggcacagacaaactaaaagacagcagtaacctctgcagacttaaatgtccctgtctgacagctttgaagagagcagtggctctcccagcatgcagctggagatttgagaatgggcagactgcctcctcaagtgggtccctgacccctgacctccgagcagcctaactgggaggcaccccccagtaggggcagactgacacctcacacggccgggtactcctctgagacaaaacttccagaggaatgatcagacagcagcattcgcggttcacgaaaatcctctgctctgcagccaccactactgatacccaggcaaacagggtctggagtggacctctagcaaactccaacaggcctgcagctgagggtcctgtctgttagaaggaaaactaacaaacataaaggacatccacaccaaaaacccatctgtacatcaccatcatcaaagaccaaaagtagataaaaccacaaagatggggaaaaaacagagcagaaaaactggaaactctgaaaagcagagcgcctctcctcctccaaaggcacgcagttcctcaccagcaacggaacaaagctggacggagaatgactttgacgagttgagagaataaggcttcagatgatcaaactactccgagctacaggaggaaattccaaccaaaggcaaagaagttaaaaactttgaaaaaaatttagacaaaagtataactagaataaccaatacagagaagtgcttaaaggagctgatggagctgaaagccaaggctcgagaactacgtgaagaatgcagaagcctcaggagccaatgcgatcaaccggaagaaagggtatcagtgatggaagatgaaataaatgaaatgaagcgagaagggaagtttagagaaaaaagaataaaaagaaacgaacaaagcctccaagaaatatgggactatgtgaaaagaccaaatctacgtctgactggtgtacctgacagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcaattcaccaaagttgaaatgaaggaaaaaatgttaagggcagccagagagaaaggtcgggttaccctcaaagggaagcccatcagactaacagcggatctctcggcagaaactctacaagccagaagagagtgggggccaatatgcaacattcataaagaaaagaattttcaacccagaatttcatatccagccaaactaagattcataagtgaaggagaaataaaatcctttacagacaagcaaatgctgagagattttgtcaccaccaggcctgccctaaaagagctcctgaaggaagcactaaacatggaaaggaacaactggtaccagccactgcaaaatcataccaaattgtaaagaccatcgatgctaggaagaaactgcatcaactaacgaacaaaataaccagctaacataatgacaggatgaaattcacgcataacaatattaactttaaatgtaaatggactaaattctccaattaaaagacacagactggcaaattggataaagagtcaagacttatcagtgtgctgtattcaggaaacccatctcacatgcagagacacacataggctcaaaataaaaggatggaggaagatctaccaagcaaatggaaaacaaaaaaaggcagggtttgcaatcctagtctctgataaaacagactttaaaccaacaaagatcaaaagagacaaagaaggccattacataatggtaaagggattaattcaacaagaagagctaactatcctaaatatatatgcacccaatacaggagcacccagattcataaagcaagtcctgagtgacctacaaagagacatagactcccacacaataataatgggagactttaacaccccactgtcaacatcagacagatcaacgagacagaaagttaacaaggatacccaggaattgaactcagctctgcaccaagtggacctaatagacatctacagaactctccaccccaaatcaacagaatatacattcttttcagcaccacaccacacctattccaaaattgaccacatagttggaagtaaagctctcctcagcaaatgtaaaagaacagaaattataacaaactgtctctcagaccacagtgcaatcaaaccagaaatcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaaaagaaagcagaaaagatccaaaactgacaccctaacatcacagttaaaagaactagaaaagcaagagcaaacacattcaaaagctagcagaaggcaagaaataactaaaatcagagcagaactgaaggaaatagagacacaaaaaacccttcaaaaaattaatgaatccaggaactggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattccttgacacatacaccctcccaagactaatccaggaagaagttgaatctccgaatagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacactgatgcaaaaatcctcaaaaaaatattggcaaactgaatccagcagcacatcaaacagcttatcaccttgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatggcaaaataataagagctatctatgacaaacccacagccaatatcatactgaatgggcagaaactggaagcactccctttgaaaactggcacaagacagggatgccctctctcaccactcctattcaacatagtgttggaagttctggccagggcaattaggcaggagaaggaaataaagggtattcaattaggaaaagaggaagtcaaattgtccctgcttgcagatgacatgatagtatatctggaaaaccccattgtctcagcccaaaatctccttaagctgataagcaacttcagcaaagtctcaggatacaaaatcaatgcacaaaaatcacaagcattcttatacaccaataacagacaaacagagagccaaatcatgtgtgaactcccattcacaattgcttcaaagaaaaaaaaatacctaggaatccaactcacaagggatgtgaaggacctcttcaaggagaactacaaaccacttctcaatgaaataaaacaggatacaaagaaatggaagaacattccatgctcatgggtaggaagaatcaatatcgtgaaaatggccatactgcccaaggtaatttatagattcaatgccatccccatcaagctatcaatgactttcttcacagaattggaaaaaactactttaaagttcatatggcaccaaaaaagagcccgcatcgccaagtcaatcctaagccaaaagaacaaagctggaggcatcacgctacctgacttcaaagtatactataaggctacagtaaccaaaacagcatggtactggtaccaaaatagagatatagatcaatggaacagaacagagccctcagaaataatgtcgcatatctacaactatctgatctttgacaaaccggagaaaaacaggcaatggggaaaggattccctatttaataaatggtgctgggaaaactggctagccatacgtagaaagctgaaactggaacccttccttataccttatacaaaaattaattcaggatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctagtatccagaatctacaatgaactcaaacaaatttacaagaaaaaaaaacaaacaaccccatcaaaaagtgggcaaaggacatgaacagacacttctcaaaagaagacatttatgcagccaaaaagcacatgaaaaaatgctcaccatcactggccattagagaaatgcaaatcaaaaccacaatgagataccatctcacaccagttagaatggcaatcattaaaaagtcaggaaacaacaggtgctggagaggatgtggagaaataggaacacttttacactgtgggtgggagtgtaaactagttcaacccttgtggaagtcagtgtggcgtttcctcagggatctagaactagaaataccatttgacccagccatcctattactgggtatatacccaaaggactataaatcatgctgctataaagacacatgcacacgtatgtttattgcggcactattcacaatagcaaagacttggaaccaacccaaatgtccaacaatgatagactggatgaagaaaatgtggcacatatacaccatggaatactatgcagccataagaaatgatgagttcatgtcctttgtagggacatggatgaaattggaaatcatcattctcagtaaactattacaagaacaaaaaaccaaacaccgcatattctcactcatagatgggaattgaacaatgagaacacatggacacaggaaggggaccatcacactccgtggcctgttgtggggtggggggagggggaaggggggagggagagcaataggagatatacctaatgctaaatgacgagttaatgggtgcagcacactagcatggcacatgtatacatatgtaactaacctgcacattgtgcacatgtaccataaaactttaataataataaaattaaaaaaaattgttcaattcaaattttcaacaatggacatgtattcgcatttataattttgaaaagaaaaaaatggacaatggtatttttatactattttaagctccccaatggcagacattattttcactgaatcatgaccaagtcaagttcagtgctgggaagaggggacttacattaaatatataatcagttacttccaggctctgcctcttattggataaggatagacactgtgacatcagagatcaccgtgctgtggaccgaacaaatgccatgtaaacagtgaccatgaccttttatgatcactgtctttctggaatttgacaaactcagagaaaagtttagaggaatgtatagactaaatagtccatttgctattgtgacattgatgatgaaacctttaagaaacttttgatttaaaatgtgttcatgaccttgtgttcataatttcacaattgagaggcgtccctccacattcttggaactgtgcacccattggaacctttaaggtaaatctaaccagggaagtttctcctcagaagaagatggcatccttgatgtgaacagcttttcccaagatcatgaatcaagacttctgtactatcttgagactcttatctttgagtaatttttccccttgtttaggcctctatgaacaatagaaatgaaaagaggtcttctgtgtgcacttactgggtatacttttacttgtgaaggatttggcagccagacttatatgtagataaccttatattttgatagataaaatatgaaagcccaatgtaggtgagagacttaaatggtacatacgttgcctcataatcagtcagaaacagaactttggttcactccctttgacccacatcatgtgttaaagagaaggttgccaggaggccttcactcttctagaagggcatcatttgttaggtactttttccatggtttggagtaaaagaagcaatgattagaaatgtatccctcatgataagctgtctagcaaactctactttaaaggctataattacacagcagattttaaattctcttgtgaaagttatgctaaataatcgaattgctttagattgctgactggctaaacagaagtatctgtgcagctgctggcacttatgtcttgtggagaaagcattgggtattacagacactcagttgtaggggattaagaagaggactacttaatcaagcgagtaaactctttatctagctcattctttgatctatttgattttaagtgatttggtttatggagaccctagtagggaccatactttcaactcttggtgttatcctcccgatagtcataatagaagtctccctggtgtgctgtatgctctcaaaggttttaaatgtttgcattcagacatctccagaatgtcaggtagtctctcttcaacagaaatgacaagagctgaaagaactatgcaaccatgggaaaaccgtaatctatgaatgaggtgctaagaccggaaacccaaaatgatggtaactgagagtagcattaaggccctaaagtttggtcacactctcacctaaatgagaacctgaccaaaaagggggaattcttaaaacaaaattacgggaggctattgtttggactgagctcaatcactaggcaccaacagaagaaactgtataaaaatggagtcacttgtgctaagtgtgacataatcaagctaagactttaaggaaacacatagatcctagaacagacgaggttttgtttttctcctgcaaacaggacgtttctgtataaggaggtaccatctactcaatcctcattcccaccttgcaaaacccactgttctactgttttccagtgggtttcaagaccaaataagtacatttacgatggtgatagtgacatcgatgaataaagttttggccaatctctcaaaattgagaaaatgaccaaaagcggggaattgttaaagcaaactaactgtggcctaagaaggactccttacttttatatctgagtccttgtggatgaaccataacctaacttaataggtagacaagattgaaaacctgacttagaagtatgggattgtcacaatatctgaatcttggcaaatcccagcagccatacttcaaccagtcatagactgctgagtgtttaaactgtgttcaaagagggcaaacactgaactgtaaccaatccagttgtttccatacctcacttccaatttctgtaggccacttcccttttatgtctatagatcttcttccaccatgtggctgtactagagtctctgtgaacctgctgtgattctggaggctgcctgattcacgaaggtttcattgcttcactaaactcctttaaatttaaaataaaataaaatgtgttcatgaacatgagttctaggttggttttggcagttttgtaagatcaataaaagcttcatttaatttatttgaaaacagtgtttaggaataccccaaagtatgttctcacatcgagggatttagaaagtgaaaaccggccgggcgcagtggctcatgcctgtaatctcagcactttgggaggccaaggcaggcggatcacgaggtcaggagattaagaccatcctggctaacacagtgaaaccccgtctctacttaaaaaaaatagaaaaacttagcagggtgtggtggcacgcgcctgtagtcccgggaggtggagtttgcagtgagctgtgatcacgccactgcactccagcctgggtgacagggtgagactcttgtctcaaaaaaaaaaataaaaataaaataaaataaaataaataaaagcgaaaaccgactgttaatacttgtacactttcaaaatgatgaatattttaaagtttaagttgttctcactagagttaactccaggatttctttatttctgttaagaagaggaaaccttgctatgggtagtgcttttctcacaagcttttctcacaggggcacttgcctgaaattatgtggtttattttggtttataaaaagtggctgggacaaggctgcaaaggttggtagtaaagtacctgacacctgccctggaaacttccattggctcttgctcttacttttattttattaaaaaaatgcacgtgtaagagagatggtgttgaatatgttgtaattataaataatgccaacctaaaataattaaaaagggttagaatctagtttaataagagtttattcaagcacaaagtttgaagacagccactcaggaagcacaggttacaaagactaaaagtcagtgttctgatggtagaagcttagggttgtttatagagacaaagtttaaggaagctaaaaagaatttcaacatctttctgtacaaggctggatgcatatttacaatgatctgattagttgagactgtatttttctttcaggaagggtatatttaacattccaccctgaagatgtaacagtcatgaggtcgtttgaaccatctggtctgagttaggtacatgacaataaaagaggtagttaatctataacaaagataagtgaattgaaggggtaagatgtctgatctctagtctcccctagtcatttacagagcaagaacaatgaagaagagagtaaatctataatctaagaagctgaacttgcacacatactatgtgactcatctccaaagcttaactttccccttggcgtaataaattaagagcgtcctaaaattacaatccacagataagtatagatacagcgctttatatgtgtgtgtttatatatatctctctgtatatttacatatataatatataagtagtagaagtagaagtagttttatatattatatatacatatatgtgtgtacatgtatacatgtgtgtatacatatgtacacatatatatgtatatataatatataaaactacttcttttgtacattgtattctgcttctaagaatgacatcactgcaaaaacaaatccctccactccacatccatgttacagtgaaacatttctcattaatgctccatcacttattaatttaaatgttagattctgtttagggtattatgtttataatttttattctgattgccatgtaaaaatatttcgttaaaatattgtaaagtatttttgaaatgtcttgctaatcttattattctgtatattccttattagcccatcagcttctcgagggacaaaaaattacgcatttcatttttattttgtgtgctcaaatctattgtcttattcatcattcaacaaatatttattgagcttacgatataccaagccaagcattagatattggtagtcccagaaatctaacaatcctgatgaattgagtgattattgaaagtgaatttacaaattcatcatccttctatctaagttttagtgcagaaagacattgtcaatgcaggctagcctttactgtaggacaaatggaaacctgacatttacaagaaaatataatttcataatgtatctaggaggaaaaatatttatcactgccaacccaggaaaaaatagaaaacttaacaaatgctaggtattgaccaaagaaacacatgatcaactgtaaatctacccccaaatgagaaaaaatgcattttttcttctactagtagctctaagcaagcggcagtctacaatgttttttcttgttctatagtatgtttcagaaactcacaataggagttcgttttgaattcttctgtgtagctcattttccatttggggaatctatttcttatccatttgtccacatctataactagcaaatagagaattcaatatagcaaatgtgcctacagtaaattcaaaattgcctctcatccatttgtgagcaacacataaataatgaaggcgacattaaaacttcgggtttttttatttttacttctttctctgaaatatcttttccagcaaaataaatggtttgaaataattatctatttagaagcactgcaatagctgtgggaatgtgattgccatttacctttcaggattttacggttcccatgagaagaagaaattttttgattccttgattctcttttccttcattatacttcattcttaacccatcagttttttaatttgcctgtaatagatggggctcagtgtctcaagagcatcccaattttatggttatagaaaccagacttagtagacaaaatgtttccttttgagcaaagacttagtggttttagcacctacaaaaaaactaaaggaataaaatggaaatgcaagggaaaccaaaatgcattaaaggttaaatttttcaatatttgtatttctttcttaacttggcacaaatgagattttttttcagttttttacattttatttttgactgctttgaatagtgtcggcttgccaaagtctcaccggactaatgcttacagcagaatttaacacattgccaaactaaccctgaggtgtggtttacactacagaaaagagtgttttggcacaattgccaatttagaaagtacgaaaggagtggcagaacttattgccatagagttagaattttacatctatactgcctattttttaaaatttaatatttcattgatgtcacgaaaaacattctcatgcgtcatattttggtccctttctttttttatttttattatttatttatttattttttgagatggagtcttgctctgtcgccaggctggagtgcagtggcacgatttgggctcactgcaacctctgcctcccgagttctcttgcctcagcctccctagtagctgggattacagtcgcccgccaccacgtccagctaattttttgtattttagtagagacgggtttcaccttgttgtccaggatgtcttgatctcctgacctcgtgatctgcctgcctcagcctcccaaagtgctaggattacaggcgtgagccaccgcacccagccccttatttttttaacagagtgttaaaggtggagtgtggaaggtcttaataaattatgtgtttgctgtgtgtatgtattaccatattacacatgcagtgataagaagccattctcatgataccttgttggccaaactgggttgaaattgaatttaagctccacagagattgtgactacacattagtgtagtaaatatatatatatacacacacacacacacacacaatatggtgtgtatatatatacacacacactgcactatatatatatacagtcgtatacatacagttgctgtatatatagttgttatatatatgtgtgtgtgtgtatatacatatagagagaaagagagagaaagagagagagagagaattgttatattatcttgctaaatgggccactttctaattatataattaccatctttgtctctttttacagcttttgacttaaattgtattttatctggtttaattctagctattcttgctcttttttaaagtttctatttgcatgagacatctttttccatttctgtactatagttaggtcctatttttttaaaccattcagccacttcttatcttttggttggataatttaattaatttacattcaaagtaattattgataggtaataacttactacactatattgttcattgtttcccagttgttttgaagattctttcttcttctcttactgtcttctttgtggtgattttctctagtggtacaattattttgttgctttttatttttagtgtatcaaagttatttgctttgtgattatcatgaagcttgcaaaagtcatcttacagttataacaggatattttaagcaaaagcaacttatctttgatcacaaaaaagcaactctacactttaactctacttcccctctacatttcaattttggatgtcacaacttttatcattttatattggataatccttaacaaattactgtagtgattactaatttaatagttttgtcttttaaccttcatactaatgatatacatgatttacacaccgccattatagtatgaagatagtctgaactttactttgtattttctcttaccaatgagttttattctttcagatgtttttgtgttaatcttagtgtcctgttctttcaactcatagaaccctctttatcatttcttctaacacaggtttggtggtgatgagctccctcagctttgtttgtctagaaaagtctttgtctcttttttatttctgaagaacagttttcctgggtatgctactcttggttgacagatttttttttttcttcagcatgttggatatattatccaaatcttttctggactgtaagatttctgctgagtgtgtctccagttaggtatattggaacttccttatatgttatttgctgctttagtcttgctgttttcagaattctctctttgtcttcaatttttgatagtttgattttaatatgtcttggggtattcttatttgtatagaatctgaatgaagaactttgaccttcctgtacctggatatttttatcttttcctgagtttggaaatgtttctgctcctatttctttaaatatgctttctattcttttaatatttctctttcctttatttaacttctataactcatatagttgcttttttgatgttgtctcataattcttatgcacactggaatggaatggaaaaataccttcaaaattctatgaagaaaaaatatagatgtaaaattctctacataactaaactatcagtgaaacagtgggttagatgaacaaatttatatatgctggagcctaaaagaaaaaccaactttactcacttactctccctcagcagagagaataagatatgtgaaggcgctcatcaaattcaaataaatgacattacagttattgaaatatataatacatgggagaatgaaagaagattgggaaaaaggagtgaggtacaaggactattacaagaatgtggctgaaaaacagaaaatgtttcaaaatgattgtaactgttattacaagctatatatcagttattattaaaaacaaaaaacttgcataaattaaaataaaaaggccgacactgcagtgggaggaaaaggacaatatatatgcaagaataacttactgaaaagacacaggagtggccaatgaaaaacaaagaatgcatgttcaacctatcattaagaagaataataaatgaaataccacaattacctattgactgagaatcaaatttatgtataatgccaatgttagtgtgttttggagaactgccaatgccaatgttaattgttataatctttccaaaatatcgacattgaatgttgcctgcatcaacactaaaataggcttaatctttgaccttactattccaccttttattataaatgattgggaatagctcttaaaggacattgaaatgtttctattacaacataatttatcacagtaaaaatttagaaatagtgttcatttttacatgttggcttaaaactgtaaaataaaatagagtgtacaattaacccttgaacaatgtgagaattaagggcacagacccccctgtcatgcagtcaaatacccatatataatttttgactcctaaaaaacattatagcctactgttgaccataagccttacttgtaatatagtcaattaacgtgtattttatgtttatgtattatatactgtattcttactttaaagagaaaggaaaatggtattaagaaactcataagaaagagaaaatgaggccgaggcaggtggttcacctgagatcaggaattcgagaccagcctggccaacatggcgaaatcctgtctctactaaaaatacaaaaattagccgggtgtggtggcatgcacctggaatcctagctactaggcaggctgaggcaagagaatcgcttaaacctgggagacagaggttgcagtgagctgagatcatgccactgcactccagcctgggtgacagagtaagattctgtctcaaacaaacaaagcaaacaaagaaaaagagagatagagaaaatacatttacagtactgtactgtatttatcaatactctaagttacatcatctgtttacaaggtgaattgttggtctgaagtagtagcaaccgcagctgcaggcttctgtctatggtacatatcatgccatttagcttttactggtgatgtcatgacttttctctgcttcttgggagcacttcgagcatcactagtggcaccttgtatgggccccatggtgtcattcaagatttacagtattgcactaaaaatgataagaactacaggagaactgagagaaattacttactactgcaatactcaattactggagagataaactgcttacatgaagatgattagcataacacagcattttaggaggatactgacaacaccagctcaccgcaatagcagtaactataaagttattactatagtttaatttgtactatagttaattttatagttatgatttaatactgcacctttacttttgtttatatttctctcaactgcaaatggtaccatatatggtctgcgtttctgtgtgtaagttttgataaatttgaacttttcatactagatttgtgtatcatttatggtagtaaattatgaaatagacgagtatcaacatatattttatatgttcctgacatggctatttttttcttaatttttctatatttctaggctgtgagattcatctacaggtttttttttttcaaattgttgcaaatctccaatcatttttcaatacgtttatttttaaaaatccatgtataatagacctgtgaagttcaaacccatgttgttcaaagatcaactgtagatttttttaattttacagttatcaagcacatttattatgtgttgcatatggtatattgaatcttaattctgtgttatatcttaatttttatgaaacaacctactgtagttataaatatgataataaattagaaaatattcataaaggaataatgttaagtggataaggtaaaatactaagcagcaacgatgacattcctaaacttgcaagattattaatgtagatatacatatgcatagaaaaatcttaaggctgcccaggcgcgggggctcacacctgtaatgccagcactttgggaggccaaggtgggcggatcacgaggtcatgagatggagaccatcctggctaacacggtgaaaccccatctctactaaaaatataaaaaaattgctggacgtggtggagggcgcctgtagtcccagctactcgggaggctgaggcaggagaatggcgtgaacccaggaggcggagcttgcagtgagccgagatcgtgccactgcactctggcctgggcgacagtgcgagactccgtctaaaaaaaaaaaagaaaaagaaaaagaaaaatcgtaaggctatgcatagcaatttaatggtagttgtctcaaggtggtggggttatgaatgatttatgttctgtcttttctgttggcatttctttttatatttttcttctgtgaacacctgttgctataaaaatactcagtgcacgtgataataaacatataaagcattctgtatagtctcactgacatttgaaaaaagcctctaggttttatttctcattgtgatcattgcaatgggcatcagaactgcatgtgtaaaaacgatcttgtctgttcttgttatcgtctgcaccctttatctaacatctgtatcactgcttagctggaagcatctcctttagcacggcactgccatgttttatgttctaatgtaaacttgtgtgacttagctatggttaaatagaaataactggtgtttcagcttgatttttgtaacagattctgaggcacgtttttctgtctcaacccgggaatatccatttctgcaccaggacaaattaattacaatactgatgtttaagtatttatggttagtcaaatcttgaatcaaatcgtaacagaaatggaaaacagaaaataagaagagagaggagaaggggaggaggaaaaaggcgcagcagcaacagctattttgagagattgggaaggatcttaattgaaaaaaattgttctttccccaggcttggtcggcgaatcacttaatccactcatcccttcgtcttttcatagaattaggaaagatatttagctcaggccctagaatcagactaatgctgactcgttcttgtctcgaagggctttctacaatttactgcattcagctccatactattaataataatgttgctgcttttcttaaaatccatgttggaaatgtaagaaaatgtaaagaaaattttatttcatatttcattttacatctccaaagcccccaccatctccagaaagagtacaatgatcattttctttgtctctttatatttgaacaatcatcacaacactaaaactacttcgccgttgtgctaagacctcctcctgcctagattgccaccatggcccaccttctccaatttagaagagggaaaggtggggccaaagagagacctttggtgggttttctaccaataagtttaaaaagatactgaaaaggagacccttccttccttcccttccttccttccttccttcctttccttctttccttccttccttccttctttccttccttccttcctttcttctttccttccttcctcccttttctttctctctctctctctgcttcaaatacactttttattcccctgtagaatcagaaaatatctgactgcttgagtctaaatctaccagactaaggaagcctcggaaaagcttttactatttcctcttccctgtctgtgatttttaaaagcatagaaataaaagttcattgtttttatgttatttgtctaaatatatttccatgatatattttaataaaacattccttaggtatttatagttataggattgatggaacagatataatataaagtaagtaaaaaatcttcatttcaaataaagtatccaaaacaaaaatttgattattgagctttaataacattttttaggtttaggggaggcttaatttggggaactggctattagaaaaaaattatttgaaattgcaatagataatgagctttaaaggtaaaaggttggtgcaaaagtaattacagtttcagtctgtgaatttaaaatcatgtataactaggctcaaacacatctttattaattaaaataggaaccattacaatcaacacattattgccaaggagaagtaaatttattcctgtagcgtaaaaagccatgcttcaggatttgatgaattcttggaaagcattttctacatcttgctggttccaacaactcaaaaactgcaattactttttcactcacctaatattagattagaaaaagatcattatttaaaactgataattgaaaaagagcaaatacaagcattcacaaaatccccccaaaaaagcatctttatagatatttttgttcctgtagatttagactgcatcttctttcattgtcatttcttatgacaattatttgcaataaaaatatcaatttatttatttatttatttatttttgagatggagtttcactgttgttgcccaggttggagtgcagtggcgtgacctcagctccctgtaacttctgcctcccatgtacgagtagttctcttgcctcagcctcctgagtatctgggattacaggcacctgccatcacacctggctaaaaatatgaagttagaaaaaaaaaagtttggtcattctgctaaagtggtggtgtacattttgagttgtcattttttaaatttttttctccagcttctcaaattgtcattagcaatgtcatataaatttgtaaatttttaagataattgacagctttgtgaacacccctatcaagttccttctctctttctctctctctctctctctctctctctatatatatatatatatatacatacacacacacacacatatatctttctatatatattgtatatatatactatatatatacatatatatctttctagatatatatagtgtgtatgtatgtgtgtgtgtgtgtatgtgtgtgtgtgtgtatatatatatatatatacatatatatatatatatatatatgtatatatctttcaaaatatttcaaagccaggcatggtagctcatgcctgtaattcaaacatgttgggaggctgaggcaggatgattgcttgagatcaggggtttgagaccagcctgggcaacatagcaaaaccctgttgctacaaaaaataaaataaaattagctggacatggtggggtgcctgtagtcccagctactcaggagactgaggtgggaggatcacttgaacctattacttcgaggctacagcgagctataatggtgccattgccctgcagcatgaatgacaaaggcagaatttgtttcagcaacaacaacaacaaaatttcaagttttataatatttgatgtagcccttaattttaaatgctttttaaaatttataacaaatttttctcaccttataatagcatataaaaagttttatgttacctttgttgatgttagtgtattttgtcaaatgagcaaaaggtacatttgaatgaaggtattcatataagttactacttggattatcaaaaaaagccaagcagctattctgtttgctatttatctttttctcttaataaatcccttgtttggtattatttaaaacaagggccaaatattttatgccaatttctttgcatattgcatgtgatattttctcctatgactctggggttggatagtggtgacacagaccatgttgcctgcaaagcctaaaataaagacagaaaaattatttttgacagaaaattaagttcatgatgtaagataattttgtggtaatttttgttataatttgttctcaatgttaaaataatttctgttaattttattgcttatctttatttgttgtgtcattttctattaattttgcatctaaatattatctctatacttttataaattaatgttagtctgacaaaaaaaatagccttcatttagggcctaatcaggagtttgaacttctcaattatatttaaatcaaacattccaaaacatatgttcacattacagtatataagtgctttataaaatgtatttccttcagtaaaacaataaattttgagtatataattgtgtatgatacattatgaagtagaagacaactctttggatgaggtgttgaattaaatacattccttgcaattttatacatctgattgttgcaagcattctccacaaattaacttgtggtggtgtacatgacaaagcttttttctttacaacacaggacacagatgttgggcctcatatgacttgttcctatcattatgcaacctcacactgtgtaattcatgtagcaatgctgtatagactggcaggtagacagaggagcaatttcaacattactaggctttaggggaagtgtgatggagaggaagcaggaataatacaatggttatagccagtcatgcttaactatattacttttgcaagttttatgaaaatacctgctatgagaagacactgcaagagctcctcccagggcctttaaccgactgtgtaagtgaggggcttaagcttcattttcttcataataggttcatctttgcatatcaggatacatagaaggaaagataaaacaattttgaaagccaatcaaagcatatataaagcctagatgggcacatattttttattgtgacattaagatagataggataaatgaaattgtcaagatacatgcaagcttctgccccagggcatttcccctatacggaaacagacctcagatcgcactcttccagcagtcttatcccctgatgtctctgaactacatcggtacttcagattctatttttatagttctttgcttttgccacaacctctcgtctgatttctccacgttgcctggtaaacctctatggtcctgaggttttgactctgatctgaaaactgtccctcttctgcaggtcttttttccatcaccatccttttcaaagctgctaatttagacaaatttcctgaggttctagtggaagtggggctacaaatacccttgcattatttagtcataattatttctgggaagaaatctaaatttcttgttttgttttctcagttatatcacaatgcatttgttgaattgaaattgtgatcttcaagcctcgttttcctaatttgtcccttaaagaagggaataggccaatgttctcatggtgccattgctttgatgttgaggcacttacagacctgatccaggactcttaacatttctccctgttcaaggtccattatgtggtgcagagccatggtgaaggatatgagcacaaagctctgtgggttttgttttcctttgtttttgtctttttaatctgtaaattgattcttgctaatcacttgaggaaaacaatgacataataatactatgtgcgaagaatttagcaaaaattggtgctcatctgtcaggaaatgattaatatgattccaaggatgaaatgtggaagcattaacaagagaaacaataacaacagtgatttttgccttaggtatcagaggccccaaaatacaaatttcctaaatccattagaaaaataattgccttaatatgaaaacatgtgcatctaacaactttctgaaataattatattatctgaaagtacatgtagatggtctggctttctttaaagatgtttataaaaattcaagataaatggttaataaccttctatccttgggaatcctaattttgccattctttatgcagacaattacttttctttctttttttataatactttaagttctgggatacatgtgcaggtttgttacataggtatacacatgccacagtggtttgctgcacccattaacccgccatctacattaggtatttctcctaatgctctccctccccttgccccccaccaccaacaggcaccgatgtgtgatcttcccctctctgtgtccgtgtgttctcagtgtttaattaccacttatgagtgagaatatgtggtgtttgttttctgttcttgtgttaatttgctgagaatgatggtttccacctttatccatgtccctgcaaaggacatgaactcattcttttctatggctgcataatattccatggtgtatatgtgccacattttttttagccagtctatcattgatggggatctgggctggttccaagtctttgctattgtggatagtgctgcaataaacagacttgtgcatgtgtctttagagtagaatgatttataatcctttgggcatatacctagtcatgggattgctgggtctaatggtatttctggttctagatccctgaataattgccacactgtcttccacaatggttgaactaatttacgctcccaccaacagtgtaaaagtgttcctatttctccacatcctctccagcatctgttgtttcctgactttttaataatcacctttctaactggcgtgagatggtatctcatcgtggttttgatttgcatttctgtaatgaccaatgattatgagctttttttcatatgtttgttggccacataaatgtccgcttttgagaagtgtctgttcatatccttcacccactttttgatgggcttgtttgattttttcttgtaaatttgcttaagttccttgtagattctggatattagccctttgtcagatggatagattgcagaatttttctcccattctacaggttgcctgttcactctgatgatagtttattttgctgtgcacaagctctttagtttaattagatcccatttgtcaattttggcttttgtggccattgcttttggtgttttacatatgaagagtttgcccatgtctatattctgaatggtattgcctaggttttcttctagggtttttatggttttaggtcttatatttaagtccttaatccatcttgagttaatttttgtataaggtgtgaggaaggggtccagtttcggttttctgcatatggctagctaattttcccaacaccatttattaaatagggaatgctttccccattgcttgtttttatcaggtttgtcaaagatccgatggttgtagatgtgtgacattatttctgaggcatctgtttgttccattggtctatatgtctgttttgttaccagtaccatgctgttttggttactgtagccttgtaagataatttgaagtcaggtagtgtgatttctccagctttgttctttttgcataggattgtcttgactatacgggctcttttttgtttccatataaaatttaaaatagtttttctaattctgtgaagaaagtcaatggtagcttgatggggatatcatttaatctgtaagttactttgggcagtatggccattttcgcgatattgattcttcctatccatgagcatggaatgtttttacatcatcctgataccaaaacctggcagagacataacaaaagaaaatttcaggccagtatccctgatgaacatcgacacaaaaatcctcaataaaatactggcaaaccgaatacagcagcacattaaaaacttatccgccatgatgaagacagcttcatccctgggatgcaaggctggttcaacatacacaaatcaatagacataatccatcacataaacagaaccaatgagaaaagctacatgataatctcaatagatgctgaaaaggccttcgataaaatttaacacctcttcatgctaaaaactctcaataaactaggtattgttggaacatatctcaaaataataagagctatttatgacagacccacagccaatatcatactgaatgggcaaaagttggaagcattccatttgaaaactggcacaagacaagtatgccctctctcaccactcctattcaacagagtattggaagttctggccagggcaatcaggcaaggaaagaaataaaatgtattcaaaaaggaaaagaggaagtcaaattgtctctgtttgcagataatatgattgtatgtttaggaaaccccatcgcctcagccacaaatctcctgaagctgataagcaacttcggcgaagtctcaggatataaaatcaatgtgcaaaaatcacaagcattcctatacaccaataatagacaaacaaagagccaaatcatgagtgaactcccattcacaattgctacacagaaaataaaatacctaagaatacaacttacaagggatgtgaaggacctctttaaggagaactacaaaccacagctcaaggaaataagaaaggacttttcttacatttctaaaggcacataagatcacagagacagaagatgtccagtagatttattttcattcctctagtacaaattttttatagacagaatcataggaatttctgaacctaaaaatattaatcttcatgccacctatttaaaggaaatgcaagcacatgtttattgtaagtgacagtcctctgagatgatagttgatctgtgttcatggcttaagattattatattcagtgagaatgaaattacttctattgaaatcttggaagtaaatgaacagatcatagaatattctagctctcaaggctggtctcagcaagacaatatctgggtagaaaaaacttgatggatagtcaaggatattttagatctgagtaatcaatagcaggtgatggagaaaaagagccatataataagtggtcttataagcatttttgctgctcaagaagtaccagccacaaagaaccaatactattttaaggattaaagttaccaaactatagtagaatgtatgtgtacttaggaatcacatatgtatcatttagtgtgtatgtcactagttctgcaacttgtagtttaaactagttttctcatgtttaacgagatgataaaaaaaactaactcagaagattgtagtataaataaaaagcgatgacatctcgttttacataaattattgcatttgtcattcattcagtaaatgctagctatttttacttttctggaaactagggaaaataacttctatataggtttgtaacgaattccaattacgaaattcgaaataagcataaaacaatacctcttgcatcatatataatcaaacattaaattaccttttgaacaaaaatctttgtttattaattttactggcccccaaatggctatgaacttgttgaaaatggagatatcacattcatctttttattccccatttctagtagagtacctgagacaaagctagcaaatgccgactgattgaacaattccagctctgttattaaaatcatcatataacacaaacttgtcaatggaaaagttaactttcagataccaaaaaaagggaaataagctattgcaaataataatcaggtaaaaaaatatttattctgtttcagcatagtgttataaatattgaaatgtaaattaaaggcagtagggcacacctatatcttgtttctagtttttgctgatagctgtatataatcaactattattgctttgataccaccatataacgtgggttataagattttcagataaaagcaactcttatttcatttgtttttcttgaattactccatataggaagaggctttggaatcgtatttcttgctttgaaattttatttcttgcatttatatgcctttgcaataaaatcgtgttaacttataatctctcacgcaatggtttctcctagtgtttaataaaatggtattaagggtaactgctactattttttctaaaattagaaggtaacattgaatggacacacagcagatacatgttacattctgaaatgtatgctttgctggagcagaatgaatgcaatcaatgtaatggaaatgctgcactaatggctcattaaacatggaaagtatgcatagatgaaaaaagtctgtgcatatgtttcagttcactgaaggaagcaatgaactataatgtggaaagaaaaggaaacatacttctttacgtaaatattcttacttctggaaaagaattgttgaatcagtcaggaatttgacagcaagatttcaactattggagcagacaactttatattgtaattgatggatctggtggacttttaaatattttttttccctattctgtgctttttcacattgtttctatatctttttgtttttttgcaaagttctttaattgatcaatattttcttttgtgatatgtgttttattgctcacaagaaaaaaatttctctatttaaatgttatactctcttacactttctttcaaactgtcacttataccactgcaattcaccccaaattattttagtatatgatgtgaaatccaagtctagctttacttttttcacctttattcaattgtcccagaaacatttatcaattattccacatttcttcactgatttgtaatatgccctttgtcttaaaccatgcaaagctccccagcatcaatagaaagagagaggaagtagatgataaccttttgcagtgggaaacaaaaaagatattttaaaactcttgtttgtgtttggaactgtcacctcctatgacatgtcaaacaaccttatttggcattggatagtgtaagtaattttttgccctgacaaaatatatttaggtacccacttgagcaaaacttataatatagatttaatcatatattcactgttatcatcgacttcattgtgttcttctacctctgcctgatgcacctcttgattattcagcattgttgccaagcatttgctgttagtagctgataacattcatcttcttttgctaaatatttctcatatacaagaagatttaagactgtttatccctgtagttggaagatttttcctctaaaagctgtttatacttttcctagcacgaagacctgcttatatgccacacaagtgtctcttaaaaagttagtcactcaatgccctgctaataggagtgaaaaagacactagaaacaaaaatcttttctaaccagaaaaccacttttgtataaattttgagctccttgcaccacagtgactacagtgtgcctcactaaggtaaacatagaaaatggtatcatttattgtttcaaattaatagggtaattgtaaatatgataagtttatcgaagatattacagaagtatacattttaagacaaccctagaaataattcttttaagagcatgttacaattattattttaaaatgcattactcctaccctaattttagttggaagagatgtatgaaaattacaatgattgtactgcatagaatatgtcatttttgtttgattttttaattagcagtttaatttgtgcagtgtcgaatataagagataattctgataggtttgtcatcacagagtctctggcagttaacatgaatacaaaatattaaatgtattacttaccgcagtaaacggtcactagtcagtaggttgataattcgcatcttgtagaacactggccatgactgatggatttttatcctttcttattatgtatacgttttttttcattaatagtgttccccctccaagtcagtttttatattcaatcctagcacaaatgattttaaaaatgaaagagatgaaggagatcattagattctagcagaggaaaagttgtaatacaagttggtttagaaccaaagtgctttctaactttcccatttgtttgttttttgttttatgtttagacttggtattaaaaaatgaagatgtaaacaattcagttaggaaaccttcagagatattctgcactgaccttcattagagtttgtgtagtgcatgaccgtggtaatatcaaatggttgcgtaagtatctacaaggccctttttcaaaaaagccatcaagttgcatctctctaattattgcaaatatcttgtttactcctatttattcactacatcacttgaagtttcctcttgaatctgagcatgtcctgtaggtctaccttagaagaaaggaaaagtgctgtcttccacattgggtttcagctgggcttacagccaagtgtacattgcaatttgcaattatctccttttcctgcttgtgctggcaaagagagggaaaattttaaatatactctctgtgaaaagagtgtgagatcagaaaacagacagtattatgaatacttaatgtatttcctactcaggacaatttccagcacttttcttttgggatttaggcttctgtgtataatatccccttgaaaactgaagaagtacaagtctccttgcttgtaagcgactaaatggctgacattctggatgcatgttttcatagactattgtgttttgagtaaatataaatgggatcactggataaatggatttggaagagtaacgaaacaagaatagcatgggggaattatctcacaggaacattaaacttaaggggatttaactgtattcccattaagagaaaaagattaaaataaaatatgtacagccacgtgtcatttagtgacagggataccttttgagaactgcgtccttaggagatttctcatcatgtgagcatcatcatgaacagtcatgtgtttctgaacaaccggggtatgttccaagaaatgtgtcattaggcaattttgtcatagtgtaaatatcacagagggtacttaaacagacctagatggtatagccccctacacacttagactatatggtatatcctatttttcctaggctataaaaattttcagcatgttactgtagtgaatactgtgggtaaatgtaacacaatggaagtattaatatatctaagcatatctaaatatagaaaatgtaatgcattgtcctaaaatgttaggatagctatgacttcaccaggtgatagaaatttttcagttcccctataatctatggaatcaccatcatataggcagtgtgtccttgactgcaacgttatgtggcatatgactgtacatctatgtaagttgcatagaccattttagtctccatttcactctgtgagaatgtatcctaaacggtaaatgcaattaagttttaaaaacatgttgcaagcatacacaaaagcatagagtaattgtgcaaattattttaaagttttccaggccatagatgaaaaggtaaagttcattgcttaggtagccagggaaaaggagagtgatagaaacaatggcagtcttggggtagacagtgaaatactgagagcctttgacagtcattgaaaaagaattggagcccgttctccatgtcgtgcttatttcagattgcatgcctgtatcaaaacatctcatgtactccataaaaatacacacctactatgtacccacagaaatgaaaaattaattagaacaatgaacaaagaataatggatttatatgggtgtacataaatccaagtgtgtaatagtttatacacatggacttatcaagaatgataattctttatcattcatgataaatgaaacaatctttatcattctaaatcaatgaaactatcaagaatgatttagatgtacagaatttatagtgaggcatgaccattagaatctagccagaatatagcgtacaatttcactatattaacatattcttgaaattgtctattcatttggtttctactggatggtacaattagagatgaattagggagggacaagaaactagcatttactgggtctctaacatgtgccaaaggcgaatggcacctcaggaaggtgcagctgcctttacgtgacatagggaagaaaacatttagaaaatgatatttgatcttccttgagaaatacaaatagaacctatccagatggaggaaggcagtgagcaatagcatgtttgagaacatacttttgttctcacacatcatgtaccaaacacagaagaaaatgacgcatctaaaattttttttaaaactacgctgatgcttttttttcttcacaacacatttttatggttttttttttttttttttttttttgagacggagtctcactctgttgcccaggttggagtgcagtggcacaatctcagctcactgcaagctctgcctccagggttcatgccattctcctgcctcagcctcccgagtagctgggactacaggcacccgccacaacgcccggctaattttttgtatttttagtggagacggggtttcaccatgttagccaggatggtgtcgatctcctgacctcgtgatccgcctgcctcggcctcccaaagtgctgggattacaggtgtgagccaccacggccggcccatttttatgtcttttaagctccaagttttcttagctattttcatctgtcatatatagcctcaatatattgttgcctggcacatagtaggcatccaattaaaattaattgaatgcatgactgaaacaagagtttctcttcattatgattcttaatttaagcttaaatttagaaatcctcttcttatcatttttcttagtttaactcaacactaataagattgtcgtttctatcatattctgtgtctttccccatgatttccatagctctttgaattaggataatgacttttttattttattttattttatttatttatttattttgagatgtagtcttgctctgtcgcccaggctggagtgcagtggcgccatctcggctcactgcaacctccgccttccaggttcaagcgattctcctgcctcagcctgccgagtaactgggactacaggcacccaccaccacgcctggctaatttttgtatttttagtacagacagcgtttcaccatattggccaggctggtttcaaactcccgacattgtgatctgtccgcctcggcctcccaaagtgagccaccgcgccaggcctaggatcatgacttttataacctgtagcgagaaaagatgcaaatctttctcttattggtatgattctgctcaaactcagatacacaatctagagtcaagatgacaccgtaaaattattttttttaaaaaagaaagaagcctgggcatggtggctcacatctgtaatcccagcacttcgggaggctgaggtgtgtggatcacttgaggtcaggagttcgagaccagcctgaccaaaatggtgaaaccctgcctctactaaaaatacaaaaattacccaggcatggtggcagacacctgtaatcccagctacttgggaggctgaggcagaagactcacttgaacccgagaggtagtggttgcagtgagctgagatcataccactgcactccagcctgggcatcacagcgagtctcaaaaaaaaaaaaaaaaaaaagaaagaaataagaatacgaactgcaatcacatttccaggctgattgtaaaataggaacagcacacttgagccaaagcaaaggtttcaagaaggataaggtcaaatgcacagaatatgggacttagattgtcaagctgaggttaaagtcagtaattattggagagacctagggattccaactttagactaggagcatctaggctgtcataagtaagaagagagcaggggctttaaaacttggctgtcacaggtagcatttcttttccccttgaccctggggcacaggttgtccactcgcaaatgttttcgtgtcacctgacactcaccttctcttctcgccagtcttgcaggccacaccttactcctaccacatcttgccctaggttttccttttcttgcactgaaagttctcctaacttatgccatcctactggggaaaaaaataagtttctttttctccctgctacataactacattacaacacttaataatcccattcaggtccaaaatgcacatctttctctttgcaaatagttactatactttctttaaacattcttattacttattttgagaatgtttctattttctcagttttagcatttcatgagtctttgacagctgggtctcagagagaggccagttaggaattggacaatcgtcttaagcaggctctgggtttcctgtacttttctgtgcagtgcctgtgctgattaaactatgacctgcagtttttctttttacggagttcatagtggtcatttgaaatatgatgtggcattcagaaaaattactctttctcctgcagtttctgtgaatatattttacactgcagcaattgtcatacaaggcatataaggatttattcaaaaatttatcaacaatctgagatgcattggtaagaattacaatgaaaatattagttgttctttatatcactgcaaacaatagacaaatccttacatgcaagaaaacttgctatgatgtttcaatattgtaatttcagccaatctaaggctaaggttctccaaagtttaaatatggtatttttttttccttttagaaaatccccatacatttaatagcccagttataaacatactgcccatgtaggtctcctttacttgtgacctctagctgtgagagaatccttaggttccagagaccagtagttcactgtgtgctaaaggacatgctttagctactcctttgctactccttttgaattctttctccttttctaagtgggcagctctcacccgctcattctctgggctttgcatttagaatgattggtcttccccactattattttagacaattacatttatcatgagaaattaatccttgagggatcaatgatgcgtgcttttctctggctcacaggaacaaaactattattcattttccacttgacataaagtgacccgtgaacccatttacattttcattcccctgctggcagtaccagtgaagccctttgtcagttatcagctagtagtgacccctgcaggcacagccaccactcagcccagggaggactgcttccggggcaggtcccctaggtgccaataaagaatgcaaccattagcccacatgtagggacctaaataacgctggtcagggtcttgggtctacctatgtgaagcaaacaggcaaatattaacaattttgctgtgacctgtatttgagtgataaaggtgtaattcgaagtgaagaactatgagagctggggcatttgtcattggaacttttccattttctctctaagggtaactttctttcatttttacaccctctaccctgaaagttgtcttcagtcttcagtcactgcccctgtattccatgccattatattatgtcatatattggtgactcctgtccctggaaaatttaatgagaaatgggaacgaaaataatatcgtcatggtggaatgacaggcggctgatattgttgagctagggaatgcttgcaatgctgagcacagccacatgtgccagaaatagggaaatgtatgacacaagacacagtcttgaggtgctcatgagctattaggaagttgcagcatgatctcaccatctgaaaatgaaaaatgaatcattctctggggaatgagctaaatttgactcctgaaatcaccatggtgccagggattacggtctctgaatgtgctacagacttggagtgactaatgagctgcttgaggtcatagagagacttaggcaattaaagacaattaatgcacattatcttgcttaaaacatagaaaatgatactccagttacgcagtggttacttttgtgacctgtttagataactctaaacaccatatttctcctagattttataatcttgttgttcattcagtataatttgttttctaacataaacttgatctttactgttgtgagattcttgagaacagagacactgtatgttatttcttctttatattcccagtgcattaagagcttccaaaacagtagatttttgctaaataagataactgttgaacaaatgaaagaatgagcaactgtagagctgtgttttgtgcattttctttaacacagtctatttttactgctgccgatctttactgttgctgatcaacctgagttgagttcatatttgagtgcaaaattcttcttctgactaagtaaggaatacttgagatgatgcaggattgaaggttcctaagtttatcagtaagggagtaagggagtcagcatattttaacccactttgggtaaaatatgacattgaactaagagacaaaaaactacaatgaaattagttaacatagtttttttgtttgtttgtttgtttgttttttgagacagagtctcgctctgtttccgaggctggagtgcagtggcacgatcttgactcactgcaacctccacctcctgggttcaagcgattctccttcctcagactcctgagtagctgggattacaggcaggcgccaccacatccagctaatttttgtatttttagtagagacagggttttgccatgttggccaggctggtctcgaacccctgacctcacgtgatccacctgcttcggcctcccaaagtgctggcattacagcatgagccatcgcgcctggccaacattatagaattttaaattaaggacatctgaaagataattgagttcaacatttcacattcaccctagactgctctcccaagatcaggagctactggagattttgaaggaaaacaggcctattcctaaaatgtaaaaagtgagcatgaaaattgcatctgatgatgacattcaggagaaacagttagtgtgcctatgcaaggtgatccgtgtgggacagagccaggactattacgaagcacttgatacctcaccacggaggactgatgagaaaattcattataaagagtttggctaccgcgaaatgtaagttgacttctaaataaagaattcaaatgaaataaaaatgatcgacaaaagttgactagaagttctctaaaatatatctatttctaattttatttcatttgataattacctaaattactctgaatcctaccttcaattttacttgtctttgtttgaacagtaattcttttgtctcaaatgtcatgtatctttgcttaatgccatgaaatttagccagtcttaaaaatctttgatagaggaaagaaaaatgtcctaaacatgtgttatttattttacttcctgagtctcaaaatgtgttttcatattgtgcttcaagtgtcatggtttagtttttgccttactcatttttaatatatctcatttaatagattaatattatattcccttgtaacctgcttatttcaagaataaaacacaatgtcttaaatagtaacacaattaattcagatttttttgacagcacgatgtatagtgcctaaatatattcagccagatttaaaacagggcataataagtaaaaaaaaacaaaatttcatagtgttgaaaaatcgatttggtgtttaatatttatttagatttataaaaattgtttcatattgtcccttgttatcactaagcaattaaagcattgctatctgagtagaactgccttggatattgtgtagcttatgaagtttaaatggctcaacactgtaggattctgatttgcaaagaaacagtctgaaagctcatcttcccaggctggaagacactggtttatttatttcactgtattaggcaagacaggatgatttttttttttatgttgagtggatgccttttggaagattagaaaactctgaggaagagggttctgaacaacaagccatctcaatttactgatcaccagcagtggaggcaaaaaatgagaaaatccatgagtttcctcttgatctattaaagtcctatttgtgatccaaatcagaattggaaactttcttcatagccttagtccactgtttctgaattaaaatcacttcatcatggtgttattttgaatactgtgatcttaattaagatccaaaccttagtgaacatttggaaaacaatagaatttgctgcaaagtgttacaaaaacatgcaaaatttctaatcattgtcacttactaatgaagtttatgtttctgtaaaagaatagcctgtaactaagtattctttggggttgtctttaaaactgatttgtttaaatttaaattcccagatgtcttaatagaagacagtaaagtcctaaaacaaaggtattcactgtgttcagctccttaacaccaagtacagatcaatttgttagctgcagtgttggatatcttccagcactaaaactgacaaggtgatattaagataaaatatattacctcctttcagtgttaagatatcttaaacctggaactggactcagaggaacaatttatgtagaaatggttttccatgagtgtagaaatagtttggggcaaatgttaaatttttgaacaaatgtttcctgaatctcctttttatgtacagcaggggttcacaaactctttctgcaaaggaccagatacaagtattgtaggctttatcggtcagccaaacgatgtcagtttctgtctctatattcaaatctgcccttgtggcatgaaagcagccatggacaatacctaagcagatagtcatggctgactgttccaaaaaaaaatgttatttactaaaacaggtgactggccagagttgaccaacccctaatgtagaacattgtgttgagaatcgtttaggaaatgaatttataaaaaaaacaaaacaaaacaaaacaaaaaacagtgctactcccctcctggagcttatcatatgatataaatcaaagaagcttatgcataaatacttaaataataagtaaaacttgaaatgtacaagagaagaaggtgcatgataagagtcatgtaagaacggcaggaaggtggggtccatgtgtacagaggagagggggtgcaatcatttaaaactaaggaagaattgcaggcactcaaagctgtcaagcagtaccctgatggatggagactgccctgtagagaagagagcataatggaaccctgggagagccatgttctttccacccatctcacagtctttgggctgctttgttcttctctaaatgcagagtaactattcatatcactgtcttatagaggaggatgctaggaaccagtgttggacaaattagcagagtcagaactcacattgggtttttcttacttcaaatccctcaggattttgcacaatacattcttgcaggtcattcaggcaaggtgtattaaattgcatttttcttgaatggcgtacactctagcctaactaaacatgggtattttgttgtactaaataggagtaaaggttgaaaattttgggtacaagcagaagttggatggttttgaatgcaaagatgtttgaagtttaggtgggaaatagaagaggacccttaaaagttttaaattatagaataagataattaaaatgatgatttatagagaggtgaatctgctgaaatatccaggctatagaaaaccgttatgtagtgcttgactaaactttattcagagggataatgactaagaattagacacatcatggaaacaggtatgtgaggggtcgcacacttttgagtacaacaggtgtcatttgcaggaatatacacatgaccatggttttgagaaaccttacgctagactagcaagaacttcaatcttccaggtatctcctctaaaatatcattatggttgttcagaggtaacccttggcatcagttctgactctctcatgttctgcttctcttagtgaagtggaagtggatgtcacctttgtggctggacaccacaatttctgctccccatagagctccacagtggtgctccttgagcctctctagttgggtctaataatggaaacgtaaattatttgggattgtcattgtctctgtacgcaacttctactttaagccttatcagtctcactcttactccttctggtcttagtgtaacatgcacagagatgaacaggaagaagtattctggtagcatgattgggaaaattgtctactcatctgtgtatgctttatgaaaggcacaaactctctgagcccaaagggttatcacccatgcctgtacaatatttcccacttagacacacactcttacatgaaaattcatgtataaaatggaattctcctgccagggagcattcactgtgcccaagagctcaggctgtgcccagaaccagctgccgcctttgacgtaggccttagtgtggaaggtgattcaccagtttactcttttaatatctgcaatctggcctccatttagggctgctcaatccaccagatgaatatttatatctttgagctactattgagggtttcatccccagccatttctcctacagacaaatgattcttaggttcctgtgttacacagtatgagcaagtatatatggaggatggggaatgacgaacacaagcatccaattcacaatgcaaatgtactcaggaaaagatgatgcttgattattcattagcagggtttgagcttcagatcaaccagaccatatatcatagcagaaaaaccttttctgtactcctgcctcagcaatatctggattcaatatctagttcagcctaaatctattgtatactaaatagtgtaaaagaggtatttaatagataatttttaaaaagcaaaaccatgatcacacaacgcatggtagccccaaattgtaatttcttggaggtgggacacaggcagccaaaaggaagtgaagcacttggtagaatgtacatgaaacggtgcacagtagttgatgctgcttgggtgaaaggaaggggaaaaatctattgatcacagaagatcaatgtttagtgatctggttttgtgtgtcagataccttactaaacgtttttacattggacctcatttaatcttcatgataggcctatgtgtaacaaattgttgaataacttaaagatgtcaggtggaaaatatgatttcatttgttctttaataatttttattgatgtagactttagtaacattattacatattatgttcatatgcatgtaacctatatatttcctttcaaacaaaactatattcttgaaataaaagttaatactaatcctgtgaagaaagtcattggtagcttgatggggatggcattgaatctataaattaccttgggcagtacggccattttcacgatattgattcttcctacccatgagcatggaatgttcttccatttctttgtatcctgttttatttcattgagaagtggtttgtagttctccttgaagaggtccttcacatcccttgtaagttggattcctaggtattttattctctttgaagcaattgtgaatgggagttcacacatgatttggctctctgtttgtctgctattggtgtataagaaagcttgtgatttttgtacattgattttgtatcctgagactttgctgaagttgcttatcagcttaaggagattttaggctgagacaatggggttttctagatatactatcatgtcatctgcaaacagggacaatttaacttcctcttttcctaattgaataccctttatttccttctcctgcctaattgccctggccagaacttccaacactatgttgaataggagtggtgagagagggcatccctgtcttgtgccagttttcaaagggagtgcttccagtttttgcgcattcagtatgatattggctgtgggtttgtcatagatagctcttattattttgaaatacgtcccatcaatacctaatttattgagagtttttagcatgaagcggtgttgaattttgtcaaaggccttttctgcatctattgagataatcatgtgttttttgtctttggttctgtttatatgctggattacatttattgatttgcatatattgaaccagccttgcatcccagggatgaagcccacttgatcatggtggataagctttttgatgtgctgctggattcggtttgccagtattttattgcggatttttgcatcaatgttcatcaaggatattggtctaaaattctctttttttgttgtgtctctgcctggctttggtatcaggataatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcggagattcaacttcttcctggattagtcttgggagggtgtatgtgtcgaggaatttatccatttcttctagattttctagtttatttgcatagaggtgtttgtagtattctctgatggtagtttgtatttctgtgggatcggtggtgatatcccctttatcattttttattgtgtctatttaattcttctctcttttcttctttattagtcttgctagcagtctatcaattttgttgatcctttcaaaaaaccagttcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttctgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatgtctgatcttttacatttgctgaggagaactttacttccaactatgtggtcaattttggaataggtgtggtgtggtgctgaaaaaaatgtatattctgttgatttggggtggagaggtctgtagatgtctattaggtccgcttggtgcagagctgagttcaattcctgggtatccttgttaactttctgtcttgttgatctgtctaatgttgacagtggggtgttaaagtctcccattattattgtgtgggagtctaagtctctttgtagatcactcaggacttgctttatgaatctgggtgctcttgtattgggtgcatatatatttaggatagttagctcttcttgttgaattaatccctttaccattatgtaatggccttctttgtctcttttgatttttgttggtttaaagtctgttttatcagagactaggattgcaacccctgccttttttttggtttccatttgcttggtagatcttcctccatccttttattttgagcctatgtgtgtttactttaaagttcatatggcaccaaaaaagagcctgcatcgccaagtcaatcctaagccaaaagaacacagctggaggtatcacgctacctgacttcaaactatactacaaggctacagtaatcaaaacagcatggtactggtaccaaaacagagatatagatcaatggaacagaacagagccctcagaaataatgccgcatatctacaactatctgatctttgacaaacttcacaaaaacaaacaatggggaaaggattccctatttaataaatggtgctgggaaaactggctagccatatgtagaaagctgaaactggatcccttccttacaccttatacaaaaattaattcaagatggattaaagacttaaacaatagacctaaaaccataaaaaccctagaagaaaacctagacattaccattcaggacataggcatgggcaaggacttcatgtccaaaacaccaaaagcaatggcaacaaaagacaaaattgacaaatgggatctaattaaaccaaagagcttctgcacagcaaaagaaactaccatcagagtgaacaggcaacctacaaaatcggagaaaattttcacaacctactcatctgacaaagggctactatccagaatctacaatgaactcaaacaaatttacaagaaaaaaacaaacaaccccatcaaaaagtgggcaaaggacatgaacagacacttctcaaaagaagacatttatgcagccaaaaaatacatgaaaaaatgctcaccatcactgtccattagagaaatgcaaatcaaaaccacagtgagataccatcccacaccagttagaatggcaatcaataaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcctattactgggtatatacccaaaggactgtaaatcatgctgctataaaaacacatgcacacgtatgtttattgcggcactattcacaaaatcaaagacttggaaccaacccaaatgtccaacaatgatagactggattaagaaaatgtggcacatatacaccatggaatactatgcagccataaaaaatgatgcgttcatgtcctttgtagggacatggatgaaattggaaatcatcattctcggtaaactatagcaataacaaaaaaccaaacactgcatattctcactcataggcaggaattgaacaatgagaacacatggacacaggaaggggaacatcacactctgcagactgttgtggggttggagggggagggatagctttaggagatatacctaatgctaaatgacaagttaatgggtgcagcacaccagcatggcacatgtatacatatgtaactaacctgcacattggtcacatgtaccctaaaacttaaagtataattaaaaaaaaagttaatactaaagaaagtcttttttccctaaaatattattgtacaaagagagaactcttaataaatgttgacctctgacagaagcttaatttatcctaaagcatttattaaacatctattgtgtactaaaaattggaaaggctttcttttgaggaaaaaataaaaaggcactatatttgttctcaaacactagcgatatgaataataggtgtctatatctgagaaaaatgcagaggaaatagaagggttatctaagtctatttgggctcgtatagcaaaattccttagaggtggatagcttatcaacaataacaaaaatgaatgtctcacagttctggaagctgggaagtccaaactcaggttgccagcgtagtcaggttctgctgaagaggcttttctagggagggtcctctggtgagggtccttttctgtgcagattgccaactccctgttgcatcctcatatgggagaagtggagaggggtcactctctggcctactataaaaaggcactcattccattcatgagaactctgcctgcccttgtgacttaatcacttcccataagaccccacctgctaatacccccacctgctaatacccatcatggagttttgaactacaatatatgaattttgcattcagaccataataaagagtatatttattgcttatctaacgctctgttttaatcctaagaaatttatatcacgcatctacttcgatgctatagctagactaatacatgttcatcttcgtgcattttcccatatatgctattttacttccatctgtacttgaattttcttagtggcttgggtaaagccttgacatgtacacttgttaaaatggcctcttgatgactgacaagataaccagctacaattaatggtcattgtaatgttgagggggaaaatcatccttgaagatgattagatactaaatgaattagcacacagcatatttaaacacaagtatcaagtcaacaaatatgattttatcaatctttaataattttactaacctttattaatgtatattctagtaatgatactatatactatgtacatatacaggtagcctagtatttcatttaaaataaaattgtattcttgaaattaaaatcaatacagaggaaagcttatttctctgaaatatttacaaaatgcacaaatttttaaatttcaaaatttaacatttgtgttttattttaatgaatacaattttcaagtatgttatatgtacagaatggaatacatagcacaaaagaattatttactatctgtgtatgaacctaaactgcatcaatgaccatataaagcaggtaatataatttaaaataaacaataatgatgtaacaaattttttcatatataaaatgaaaattttggagattaacactgcgtctgcctttgtgggtgatttattccacagagctctttcaattgtttagctgccttgaatcttgtagcttagttataaagagaagtttggaggtaaatgttctgcagcattcaaaaggcttccttgaaagccatttaatgcttgaaaaccttttattaatgtatttgaaaatagtcatgttggattggaatatgagagaaaaactgatttggttgattttcctggctcatcagttttgaggttattgtaactaacacacctcagtcagaggcactaatgaattaaacacacagtgtttgattctgtgctgtctaataccatagcaactggtcacatgtggctatttaaattagaaattcacattaaagtaaaaattcagtttctcagtcacactggttatgtttcgtttctctctctctcttttttaaaggaagttttgctcttgtttctcaggctggagtgcaatggcacgatcccagctcactgcaacatctgcctcccaggttcaagtgattctcctgcctccgcctccttagtagctggaattataggcacgtgctgacatgcccagctaattttgtaattttagtagagacagggtttcaccatgttgaccaggctggtctccaactcctgacctcaggtgatccacccgcctcagcctcccaaagtgctgagattacaggcgtgagccaccgcgcctggcccacactggttatatttcaagcactcaatagatacacatggtttgtggcaactaatggacagtgcagatgtagatggaacagatccattcacactgaaagtactattagccagtattattgtaagatgtacgataacctcctttgcaattttatttagtcaaaagatagtaaatgcagtgtaaagtcattagagaaatattgacttttaaggataattaaaaaccattaggataataaacctatgttaaggttattcctgattaaatcaataccatcatgagacatattccaaagatccactgtgagatgctttatggaaactctaatttctaactaaaaaggcatgatatgtgaacactcatagcttaataaaaattatagttaatatgaatggcagcctgtcatcataaacatggttagtaaatttcctggtatccctctcatattcttcccaattggcatcattcatgaagtttctgtgtgattagttccaactggatttccaaggtgatcccccttttctaaaagaaataatcataatctcttccctttgccacaatgatgacttcatgaatatgaattgagctcaggccccagtcctaccatgaattacattcctcctatgatgccgcttgattcaagggtgtacaagagcttcataaggtcaaaacaaagtgaagtccagcagttttgctttaggatgagggagatagattctcacttttaccggatgctggggtgtgtggactgatacccagaataatcatagttatgttgttgccctgaaaggtgctagcctgaagatgaagacatatagaggacaggggatgagaacatcacacactatcactaaaaatcagttacttgggctgggcagggaggctgaggtgggtggattacctgaggtcaggagttcaagaccagcctggccaacatggtgaaaccccatctctactaaaaattagccaggtgtggtggagggcacctttaatctcagctactcaggaggctgaggcaggagaatcacttgaacctgggaagaggaggttgcagtgagccgagatcatgccattgcactccagcctgggcgacaagagcaaaactccgtcttaaaaaaaaataaaaaataaaaaaataaaaaataaagtcagttacttatttacctttaactatagatgtcaaatttagagttagattttctgttatgtaaagtcaaaattattctgaaactcttaggtatgtgacgacttgtaggcaaagttatctctccaaattggaaattagtaatcttatttaaatagagtcttcacatttagtaaaagcatattgatgttggtacatttaaattgcaaaataaaagaatgacttactctttagaagcaagaataggactgggcacagtggctcacacctgtaatcccagcattttgggaggctgaggagggtggataacttgaactcagtggtttgagaccagcctggccaacatggtgaaatcccatctctactaaaaatacaaaaattagccaggtatggtagcagatacccgtaatcccagctacctggatgagaatcactttaacccaggaggcagaggttgcagtgagcagagattgtctgggtgacagagagagactctatctaaaaaaacaaaacaaagcaaaacaagaatagacagtatattcaccaggtatacgtatattaacttctattaatttaatattttcgcaaatagttgtttgaagtctctggtttaggatagaacagaagtacatattttgggtgatatctgaaaaatggactctgaagggagcacaaggagagagaatccagagtgaataagacagtagctcacggctgggcgcgttggctcatgcctgtaatcccagcagtttgggaggccgaggtggatggatcacctgaagtcaggagttcgagaccaccctggccaacatggcaaaaccccgtctctactaaaaatacaaaaataagctgggcatggtggcaggcacctgtagtcccagatactcaggaggctgaggcaggagaatcgcttgaacctggcagacagaggttaaagtgagccaagatcatgccactgcactccagcctaggcaacagagtgagactctgtctaagaaaaaataataataaacaaaaaaaatagtggctcatgtttcacaggcgcgtaatccacatcactgctgtgcattctgagagtgcaggcgtgaagtatagtcagttcgggattgtaatcagggtccttaactgaaagatctaagggaaactaagatgttttacccctcccaccctagacacacagacaataacagcggtgataaatttcaagatgaaatcacagatgtgctcctccatctcccattctcaaaattaggaaggctttattttgaggtgccagagcacacattaggggacatacaccttcctaggtagacatttcagatattttagagagcatgtgaattaagaacttgaagtcccaaaatagtgtttaaagacatatggtaactagcagaggcatgaaaacgctatttttatcagcaaatcccagggaaggatggggagacagatgatcctgtaagggagctaaatttcttacctttcatggcatagagtcaaccacttaaagtctaatgatgatgagcgaagaaaccggtatgtaattattgaggcatcattgtggacacaaccaggaaaataaaatctgaaaacaggagcccttaaaatacaatttgaaatatggtgtcaagtttgttggagatttgttaattcaagtggtgagttaacctaaaaatatcacagaggccaggtgtgaggtaaaaacacaaactgttttcctgcttctctcgcactacaacagtgggcacagaaggcgtctgtgtgtgggactttctctccatgtaccaagtaagcaaccagttctgcagtggacacaagctgactgtcctccagcccagttgcattctgaccctgtctatctggagagagcctcagatcccacagggtgagggctccatcccacaggcctgccctccacttcccatgccagttgcaagccccaggctcttttacctgtgcttctgactgaccagctgtaagtcagggatcccaccacctcctccttgggtttgattaatttgctagagtggcttacagaactcagggaaagacttatttacattttccagtttattatgaaagatatgacaaaggatacagatgaagagatgtctagggtgaggtatgcaggaaggggcctgaagcttccatgccctctttggggacatcaccctctaggaacctccatgtgttcagctgtccagaagctcttcgaaccctgtcctcttggaccttttatggagattgcattggacaggcatgattgaagcatggagaaatgtcattacacaagaagggtaaggtatagtcctcatagactgggtagcgaaacccggcaaagcctgtctgttctgtctgctctgtcgattcttcttggcctcgctgtgcagtattcttctctcccaggaatggggcaggactcctggaatgggggcctatgaacaacaatcagacaagcagatcagagaatttctttgtagccccctccaggacagaaaggcggaggaagattcctgccctggggagaaaaatgagtggataaaaggaagggaggagaaaggcagagagagtctgttttctgaggtttgctcctgaggtctaaagaaccccaacgttataacaaaggccacaggagttagagccagaacataaatgaaaatacatatataaaaaacataaaataataatgaaaaagggaggaggctactattgtttatgactcaatgtaaaacttgcagagagaaatgagtgaagaataatacttcaatcattcttctgtcttggtgttcacaacatagagacacacacacatatacacacagaatcagaatcagaatgaaggagacataaagataccatatgtgcatagatggacttcctgtaagaatgaatagagaaggaaaggaatagaaatgtaagagaatacaaacagttattccagtagagaatgaaacgatataattattgagtgatcgttcatggagtggttttggaagactctcaggaggagtctcctgtccttgatggcctattagccctttttgccacatgtgaaccctaacactctgaaggtgaaagataataacagacagtgttgagaccagagctaaaattgttgaacacataatcatgacagggtaaattaactatttcactttatcaaatgttttaataaactcttaaataatatgcattgaaaaactggcatttgatgtggaacattctcttagatactatattttataatttttaaatttatgtatgtatttattttggtgagcaactgaaaactgcaattgtcagtgaacttccaagtgaaatgcctttgcgctgtctgagttttagatcttcaaaagctcaaatgagtaatcctgtcaaattacatgggttgatatggaagagagataagtaaataaaactccactataatatttgtgtggtaccacacacatttggcttaaaaataaaaagggattgaagactgtgtaaagaaatggaattttttaaaagataagataggagtaaatatagaaaaggtcttaaatgacttcaggcagtgaagcaaaaagcacattcccttgtttcttcctgtagaatgataccctagaccaggctattagctgtggataggagccctttatagttcagcaaactattaatttatagtttaccctttcagctaagacattgaagctattctttaaaaatttgagataatttgactatttaaaaattcaactacctttgcaaaatcaaaacagatctgttttgtaagaggtttgccatttcagcatctcactgcaagtgataaggtggttcagtgtttaaccaaagatcatggccacttgacccggtcttcaacccagcgctgtgccaggctgcacatggagggcaccagctgagtatcaccagccaaaggactctttcaaatgacaccagaaaagcctgtcctgttcagaaaaatgacatttccaggagttggaataatgctaaactacatggtctgtaaagtttcctctaagtaatatctaaggcactgtgagtctagccttgggaacatatttgtcaaaagactatttaagaaggggagatttttcagtcctcattgtgttctctctctccctctctctagttaaatgtatatattcatcaggtatttgaactcattttgctaaacatgggacacagaattaataggcattaatattttgtccaaatttagataataagatcatatatatataatatatatatttaactctcctcttgctactttactaaatatatatttattaatagaaatgagtattacatgttaatctctgaagatcccaaaataaataagaaagtgtccagcctttcaagtagctctcagtgcattggggaaaatgaatgagaaaagtaagttctactgtagtattaaagcaagagtgtgaataaaattttgttacagttaaacacagagcacttttaaaagtttgagattttgagtaaggttaatttatggtttagctatacctcctgtggaagttctgaagatcttattgattttctacatttggacaaaacattaatgcctattaattctgagtcccatgtttagcaaagtgagtccaaacacctgagaatcaagtgactttcccccagtattgattttgttagtggtaacaatttgaagatctccttaactcttctgttctcccagttgtctttactctaaatgttgccctgtgtatttaaaacctctaaaatccacattccttcccatagcctgttccctttctacttccctggcctcgtcttatactgtgtatgatagccacactggccgccttctatttttacaaagattgctgtctcttttatacttgatgtttccctcttcctagaatactactccctccaatctttatatggctggctccttcttattatccagatcgcatctcaaattgtctccacagagagtgctttattgatactcaaactaaataacaacacccttgccccacaattacatttcattccatgtttttccattattacaatttaaggtttcacagcctttgtgtctgtaattattttatttgtttatcatctggtttcctctaattgaaataggtccgtgaaagcagagtgtgatctctccaatcctgtatctccaacactatgagcagtgttgagccataagtccaaaaaaatgtttgttgaaggaagaaatacttctagttcccacaaattatgcaaagggtaaagtaaaatctgtctaaatattatgagggcaccaagagggttacatttgtaaaaagaagaaataataactatgtaagctgaaaactctgtattactgactccttataagaggactataaaagagaagagtaaaatataaatcagatgatgaaggtataatattttcacatgttttgttaatatttagtttaacctaagtcatgttaggttggtgcaaaataagtgtggctttgacattacttttaatggctaaactgcaattacttttgcaccaacctgataaatgtaacctttttccaggtggatgtcctagttggttagtgatgctttttccattagatttgaagtcattgacgttgtccaggaaaagaaaagagcccaggacagagtttttggaggatatgaacaggcagaggaggatgaaaatgaaaagccagaaagattaataggaaatcaggtggatagggggatgtggtaatgttggtgggggttacctatgtagttctagtaaagaaaccaaaaggcaaaacagaatgtcagaagggggcaagtgatcaacactattaatgctatgaaaaagctaatacaggtaaggactgagctgtatgtgtcggtgaaactcaagctgctgtaacacataagtccttgattgacaatggtttgcccagtggaaggttgattctcaggagcagaacagtccaggtaatcttggttggcagggagctttgtaataattggagaccaggtgtggaatctgtttttgagtggctataacaggatacccaacactgggtaatttataatgaaaagagatttaatgggctctgcagactgtacaggaagtgtggtacaaacatctgtttctgctgatgtcctcaagtagtttccagtcatggcagaaggggaaggagaaacagatgtgtcacgtggcaagagaggaagcaaggtgggaggtgccatgctctttgaaacaaccagatctagcatgaactgacctatcaccaaggcaactgcgctaaactattcatgatcccttgtaatccaaacacctaccaccaggccccgcctccaacacggaattacatttccacatgagattctgaggagacaaacatcaaaattatatcatcgggttccttccttcttttggcctcactctattttagggttccagagtcccctacattcagctactgagtgtggaaaacagacaagagaagtcacaactgctttttctaccccttagcctagaaattatacacatcacttctactcatattccctaggcacaaggtcccatggttatgcaaaggagccaaaaaatgtagttggtagaagcagctatttcttggatatagatttatattatggaaggagaagcagaaataatgatgggcagtgacccatcttctgtgatactttagaaatttgtgcaactaagtcatttttcacttcataaatattgattgatctcctaaaaatataggactacatggtaatttgtgtctgctcccaaagagttataacttattggaagaaataagatttacaaatgaattatggtaattcaaagatatttctgatttattcgtgtaaattttgggatagaaaaatagatgagaacagtagaaaacaagtacatgtgtattactaacccagcaaaaatataaaccctttttactgctacattttgccattttcagaataaacttgcataaattctcctcattcttagctcaaactgtgctgctgattggattgaactacttgtatatgaatgtatcttggtgtgatacgtagcccattaaaaacctagtatggatttcttaactaaaatcctgtattcctaatttacgttgatttccatttttttaatctcaaagtaatatttcagttttattattgggtaaacaatgtgtattctggcttagaacactttaaagttatttcagaagaggtcacaggggaagaaagatccagaaaagtggaatattttcatgaatcattaagttaataactttggaggaggaaggtatgtctagaaaaggcttaaaacaaaacgattagacttactttaaatatttttatttcaaattaagtagatgaagatggtataaatcaggagttagcaaaccttatattgaaaagggccggacagtgaatactttaggatttgcagaacgcatataatcttcgtcacaaatattcaattctgccattacagcatgaaagcagacatcagagacagggcaaaagcataaaccagcgagtgttaatgtatttcaatagaagtttattaattgacactggactttgaatttcatacaattttcctacattatataacattattctttctttgattttccctcaccatttaaacatgtaaatggaccatgcaaaaacaggtggtgggctggtttggcccataggctataacccctggtatatagagccattaacataaaaatacaatttaaagctaatttagaaaattttacccaaagctgtgtaaattataacacattaattattatattctacatactcatttagggtggaactttataaaatatcttttaaaaatatataatatataagatcatgttatgtactacaaaattttaacacaaacattaacaccccattctttgtgtttttttgagaagtttttgttgttacttacacgaatgaagctataggaaattatcctaggtcagttcaacagaggagacattttcagtcttgctcatgtttagcactctttgaaagtcttgatgctcaattagtcaattagtagccgccagatggagaagggtatttcttcacaggaacacgtgttgctatgtgtgtgattaagagggtgaaagatgctgttgtgtgtcagacctctctgtgttccttttagatgtcactagctcaatcaccaagggcaatggaccataagatacttatgtatcttctgcttggcttcatgcttgatgcctctgatcagactcagtgtttcatttccagtatcacagatgacagagtaaaatgcaaaatgtgttgctgcacatgtcaaaaggtccagagaagaaaagacagctctacttttgcatttggattaacagcaattgaaaataaatgcccatttccaattctttgatattgtttaaatttatatgtttgatatctgtttgttattatctacacgtatccagggattatttgcctaagctgcaaaattggaaaaaaaagtacagatttagaaaatatgctgccaatggcttaattcagattcattgttaaaccacaatattaaagtacactgttaacataatgtacactgatagttttgtttgataattacctacttgaaatagtagactgataaattgtcccaattggagaagaccttcaaccatctatgccaaccttctagactgcaattattaattaatcatttctggaacaaaagctcctaaaaatggcttttaaaattgtgttttctgctgaaagattctgctgaatggaagtgggagtgtgaagcctaggaaagaatatattcatttcatgtttttgattagctctgaaattttatttaccctcttacctagaggaagagtgccagtgtatattccctaatcctctgctcaggaaattcaacactttctgcaatttgtacttgaaaaaaggtacacaattttagaaaacatagacaaaaaaaacagaacaaaaccaaacaaaaggcaattattgatgtgaagcaaaaagtattaatgcactaaagagttgcttcaggatgcctcccttgccccatcgctacacacaactaccctacaaacgccaagattcaaatgtgatactctcttccatattacatttgaatcttctttttccaggaaaagcagagtatgtatgggtgtacccatagtaagcatgagggcttccattgtttttccatttggcgagttgaaaaacaagtgtgctgcattctcctgtctgttacggtacagatatcttcattggagcactatttgtgaagcacacagttttcaagtcttctagagcaaatttgtttgtcaccatcagaagggctggaaataaaaatatgtttgcaattgacatagtgcaggaactggttaacagcttcaaagaatttataaagaatatttgtctctgaaatgttataaatacccatggtgaaaaagacctacttagaagatgttttctttaatattcattgtgttttaccaaatacagtgaggatatatgagcaattagaaacatgtgcctgcaggttggctcttgctttctttgcagacctactgcccttcttgttcttcctctccatcattttcattgccttgttaagatttatctggccaggcgcggtggctcatgcctgtaatcccagcactttgggaggctgaggtgggtggctcaactgaggtcgggagttcgagaccagcctgatcaacatgaagaaaccccatctctactaaaaatacaaaattagtcgggtgtggtgggacacgcctgtaatcccagctactcgggaggctgaggcaggagaattgcttgaatcctggaggctgaggttgtggtgagccaagattgtgccactgcaatccagcctgggcaacaagagcaaaaccccatctcaaaaaaaaaaaaaaaaaaaagatttcttaacctgcttttccctccgttgcttttgcctgtttccctttcctagttttcactttatttttttttctctctcctattctgttttttattctttgttccactttatattctcccttggtgtgaagaatggctgcagttttagtcatggctataagacaatgtcattttagagagctaatgtgtcctgtcattgaaaggatgagatgataacagaagtaagaggggctggtgtcctacatctccacggcaaggatttcgcccttctcccaatggtgtggttcattgaaatagctccacatcctcattaagtttatttttatagtatttctgtctctaatattttttccccatggaaagattaggttttctttttgagtccttctggctctcccattgtccctgtttgctggcagtggaaatgctataaatcagtattgaggtctggcaattttgcatgccgtcagctaaacataatgctgttgaaattcaagcacagttctttttaagtagacatttaattttagtagaatttgcatttgacagtttgaattcatgtgtttcagcatctgagtgaaatagccctctctgagttctaatggaatgaatttagtgaaattaaccttttgtcacaaaaacacactatcctaggcaaaagttttcacactgttttcagtcagttctatgtagttataatagaatgaatcttcctaatttaagtcatagaatgataaaagcagtgatgaaaagagaatgtacacctaggagtccttaattactctgtgaagtgccagcaataagtatgggacattgacgtgaaactccagttcattacatcaaaaaaaatattaatggtgagatgtctgacactgacaaaatacctagacataacaaagtgcttgtggaaaatgcttgaatttttttttttttttttttttttttttttgagacagtcttgctctgtctcccaggctgaagtgcagtggtgcagtctcggctcactgcaagctccgcctcctgggttcatgccattctcctgcctcagcctcccaagtagctgggactacaggcgcctgccaccatgcccggctaatttttttttgtatttttagtagagacggagtttcaccatgttagccaggatggtctcgatctcctgacctcgtgatccactcgccttggcctcccaaagtgctaggattacaggcgtaagccactgaatttttaaatttactcttaatatgtattcttgagctaattaatgagaaaattcaaacaatcatattcagtaaagttaaccatcaacacagtcgataagtttttcacaaatattctcccttttctttgaaataaagaaaccagatatagaaataagaagtttctattttaaatatttaatatttcttctggacaacattaaagctattaaacaatgccattggccaactatcaattgttaagtgtgtccaaaccctggcattcaatttttttccaagacacttaaacatttaaagtctgtttttaaaatcttaattatttttattaaaaaaggatttttttaagaaaaaatgattttttggtaacactttaggttgcaatttttttaattttaattttttttatttccataggttattgggaaacaggtggtatttggttacatgagtaacttctttagtggtgatttgtgagattttggtgcacccataacccaagtagtatacactgtactcaatatgtcgtcttttatccctcacccctctcccaccctttctccatgagtccctaaagtccgttgtgtcattctatgcctttgcattctcatagcttagctctcacttatgagagagaacatatgatgtttggttttccattcccgagttacttcacttagaagaatagtctccaatatcgtccaggttgctgtgaatgccattaattcattcctttttatggctgagcagtattccatcatatatatgtacaccgcagtttctttatccactcattgattaatggacatttgggttggttccatatttttgcaattgcaaattgtgatgctataaacatttttgtgcaagtatctttttcatttagtgactcatttacctctgggtagatgcctagtagtggaattgctggatcaaatggtagttctacttttaattattcaaggaatctcctcactgttttccacagtggttgtacttgtttacattcccgctagcagtgtagaagtgttccctcttcactccatccacgccaacatctatgattttttgattttttgattatggccattcttgtaggagtaggtggtattgctttgtggttttgatttgcgtttgatttgcatttccctaattattagtgatgttgagcattttttcatatatttgttggccatttatacgcctttgagaattgtttattgaccttagcccactctttgataggattgttcgtttttttctaggctgccactgttttaataaaatagtttttttcttttttactagatcattcttatgattcagttttactagcatttggcaattagcaattattgtatataaataaagttgtttcgttctctgaagaacctgcagagaaccctcgtctggagaaaaattctgtcaggtctaatatttgttaagttcttaacaaagaacctggaacacaggcaaagctcaataattttattaaattcaaactgcattcttgctggtgagcaaaaccagtgtctaaggacttacatgctacatagttctttgatgccaacattagatatagaatgattagcaaatacgttccaaaatgcttaattcttgtgaaaaatgtttcaaggtatacttgaggtattatccttttttgtaaaggccatttgagatgacaatttttgaactactttattttaaaagcatttattattaagaaattcattaattagtactcactgcaccctacttttagtcctgcataatgcacctgtatttttgtactaaaaggtaaatacaaataaatgaaaatgaaaatattgaactctaagtatgtcaggattcctatagacatttcacactctgagattatgcaaattatgataatcatgttaataaagatttggatgaattaattgttattcaaaatggattagtttgcaaaacttcaaattagtctaaaatggagagatttttctggcctcattctatcttcttcgcaggtctttgaagacagctgtgtagtatagttactgtgatgatattgtcacagaaataagttgaagcattttgtgtattttgtgtactaccaatgcctaaataactaactgaaaaatgtatatatattcatagaaagataccagggacaagtggaaagttacttaacaatgatgtgaactttgacatacttaaactctttcggtctcaaatttattgttcagtacaatggttaacaataaggtggttataactattttataatcatcctataacaattgagtgactgtaaaaatgaaataagataaactttcattaaagaacctagcatagtataatgacaggtacataaaagtcctcaagttttaattcttatccaaattcccgtaactctatttccaaggcctcaattttctcacgaaaggcctcttactttctgaaattctatgatttagtttttagttcaattaatattttagcaaatgagtaagttaatgaattaatatatttcctttagagtttactttctaatgcacatgctgttatggtcctatatgaggaaatgtcttttaatgtgcaatattaaaattcacggtcacataaaatgaataaagttttaatgtagaatataacatttttgaattctagaattcaacttaccagagaaagaaaatcttagaaaacctggttaaaatggcttttgataagcacattgaatataaaaacagggtatttatatatatatatggatatgttttctatcttattttcagatcgtaattagccactatataggttttgtccttcacagaggtagaaaaaatacatttaatcacttccaaaaatctgtttgagtcctgatagcctgatatcctttgaaatgcttaaactttgtatttggtatgattcgagatttcactaaattctctattgtccccacgaaaatgacttatttgggtagggggtatttcttatcttgttggaagctttataaaggatcagttattgtatctttgagctgatgaaatagtttaacactgctcaaaacttgtccaagatgctgatatgtatcttcagttagaccatttgaacacatgactaatacacagaccaaagagaacattgtttaaaagaaatcttatcaagaatcatgtaatagatcttaggctatttggatttcctcacaggaaaatagaagcaaaggcagtgacagcaatactcaaagtaggaattgagctctgctccatgtggataatgacaacatctgcatctgttgtgaacttgctcccaaatcggagccctgtgtttttcagcttcctgatgaacatttctactttgtactgcacaatcgcctcactgttaacattctgaaatccactcatttttcctctccatatttctttcttacacacctgttcttcttgtctgccagatgtttgctttatatcacaattgtcttttccccctaatcttggcaactcagcatcatctttgattctgttactgattgggtctgagatggagataagtatgcaggaggtttagcgtgtaggagcatgtaggggtgctcttgggatcactacctgtggaaaggaagggaaggaaagaaagaaggattgggaagagataaaacttgggatgcaatgtactcttaccaaagcctagagctgacctcgttagcagttttaaatctaggatgtcccttcagtactggcctgtgttggggtgatgggactgaggcttttgtctccactttggccagtcactggatacaggttgccccaggaaacaagtagtagatgtaggacaaagtgactttttctcagccaaagaaatttggctaaaagggctaagaagttcttcagtcaggaagagatcttgtcagcacataacagtatccactggagactcctttaacacaaacaaacaaacaaacccacaaaaagctattatacatgatcagatcttgttttcttcatgattttaaatttccaaatctcatctcttgctgcccaaccaccaatctaggttaggagcttatagtgcctaacataggcacttatgaataagtaggacctcctaaatcagatctatccaatccatcccttatccatcgcatttttcaacctcatgaaatgcttccatgagcccataattagcccgtttagtaactcgttggctctccattggcaacagaataaaatgcatttcttagcttatgattcaagaacaaccactgtctgtctaaataatataggtgttgtcaccccaatcttccaagcacatgttttgctttgttagtgccattgattttttttttttacatttaacacctaaaataaaagatctacttggcttatatggaaatcaaatatcacatagttatctggtcatatttacagggatattatgtccaataagccatatttacctacaattttacttaggtcctgtagagaaaaataaaaaataaaaaaaaaggggttgaggatttgcaagaggacatagttacacagatctaatgtacaatgatatttgaacttctgtggacttgttcttatgagtaacatcttccattttaattaaggtcagatgaaaactttggcattatccatgctgagtcctgagtctcaatcattcaatgaatgagttgctaggacacttagttcaattagctatgaggtatacacatggacagaatgttttacaaaacttggccctactgacttgagactctcacatgtattacaaaaacaagtgtatccccatggaggtctgactgtatatctgccttgtaagatcatggaatgttagttgtgtttaagttcctttaaccttctttctcaatttataccttgtttaccactaaaaatagacacctagccttagttgttttggttttaagattgtttcatttatgagtatatactattctgtggctgatttttttttctccctgatttctcttcccctgagttccaagtacttttcacaaagaaaaccttgttcataattaaacatttcttacctcaggcttggtttcagagagaaaccattcaatcaaaagagtgatggaattctgtcactctgatgttatttttagaagttgtttgggttttgattgacacatgttttgtggtctgtgtgtatgttgctggggataatttaattttaagacattaataagaaaagctcattgactcagtcaaagggaaaatgactttttgaagtcaccacacagttttaagaagggatcatagacaaggagaaaacggccaaggaaactttggtttagctggagtgtcgtgccatagtcagaggattctgggggaaatagaaagccctaagaattagttcatatgtgaaaccccacctgccattttggttgatttcctttcttatatcctataggcaaatttccagtgcctactggtttcagtttaataggtgagaaaagcataacacacataaataaggtttaaaaaacttttaaaggctcaagaaagaactaaatgcattcagaaaaaaagaaaaaattagatctagcccagtctgaaaggaaaaataatggcagttgaaatgttgaaatttgattgaaagatttgagatatagtatttgaaatatagtattctaaatcatttaatttagaataccattaatttttaaatattttgggattgaaatcagttcataatgtagctagagaatttaattcaaatgtaaaggaaggacacctgatatgcacttcaatatcattaaatttagaggtcagaatgaaggcagaagaagagagaaatgattctgcaggaccaacccatgtggtaacatatttatgcagaccaccccaacatgatcggaatattactgccacagtggggcacaccttgaaatatgatgaaatgtttcaaggttgttaaataagaaagaagttacgaacagaattgttttcatcaaattttcactgtgtaataacacattgtaaaaccaatataggagtggatttacaaattctgggcatacataagcctctctgatgacttagctaagctggttttgaaaagaaagtgcaacataatggtgaagattattcaattttgctcgtggaaacaattgggcacataatgaatcaagaaaaatgctgagatcgttgaacaacaaaactcaacacgatcattttttgaaatcttccgtgttgttatggtgatttgtgtatttagaacttaacaatgtgaatggcatgaagaataagtgattatgcattgctgaatgcctttacaagagttcgctaagaagaaattactgctttatcataaatgtattgttactgcttgaatgatgatagctgtatatttgtccctttactcactcagcaaacactattcatttcaaggttttggtgttacatcaagcaaaagactccaactgagaaatggtactattatatacacacacatctcccttggagggtttctgctatgaatcaatattatggaatgactgtgtagcataaacagtacatagcatcttttagataatcatatttagaaacagaaatccttttatatgtgtattgttatagtttcatgttaaagaaggtaaaaatcagcagaactacttttaaaaaaaatcttagagtaatacctccttcccatgagcgttagtaaagataggaaagatgatcgttttatgctacatattttcctattgccaggtcaagtattataaaatttaatacatattgttgtaggactttctccttagttcagctggaaacagtgttcttgtcacacaaccatgaaaaattaggctcacagacactttgaagggtgagaatggcagggtttattgggtaaaaacaaataaaaaggaacagggactctcagcaaagccggagtcctgctaccaggtttcctgcctcatagattgaatcccaggttccaccccagaacaggagaggccaggctcctgccccctgcaaatggaaagaacttaccggctccaccccattctccctgtacacaggccaattagagtttctctggggacccctttgtacctggctgtctcaatatgaagaaaaagtagtcatactaagattttttttttctagaaccaactatctaacataactgtcaataattagaaacaaaactgtacaaaaatacttattatataaatttttaaataaatccttgctaggactttgctctctgaaatttgaaagtatattttaaaacaaattaatgctttatctccttcctaggaatgtattcctcacattgtaacaagttgataaccagaattataattgctagtgaatccgttttcttattctattctctgctcacacatgttttaagatgccatgcggttaccagcagtgaatccgtatgggtctgcagcaacctcagttcttgcctcctccaaagaaagaattcaaccaaggaggcagaacgcaggagagatggaggcaatagagcatgagtaaaagtttatcataaaagctttagcgaaggaatgaaaggaaataaaatacacttggaagaaggccaagcgggtgacttgagagatcaagtgccctatttgaccttctgacttggggttggcatatttctagggtcttgcatctcttctcccctgattcttgccttggggtgggctgtctgcatgtgcagtgggctgctggcacttgggaggtgagcaagtgcagtgtgtttactggacttgtatgcgtgctcaggtgaggcattcttcccttacaaatcgaatgaacctagaaggtcatataacaagtaaactctgccattttgcttcttaaagctcatgcttgagtccactccctgaactcctgctgattgcatcaccagtttcaggttttttttctatctattgggagactgccttttcctggcgctggctgtgaccagttattattttagagaggcagttaacaaccacctgcccatcacctgatggtggcccgacattcctggtggagagcagggagagctccctcctgccccgctcaagccttgttactacctactgtaacagtgctatatagattgtcatgatgattttacaggtgtatacgtatccccaaattcatgaagttgtacatattaaatatgtacagcttttttaataccttattaaagtggtgtaaaaatagtcgtgctacatatgactattttgtcatggccactactgtcatcttgagcattgcaaattagttattctagatgaaacaaaaaaggcttgcctttgacaatttctcaacatgtttagtattttccaggttcaaccaataccactttgaactgctctaaatcaagtaagccagaatgtgtctggcagctgaactactgtgaacctaataaatattatcatcattttctattgctaatcaggagttgcattttaggcaatgcaaagtgggtggggtactcactttctgtagatgattcatggaactaacaatacataatacagcatcaaattaaaaacttatttaagtccaatctatgtgaaatagaacaagtgacaaatgacataggttactagtagtaagtggtaagggagctgggttttgatttttttttaaacaaattcttttctaatgcatttattgcaggcacagagcaagtaatcttaccatcagagtttttgtactgcactctattttccttttcaagaaaggaatttcatgaattgttttaagcacagctgagtgttattgttcctattttgtgcattactgttaaagttctcatttccttttcaaatgtgtaattttaaagacgtgatgaattcttaagaataattttatgatgattaggaaagcaatttttcgagctatatacaatttaaattttatagtgacaatcatgaaaaatagaaatacactttgcagcaaatttgcgaaattatttctgctaaatgagtgactcacataaagcaatttgggtttgttttattttattttttgtcattacatcatgcagctgttttcctctatcccaagaatgtaactagtgattgtaggatcatttcaaatactcaattgtaaaatggcagttttacatatctgtggtgatttaaaactctcacacacatgggtgttaatggaaactagttactttatgagtattaagataatttattaatcttaaatataacttttctcattgtggatgtttttggtgaacaaatacattacttcacagttatttttgtggtgagaacacttaatatcaactctctttgtgttttttaagaatacaacatgattattatctatggttgccatactatacaatagatctctcctcctatttagctgtaattatgtttcatttgagaacatctccacattcttccctccaaaccactccagcctctgttaaccaccattctattctctacttctatgagatcatttgttttttgattctacatatgagtgagatcatgtgacatttttctttgtgtgcctagcttatgtcactaaacatactgtcctccagattgattcgatttgtgataaatgacacgatttccttcatttttatggctgaacagtattccattgtgtatatatactatgttttaaaaatccattcatccattggtaacatttaggttgattccacatcttggctattgtgaatagacgctgtaataaaaatgagagcagatacctcttcaacataatgactttatttcctttggatctataccattaacaaaagtgttagatcatgcggtagttcaatatttaatttattctggaacatccatactattttctataatgactatattaatgtatattcccatcaacagttgataagacttctgttttctccacatccttgccaacacttgttatcttttttctttctgataatagccattctaacaggagtgacataatatctcattttggttttgatttgcattgctgtgatgaataatgatattgaacatttttatatgcctgttagtcctcttttgggaaatgtgtgttaatgtctttgcccattttaaattgagttatttgtattcttgctattgagttgtttcagtttcttatacattttgaatattgacaaaatttaacctacatttatcataaaagcactccatgaatgtatcagatgtgtagttaaccagatgtatagtttgcaaatattttctcccattcagtaggttgtttcttctgtcgattttctcctttgctatgcagaaacatttcagattttggtaattccacttgtctatttttttgcatttgttgtctgtgtttttggaggcatatttaaaacaaaacaaaacaaaacaaaacaaaccttgcccagaccaatgtcatggagttttctcctgttttgtttttgtttttgtttttttttagcagctttatagttttgcatcttatgtttaagtcttgttccatttttaattgattttatatatggtgagaaataaggatttagttttattctctgcatatgtatatccaatttatccaataccatttattaaagagactgttttttcccccattttgtggtcttagtgcctttgtaggaaatcaattggctgtgaaaaagtaaatttatgatttttttttatttctgtgaagaatgtcattggtcctttgatagggatcgaattgcattgtagatgactttaagtagtatagacattttaacaatattactactttcaatctacgaacataaagtcttcctttttatttgtgtcttcttcaatatgtttcaccaatttttcataattttcagcgtagagatctttcacctccctggttaaaatttttggagtatttttttatacctatcaaaaaggagattattttcttgatttctttttcaggtagtttactgttagtgtacagaaacactactgattttgatttttgtgttaatttttatcctgcacctttaataaatgtgtttgttagttccgacaacttttggtggagtctttagagttttctataaaacggatcatgtcagctgcaaacaaggatactttaactttttttttccaatttgaattccttatattacttccttttgcctaattgttctggctaggacttctagtaccatgttaatagaagcggtgaaagcagatgatatggtttggctgtgtccccacccaaatctcatcttgaattgtagcttccgtaattcccacttgttgtgggagggaccccgtggggagataacggaatcataggggtggtttcccccatactgttctcgtggcagtgaataagtctcacaatatctgacagttttataaggggaggctcctttcgcttggctctcattctctctcttgcctgctgccatgtaagaagtgacttttaccttccaccatgattgtgaggcctccccagccacatggaactctgagtccattaaacctctttttctttataaattatccagtctcaggtatatctttatcaacagcgtgaaaacaaactaatacagtggatgtccttgttttgttctagatctcaggggaaaagatttcatctttcccatttaatatgttagttgtgggattttcatatatggactttattatgttgaggtatttgtctatacctaattcatggagtgtttttatgatgaatgcatgttaaattttgtaaaaaggtttcttctgcatctattgaagtgatcatattatttttgttgtccactctgttagtgtgatgtgtcacatttattaattcgcatatggtaagccatcctttcatctctgaggtaaatctaacgtatcacaatgaatgatgttttccatttgctgttgaatttggtttactagtattttgttaaggatttcaaacctatgttcatcaggaatattggccagtagtttgtgttcagatttaattgtatcaggataatgctggcctcatctaatgggtttggaagtatttttttcctgtttcaattttttagaaaaatctgagaattgatattagttctttaaatgtctggtagaattcagcagtgaagccatgaggtcctgggctttttactgatgggagactttttatttctttttaatctccttattcaatattggtctgttcagagattctacttcttcataattcaatcttggtaagttgtgtatgttcagaatttattgatttctcctaggttatccaatttgttggaatataattgttcataatgttctcttatactattttgtatacctatggcattggttgtaatgtctgcttacttgtctctgaatatgtgttgagtattctctttttttcttactctagctaatggtttgtctacttcatttatcaattcaaaaaactaactcagttttgttgatcttttctaaggcttttgtagtctgtattttatttatttttgctctatctttattatttcctcccttccttcttattttagatatgggtttttttctttagtagttctttgagatacaagattaggttgttggagatttttcatatactctgatgtaggcatttattgctataaacttcttttttagaactacttttgctatatcccgcagaatatgttgtgttcccatttatatttgtctgaagaatattttaaatttcatttttaaattttttcattgtcccattgtttgttcagggacatgctttttatttccatttatttgggaattttccaacgttccccctgttattgatttctagttttatgtcactgtggtctgaaaagatacgtgatatgactttaatcttaaacttgtggaggcttgtttgatggtctaatatagcatctatcctggagaatattccctgtgcaagtaagaaggaggtgtattctgcagctgttggatggcttgttcttatgtctgtatacctgctatattcatttagtcagtaggacagtttcaacatgatgtttctatgttgattttcagtctggatgaactatccattgctgaaagtgaggtgatgaagtcgcttactcttagtgtatttcagcctatcgcttccattttattaatatttactttatatatttaggtggtcctatgttgggtgtatatatttataattattatatcatcttatcgaattgactactttataatgacctttttgtctcttttcacagattttggcttaaagtctattttatctgatataactatacctagccttgcactttaatggtttccattccctcatttttagtccatatgtgcccttacctgtgaaactgtctcttgtagtgcatttcaacatataattgagtcatttttttaaattcattcagctattcagtgtcttttcattagagaatttttttattatttatatgtaggaacttactgctgtctttttgttacttgttttctagttgttatacagattcattcttcctttctttcttactgctttcctttgtgattaagtaattttcatgaaaattgttttattctttgctttttctgttagcgtatctgttataggcttttgagttaatgttaccatgaggcttatgaaaatcatcttattgttgtaacaagttattttaacctgataacagcttaagtttgattgcaaaaaaaaaaaaaaagacaaagcaaaagcaaaaatgtttacatttttactcgactcctccctaacagtttgaatttttgatgtcacaatttacatcattttatattgcatatcgattaacaaataattttagttattattattttaataattttgtgtcttaactgtcatattaaaatgtttggttgctacaccatcatagagtaataaaatattctgaatttttgtgtacttacattacagtgagttttgtactttcagtgatttttgttttactcactggtgtcctttcctttcagcttgaagaactccttgtagcattctttgtaaggtggtgactaactctctgcttgtgtttgtctgggaaattatttatttatcttatttctgaaaaacagctttgcagggcatagtattttttgttgacagttttttcccccagcactttgaatatatcatcctgctctctcttagcccgtaagatttttcttcagatgtctgctattggcttattagagctctcgtcatttgtggtttgcttcttcgctcctgctgctttccaaatcctcttttttctttgattttgacagttgcagtataacttgagggtaatcttttttaaattaaatcagaatgaagactttttaccttcctgtaaatatttctatctttctccaagtttggaaagttttctccttcaatttttaaaataatattttacctttaactgtcattgcttttttttgaatgccaatgattattatatttgctcatttaaggttatcccagaaatcctgtaggctttctgcattttctttatttttatttcctttttcccctttgtatattttcaaataacttgtgtatcagtttagagaatcctcttccacttacgaagttcttctgttgatactctctatagatttttaaaatttcatttgttgtaatttttagctctaggatttctgtttgatttaatattattattatttcaatttattatttcctcatcatagtcacaatgttttcttcatacctttagctgtttttctgtatttttttgacatttgttgagcttccttaaaacagttatttttactttatcgtgaggcatttttcatacatctccatcttttcagggttagttgttgccaattacttttgtccctttggtgacttcatgttttcctgattattcttgatttttttggtcatgtgctgatgtctgcatactgtagaagtagatacttattccagtctttgcagtctgcctttgtctatgaatatccttcagtgttaagcctgtccagaggttaagagtgggccacctggtgtgatccttaagcccgtgaccactgcagctattgcagtactagggggtgccctatatcctgaaccaccatggctggtatagtgactggtcagaattttatggatacagagcctgccacaatgcagggctaaaagtccatgaattctataattagtgcggtgctagggtgtgcttgaagcccatagttgctgaggctagtgcagcagtgggtcatgtctaaatcccatgacctctgaggtctgcctgttgtggtaggttatttagaatccaaggctgctatagttggccagtagttatgtgaactagaatttgagtcattcttgcagggcctgggggttcctatcttgcactatggtgggtctaaaggatcaggctacagataccaggctaaaatcagagatcatgcaggtctacctaatgctggtttttactgtggtgggcctggtatttgtgtccaaggcaaagttctacgattgcttacctctctttctcccaagtgaacagtgtctctctctgctctgtgctacctggggttggaggttgggtaacatgggaaatgcaaaaatgtccgttctaccttttttggtgtgtcttttctaattattgtgctatgacaaggtacagtcatcttttacttggttttcgtagctcttgtgagatatttttacctatggatagttgtcgaaattgatgtttcttccggtgggtgatcactggagagtcttaattgacagtcttgctcggccctcctcaggtttgactattcttaatgtcctttttctattgggcacctttaaatggaacacttaaaacagacacgcatcttttaattattttacagatgagtaaaagaatcaaatgtgaatttattcaaggtaataaatattggtttaaagaaattaccatagatcttaatatagagaaaatcataattgtggcttacctataaagaaggcttggtgctgggcattttcttcttcattttttaaattctgtacgtctttccaacacaaatgccttctaaacactgatgatgctgtaattcttatctccagccatgaattcttcataaaatctgagacttatttccaaattcctctagttagaggactctagaaatcttaccaccccatgaggatagttataatgatctgaagtccaggttcccctgtaacaaagcttgtcaggtatttgaaaaaaaagaaaagatgtaacactgaataaaaaagaaacaaaatataaggaaaaaataacttggaataaatagaaattgtacaggggaaggaaagcttaaaaaattaatatttttagatagatccaaataatttatttaaaaatgctataataaatagtgtttggaaattaaaaataagacatggtaaattaaaaatgtaataggagacatttaaaaaaatagtcaatatgtttagagaaataaagttgagaaaggaaatcatccattaagtaaaacaacataaggcaatgtaatagaaatatataataggtagggtaataaagtgtgataacaaatattaaaataatgaaaattatacaaagagaaactttaaaagatgcatttattatataataatttactgtgagctatgtgttttcagaattaaaaataaaaagagaatgtccagccaaatggatgaacatacactcacatagagacatgtaattatgaaacttcagaaccataagagtaaaatgaaggttctgcagcttcctgtggggacaaaaacaacagcaaacagaaaatatatcacatacaaaggatcgaaactcaaaatggctttggactttccaacagcgatactggaagctagaagataatccagttgtgcctatagaattctgaaggagattatctccagtatagaattctatagtgagctaattattaatgagttgttagaatgaacacatacattctcagacaaacaaaacgtcacgaaatttaccccctttactttcatgccaagcaagctactagaggattatttccatccatttgggctgctataacaaaataccataaactatcaataacagaaatttatttctcacagttctgggggtcaagaagtccaagatcaaagtatgagcagattcattgtttggtgagggcttgctttctggctgatagatggtgccttctagctgtgtccttacatgtggaagaatctaacttgctctattgggtctcttcattagggcgctaatcctaatcatgagggcacttaccttagaaccttaacagctcataaactccccacctcccagtatcattatcttgcaggttagggtttcaacaaataaattttgggggacacaaacattcagaacatagcaaggatgttccttccaaaaaaaaaaaaaaaaaaaaaaagaagaagcagcaaactggaaaagaagacaaggatttagaaaaccaaaggactaacagaaaagggttgtatctctagcattatgaggaagagaagtcccagagtgactatctgtcctttcaaacaaagaaatgaataaggaagatattagagggagcataaagagagtgctacataaaaggcaaattaaattctgaggctgacaaaaaatgaaagtcctatattgacagctgtatagcatgactagagcagaatcaattccgatagaactgagttctccatgtaggattgcaagtagattacattatgtgattgatcttgtacgtaattataatgagagactactaaaacataagaataggcaaaccaaccccccccaaaaaagtagcaagttaaaaaggggctataaacaaaaagcgagaaaaaaataattattgtacactacactgataaattttgaataatacttgcaaagttatattaatacaaatatctaatattattaaaccaaaaaaggcaggataactaaactgctatgataaaaaatggggaatagaggaaataacaacgtaagagttaaaatctcaactaaaatcagtcaatagaaaatatttaaaattaataaatcaacaaatagatacgcatgcatattatttagagatatatataagatatatatacaagaatgccacagtaaagagtggataatggtgattttgagagataaagcaaagaaatgtctacttttgttaggaaccgtttaatgccatttaactggttgggtgcagtggctcatgtctgtaagcccagagttacgggaggctgagtgaggtggaaggactgtttgaggctgggagttcaagaccagtctggactaatatagtgagcccccatatttacaaataattttttaaaaattatccaggcatgatggtgcatatctgtagtcctagctactcaggtggctgaggcagaaagattccttaagcacaggaattaaaaattactgtgagctatgtttatgccattgcactttagcctgagtgacagagaccctgtctcagaaatttcaaaatatcatttaactttgtttttgcttgttaattaggtacaataacaatacattcaaaataagaatatatttccatgatatttggcgaggaaatatatttggttagatgtacaaaaaactattgaagaataaaatcgatgaattcaataatattaaaacttaaaactcatataccaaaaaaaaaaaaaaagaaaaagaaaaacggtaacaaaaataacaagaaaactacaggaagaaaatgaagccattacatagattgggataatataattgaaacttaaacaacaaatgaaatatttattttcagaatatacaaagttctaaaaataaaccagaaaataattgaccttgtagaaaaatgagcaattggtcataacagaagaaaaaattcaaatgtccaataaatataggaaaatttacaaatgcaaattaaacaaaaacatgacacttcttattggctatataggtaaaaatataaatttccggaataccaaatatttactggcaagtggggaagagaaattttgcctcatatactacttaaaagtctaggttggtacaatcacttttacaaatagttaaactgtcatcgtatggcggagttgaaagttaatattcctgataagataaatgttcctgataagagaatatttacactaacagaatcttagtttaattcacatatactgatctaattactgcaactcacacttttattattgcctttattttgtagatgagaaattgaagcatacagaattaattagcttctccaaggctacctagctagttttgcttgtgttaaaacgaatcaactagataatatggaatatactggaaaatatattgttgagtaagaagtaaaaacaaattgttgagagcacataacagtgataaatgtataaagttttaaaacacaaaataaagttttatgtgtatttaaataatacagtgacttattccaaaatcagaaaagcacagatgtggaagacacccaccaaactgaagatagtattggtctctccggaggcaggatcaaaatatcaggaagagcttcaaagctatgtcatattttattttttaaaatgatccaaaatatatggtaagattcaaatacttgttaaatctgggaggtgtgacatagttatttttgtattattctctctgattttctatccacgggaataggaatatttcataactttaaaaagggaaatgatgtaatcggtaacattgttgtctcctctttaatctcacagatattcctaggagcaacccttgttattttttatgatccatacacaataaccaatattttaaatatattatacaaaagtattgtagagaaggaaaaataatttttttctctaccctactgggttcctagctggaatagacccctgcaacaaaggacaaatgaagaacataaaagcaaaaagaagtttattaacttgtatacctcatttacatgtgggagatacccagaaaaatgagtaagtcaaagacatggcttagagattaggcctaaataccaccttcaactgaaacaaagaaagaaggatatgggccagggtgcagtgatggtaaggtgaccaagaaaagtatggtaatccatgataaattctattatgcagacttaaaccagtgccttctccactgaaaagagtctctggtgatttagttatccttttcttctgggtactgaaaggaagccacccttgcaaatggaacattcctttagagataagtatttctctttaaaaagagtaacttctacttcattttcagagcttctttgttgtctgcagtttctcaaaataatcagctcaaaataatccttatggagacatattttggggtatcctatcctggtttcctacagtatcatgtatcttattgtaggagggggatgatagtctttttattttacttattttagattctttttcttctactcatcatagagatggctctacccatctggctggagccctgtaaattacactggaaaaagacagattaacaagaaactaaaactaaatagaaatttattaacatgcacaccatgcacatgcatgtatataggagtacccagtaatgagtaatccaaaggggtagttagaatataggcttatataacatcttaggctcaaaaaagaaaaaagcgttttgggcttctgggcaaggggtactagttgggaaagtggctaggagaagtatactaaacaagggttgttttagtgaggtttgttatacagatttatgtaggtgtcttctcaatccataagatttaagagttatccattgcctgatatgggaaagggagatatcttttacaaatagaaatctcctttatacatgtaaatttattttacaaaatgaaaatttatgccctgtttttagagcttttctggtgtctgccattcctcaggggcctttagctcaaaataatgcatatgctaaagaggtgtattttggggttgcatattatgatacctttcaatataaatacaagaattaaatagatgacataaaatgcatattcagaaaaaaagaagattcctcctctcccacaagaaaaattaaatttattttctctaaactaaatcttttctgtattttgagttttaaagtgtgtgataataaggaaaatttatgagtataaaatatcttcatatacacttctagtcatcttccttttagactgtgagaacatgaggctcctgtcattttactatgtttccttgtaatgcttttgttactggggagtatggggtccttggttcctgtcttcttggaggaaagaattctgccaagtgacacacaggggcaattcagcaatggcaatgtttatttaaaggaaaaagtacatgctgaaagccgagtcagggtgggctgctccagaatgagatgcattgactgacactggggaaccccctttatgagagttttacatgaatatttacaaatgggcataaagaggtgttaccagtaagcacattttgggaggtctcaaaacatgtgtactacactagtacatatgtcgcatgtttcattagtattttaaatccccactcatgggtgtgttttttactattatgatgagcaaaatgttacctttagggtgagccaagtcaaaatgcacatgctcgctactggggaaagtccctattgaagtgatttttctgctagggccaggtaagtctcagtgagggctggataagcctaaccataagcccagatgtggctactgttaattctgattgctctaaccacagagcataaattttctttttgcattgattccaagtggtgcaaggtatttagagcttctggggctttctttcctgctatctgtctgtctatctacctgtctatctagctacctactctaatgcttttcttcatacaaataaatgcagtaacttgtcatgaaattttaaaaaataagaaaaaagccaccttttgtataattatagttatattattgaatttcattaacttcatcagattaatgtaaattaaatatctgagcatatttaatttctagtttcttggttgtgggttgtgggctgtgtaagtaagaaaaaagccacctttttttctgggtttcctataacctgactagaattactaaggtatctataattaatgtaaattcagctttcataaaattaaatatcttaaaatatctgagcatatttaatttctagtttcttggttgtgggttgtgtaagtacttcagaactatctttagtcacaccaacaaaagagaaaatcatactcactctccaataagtaaattacaaaaaaaatacttatttccttaatagcttttgacataataaaatacactaaaataaaataaatgaacttctctccctaatcatcaatggaaagaaaagctaagcttctaataaaataagtgcaagttcattttcctgtttcttgttaaaattatttaatatgacaagtgtctaatacattattgcatatcaacacaatattatccactaaggaaacacctaatttggggtggccccacgttttcaatagacccaattattcaacccctaacattctattcattatttttttaggatccattagcaaaatattctaaactatcatttgtagtaacaataaggaaagaccgtgacttgttaatcctggttataagcgtattgaatgacctactcaaggaaggaggagcagaaaataatgagaaccagctggttctaaatcttccattatttctaatatataaggagagaatgaactataatttttatggtcttcatctgacaatacttcaagaagaggtcgcttactatggtgattcattttcaaaatttacactttagtttactatacctggtgtgggaaccagtttgcttcaagaaattataattttaggaaatggaaaaaatatttttcctctattcatattaggtttattggttgggtccctgcaaattagactgaagaaagattagttaacaaaagaaaacaaacaaaataaaaaaaacaggagttttttaagacatacattgtgcatacacacgtaagtacgccgtcataagtaactcaaaggattggttacaatgtaggcttatatagcattctgacaaaaataattttatagataagcagcaaaacaaaagaaaaggactttgaacctctgcggccagcaaattgtggaaaggcaaatatgtagggagactaatggtagataaagcctagttcgtaaggtttatttatctggactttttctctgtaccttgttgtctcgggtgataaagtggttattctttttctgatacaaaaattgagaaagaggagagagacatagccttcacaaagagaagttgttttgtgtgttcaggtagatagggggagggcagagaggtcttctggtgtttggatttttttttttttcagttgccttaagttcaaaatatttttaatgctcaattgggctattttggggtaatattactccaaagcttttcattaaaaaatagaaaaattatacaaatgccttccaaagatctagattatgcatatatagaaaacacaaacacatacacaaacatacatataagtagcgcaagtttccatgtcaagtgtacctatctgtctttactttgttaaatgtatcacctcttgctaacatgtatgtcttactatttagtagtgggagtaattcaaaaacactaaggtcaatgttctgataatcatccgatttttccccattctgcttataaaacatcagatttataaaaacctaatgtctgattgagaaaaggactcatgaacaaaaatcaagccatataatgtctaacaaaattggtggttattatatggtagcagtttgacaaccgacagttttcatccagacttagtccgatatgtgcatttaccttggctgtagaactgtgttgtttatttcacttggagttgtgctgaattaataatttcccttcaaaagggtatcattagtagccagtggacttttcaagctgtttattttgaatttgcaattcaattgaatgaaaggaaatacatataaatatggatcatttcagataaaaataaggcttttgttttagtagggaaaatatagaatagcttaactcaacatctagtagaatatttatcaatctagttcccaacattaatgagagcttcaactagcagcaaattctatagacttccttctacctagagcttaagagataagtcatcagcttaaattttggagtgtgactgtcacaatgtttcaacaaaatcagtcagattctttagaagctacacagttttcacagttattaatgtatatagatgtatatgaaaatacatactgatgtaaatttctatgtagctctgcccagtggaagagcctaggagcaacaatgctccagtatgctccagtatcattgaacacaccaggcgtctatatcttggttcttttttttttttttttttttgagacaaagtattgctccatcaaccaggctggagtgcagtggcatgatctgggctcactgcaacttccacttcccgggttgaagtgattcttccacctcggcctcccgagtagctgggattacaggcatgcgcaaccacgccaagctgatttttgtatttttaatagagacacggtttccccatgttggccaggctggtcttgaactcctgacctcaggtgatccattcacctcagcctcccaaagtgctgggattacagacgtgagccaccattcctggcctagatcttggttctttagtatcatttttgattaatggattatgccttcttgaaaaaaatgatgaattttggttctttagtatcatttttgattaatggattatgccttcttgaaaaaaatgatgacttttggggctgaaacaagacacgtatatatgaatctaaaatatctatttgtgccagaaagtaaggaaataccagaggatgatggtaacctggcagaagtacatagcagtgagtttagaggggataccattggccaaatctggaacaatttgagcatcaaactatgtagtgatactaccgtattataactcactgaataaaataggaatctttcagttcatatagttatggacaaagacatgagtaaataaatggagagaagagaaagctttttcttgtagaagagtaccaactagtcagcgcagaagtaatgatggaatcaggaaatcaaaatatagcaatcattgtagtgataatcaatgctgctaagaaatatactggctgagaaaactagcaggttaaaatgtgatagggaatggaatatttacatcttctaaatgtacctccccccgccccaaataattcttaattgtaaagggaagaaatggtaccttccacagtagagaagctggcatgttatcaaagttagtatcaccataaatggaacaaattaatatcctgccccatctgaggaagcttcaccaccgtgtatttctgccaaaatacctaccctgaatttcatcctgaggaatcaaaagacaaacccaaattgatgcattgtcaatgggagaactggcctgtgatatagaactatcaaggctgggtgtgatggcttacacctgtactccctgccctttgggaggctgaggcaggtggatcacctgaggtcatcagttcaggaccattttggacaacatcatgaaaccccgtctctactaaaaatacaaaaattagcttgacgtggtgacacatgcctataatcccaggtacttggaaggctaaggtaggagaatcacttgaacctgggaggcgaggcgggggttgcaatgagccaagattgcaccacttcactccagcctggacaactgaatgacactccatctcaaaaaaaaaaaaaaaaaaaaaaaaaaggaacaaggttgtgagggtaacagaaagaaaagcaactgttctggattgaaagaggcataaaaactaaatgtgacatgggattctgaactggatccttttggtattgttggggctcagaaaaccatactcaaaagtgaaggcctcagaagcagcctcggaagcaaagtttatctctggcctcctattccgagccactcattctcctctgagacaagccatggaaactagaattcatctccccagagcaggtcttaggaaccagaagccctttttcccaaagccagccatacaagctaaaaatattgttgtcatattttcctgtcttatctgggtaagagctggccatagagaaagtctctgaccttcctcgtttgatggcagccattccagaaagtgtccagcaccatattcaggaggaaggaacaccgcatagagaggccaagaagaatccagataagcctggctgggtttccccacctgggtctactagaattagaccagatccttttgtctaatcacagttctgcatgcctgtccattcttcattgaacctaagcataaaaatggatacttttccctgttcctttaattcttcatcctgagggctcccatgttatgtaaaaccataatgaaatatatttgtgatgcttttctcttgttaatctgtattttgttataggaatgtcagtcatgacctttatgatggggtgggaaggagtcaccccttttctgctccaatattataaaaaatggtggtgccataattggggaactctaaataagctttgtgcattagatagtagtaatagatgtaaaaaccctcattctaaggtttgtcatggttatataagagcatattcttgtttgtagaaattacagagtaaaatactggggatgatgaaaagtcagccagcagcttacttttaagtgattcagaaggaataaaatgtgcttcatagtattcttaaaatttttgctgtaagtttaaaattgtctgaaaaagagaaaaatgagaaagtaattaggaagatgaagtagtacttttgaaaacgtactaatattaaggagtaaattttaatttgaaattgaacctaaatagtagttctaattgtggtcacaacttgaaagtaaatgacagattaattttagagagttttaattctatataaaatttaaaagttgatcagtatgaaacttgagaattgtgatatttgaggctagtcaagaatcaatgaaactaatttaggcttagaaatatctttgagaagttgtcatgccaaagcttttgaaaacataatttgtaattagattgaatgttttgatttggatataaaactgacttagaaataataagagcagagcaagtgaaagagctccccaatcctgcccaaaactatgtagataaataaataaatactgaggccttttgggacctgctagtattgcagccagtgtaaacacagatgtgtagtgatgtggaaaaatgtgtttaaaattgaatctccaagttgacaactcttatagatgataaaaatcaaattaatggatcaacatttaccaaagttcttttaaaaccattttgaccccccaaaatgacaaacaagcataatccaaatatgtgtagaaaaataattcaatgtgttttcttgaataatagtttattaaatattaattatatgatagcaagtatgttgtagaatgattaaaattaattttctaagtcattggtcctatttttgaatagattcaaatagatcaaggtaattttgacagaacgggtcaaccattttgctagtcactgagagatgtccctggaatgatggtttgcagttgtggtgtactaaatattgaggggtgtactagacctggagggaagtgaaggaaatattaaaacttccatttgtctttggaatgagaactaaacttttagctttgtgctaagtggtttcttcagtaaaatatcaatattttatttatgtttttcttacattaagcatccattttagctaacctcacaaaatatactgtccctaaaaactcagtcttcatgtaaacactttgataccagctgttcttccatctaaaattattttcttcctcctcattgccttttcttcctgaagatgatcctgtcttcaggatctagttctctttctgccttttcatggaacattgctacaatacttcatccgtgtccgtctatcccctctgaatatttacagcatatgttcttagcataatttattcagaaagtaatcatcattgtcttgtgacatataaggaagtattttcttaccgtttaactctatctatacttctgcaatacaatttgaggttcttgaaagaggaatcctgtcttattcctctttgggataaggggaatattggtagacccaatgtctaccatgacccaaatacagtgctaagagccgggaacagaaatctaattatttctctcttccgacatgctttgtgtttatatgaagttgtggacaagttaatgaaagatgcaaggtaaaaatatgaatgcacattagctaatttgtctatattagaagcacagtgagttatgaaatggaaaaagggatgtttgtggcatgagatcagagctctaacaatgcctctccacaaggagacttccagtgatgtttttctggcactcagcccttagatatcattgaattaattcactaaagcaatctgtatgctgtctatgctcattttaatgttaattattctgtgttccaaaacaaatgtattttctcagcaggaattaaaatttcaggaatataacataaaaaaccctgtatcgtttgaatttttcataggtttttttctaattaaaacatatattgttaagtgcatgtttgcttttctaaaataacacctagtaatttgtaatacattggtttgttctatgagtgtggtttatgatggtctaccttttatccactggtgtaatatcttacgttttatcagtaaccatggaaatgtttagtacatcatccaacaataaataaataggctaacttcccagaaatgaaagtaaataattatttatttaattcaaagtagagaacatagcatggatttaaaaatcttatgtaagatccaataatccaaatatttaatattttctctttggtttaacataatgttcaaatccgaaagcctgctttgctcaccaacacctcccacccaacaaaactgccaacatgccaaaccaagtggattgatttaacagcaacattaagctcccctgccagtgtttggtggaaaggcggttaatccggagtgaaaggcctcaaatcttgccaacaggaaacaaaaaaataaagaagaggccatctgtaatacatactcatagttagtcagtccctggagattcttcagctctttgtctgcagcattaagaaacacatgctaatatgttattctcttttgttgactgctctaattgagatgcctgacaaattaatacagaatattaagattattaatgccaaatggaaaaagaagccttactacaaaatgtcatataaaagttatttgtaaacgctaaggaattaatttcttaaattatttcagcaaatgttaactttaattgtgctcaatgaatgtttatggatgcttttgacacagtggtttttttttttttcttttttccctcagagtatatttttaggcagtttaggaaacaaaagataaatgaatgattagttgtttagtttgtctgattcaaggcatagattggatttaaaagagcaggaagcatgagctcttgaagtggctctgggcacactgccccaatttctggatctcattggtaaaatggacagagtagggttactgggggaactgtgataatataaagttcttagcacctgtctgacatttcttatttttagttatattgtattgttttgtcttcaaatgcagcagataatcattttttattctatagctaacatgctggcatcatccaaaaaagtgacttctattttttttaattaccattttgaaaacaccatgccctataacatctaaagacgcatttactttagtgagtgggaataatgataatataatcccatggcttattcataaaagagaaccttggagatgctgtggtaatgagcaggtggtaacaattcttgattatttatacatttttgaggatataatgggattgagtcattgaactgctgttgtatcaatatgtaaatttcacacatcagttttttttaaagctgttttcttttgaatttaagaagggtaaaaacacaccagaaatattttaaaagagaggcctcagatatctcttaaactatcatgttctgttcacattcgtcaccatcaaacttatattctatctctaatatatcctacacattggcacatggctcccaggaagtagtgtctacagtaagaaccgagaaggtaatatacttgctctcaatttcttccttcttaggaatgacaggcaaaataactgtcacttctgtcaagtagcaatagatactattatgaagtatatcgtgtggcaaaatctctgctttaactgagtactttaaaagtacttacctaattttcattgcttgagtactgtgctcacccctttgggaacaccagaaatttgataattttctatctgagttctaggagattgaaagctgtgcgacttttcaaaaactttctgacacatgagtgctaatttgagcagaatttagctagctctcacaagtgatgaaagcgcggaagaaccagtgagcactgtcagtcttttaatctagtatctgattgcttgtctaactgtcattggtgaaaagcaaatatctttgttcttcttctgagttcaagccggatgtgctcctgtatttagcatgacaggaaatctcaaacggcaaagaattacatggatttaaggaatctgatattcctgtattcaaatctcccctcttgttcatgatagagtcttctgtagaaaatctataaaatagcaagaattaaaaacatactataaagtatatgtttggcttatcagaaatccatacaaactactttttctcagggcctcttaataagaactggttccatttgatgagtgagttgcaaactcttgaaggcatattgacagatggtttcatctgaacaaactgattttcttgatttgccaaagtgcctaaaaattagttttcaaatttttgaattatatttaaggcattttgcttctgagaggtgacttttgacagacccatattgcttcttataagaaacttaggtgaataaggcacaaaatagtttctagaattacttaattgtttttcaaggaaaaatggggctcaaagtgaatgggccacagggaagttacagctggatcctgtagagatcactgagaaaggtctactccctaggtcactgtgcacagaaagacaggcctactgtgattccacagagaaaaatgtgtccggccaatggacactctgagcacataaactactgaaggaagagagattgatgatttgggatgcttgagaaaaattttcctgcatttattcttaataatatgttagtaatttaagctagtaaaaaaaaaaaaagaaatcaatgtaaaggatttcctgacttctcttttctactgcaaataaagtaggttgatacatttaaaaagggctattctccttctccttcaggtcctttatttctgcttcttcttctgtcatattttattttttttctcacgtcttttcccaccatcctcccagttgtcttccttcccaacatcgccatttatttcatattatattcttcagcattacacacacgttatttaactggaaagtataataactacagccatttcttaaaatacaacattaatgggatgtaatttgttataacatgccatttgaaaatactgcatttttttactttagtaggatttctctactagcaattgtaattattgtattgtgatgtttcctatgtatgctataatatatgctataactgcctaccttacctacagatgaaaactctacaaaatggtttctaaaagtatctcaagtaaaatttgattttgtttcaaattacctttaaatttttaacattcttaacttcttttttaaaaattacaatttttcataatgccaaagataggaaatagtgagtaaaggacagtaaactgatttatttagcgagtaaagaacagtaaacttatttttactaaacaactctttttacaatacactctcaagtctaaatttcaaaatgttaaaaaaatgattcttgtacaaatataaagtgagcatatatcaaagatttatttaacttattcatgaggaaactagcagaatactacagctggtttaaaaaataaaagatatgagagaatatgatcaatgaatgaaagattgttgagataaggttacttcaattagatacaaaattggctaataatgtcctataggcaataaatctgtaactgagccatcatttctgttggctggaaccactaacatctctatcagaaaaaaaatcttttgtaatttattagtcttctgtaagctgacatttatctgcggagaacctcagttctattcaatgataaaagaaaaatatgcatttctctagaaaatcagtgttttgtaaacaagtttgttagataattcttcagtatgataaggcacttagtaatctttttaccataatttcagttttggataatttatcttactaaactctgtgtatattccacataaaatccaataaaagtaccaattatactggttaggtacagaatttttcagtctgatagagagctgcaagacaagcccaatttctttcttgaaaactgaaacatagtgaagaagaatatttacctaactccttgtcctataatacccactctatgactctgtcatggcatgtgccctaaataaacactgtccatgtctgttatttgatttgcgtgagagaaatgtatcagattttaacccatattgcataaattactagggtcttaactggatgactggtttggatggggaaagggataagagaggaagaaagaatgaataggtgaaaatcttctcactctaatgctttattcagataaagttatttagttttgatagacaaactgaaattgtattcacattttttaaaagagagttttattcaaaaactgtttttggaaacccttaaacttctaaattaaaagtcatatgcaattgcaacaatttgaaaaactggctgcatgagccagttaaacaaatagtaaagtatttggataaccaggcactaaggagattaaataaagagccgctatgttctaaatgttgataagccaaagacaggatagtgtgtatgaacctgctagttcccttgaccaacaggcatctccttctaaaaaggagtttgagaccttatcttgagaataacaattaagggcagaatcagaactaatacctcagtgacaatttgtacaattaccagtgaagattagctgcccaagatgatctagatctccatactacaaatctcttttcagtgagtaatatcaaaattatctctgtgtaagaatgcgtgataagaatcaggacccaaagagttaaaaaatatagtttatggaaatcattatttgttgttttagtaatccctacattttctaagtagtactgagagtttgttgtccaattggaaattcacatttaaaactcttaatctcaaaaaatatatcactaaggaagtaattatcttctctcaagtgcagccagtttagctgagtgtcaaacagcatttctacatattatttttctctggtgtggtgctgtctccttgggcttgtcttataagttgtttcacgctttaacactcaataaatgcatgatagttgaccgaatgttaacttatgatatacgacatttttctctagatgtctcccaagttgggagtactaccaaaataattccccaaaaaagcaaaaataaacaaacacaaagtaaattcaaacaaaaaaaggccctgcatcagtatccatataaccttcctagaagggcttcctttataggttaaattttaattgtgtttggtgttgtgggtagagctgtcagtattggaatattcatcaggatcttgatattaaggacttattatttattactttattttatgctcaatgacccttctgcctattgcatgtaaggcagaaatctaggtagaaggaatgcaggtgaataaagatggttagtccctagtcaacatggttcaaacataatatgagaataaaacaagtgtgtgaatctttacagtacaaagcagaaagtactttgtgtaataatgatgtttcagagcaggaagaactcacaactaattagttctaatcaaaattggggtataaaagagatagttgctgatagaggtcatcaatgatacatagaatttagctagaaaaaaaataagtggacagaaatgtcctggctatagcaggtagcgtgagaaaatgaagaatataaaacaggattaagacaatggagtagtatagatatagtatggtatggtatggtatggtatagtacagtacagaatagatatagtatagtatagtacagtatattagtatagtatagctatagtgtagtatagatgaaatacataatgtttgtaggtgattgtagttgattgggaaaaatagattttgcacatatcatagatgatcccaaatcctaggatgagctattacacttgatgcaatcatcaccaacataccagtgaaggcttctatttatataagctgtttaaaaatatttaatagaatctatttttgaatatctttctgttgttctatagactttattgaactagtgtggaactggattttgaatgcctaattaggatgaatttcataacacaatagaaaggctacagggttaaagggtctagtctggaatgatagatgcgcacaaattatgtcttgaccttgattgttagttgtcttattgaaacactgtacagctcacaaaaccactgggccccatatctccttgttatatggagttctcctttatttgagttgatccacttaatgctgtcatctggaggaaaataccagactgccacactgtgctgcattcttagtgcatttgttgttattcatatacactccgtaaggcccagtttgataggaaatttagaccaatgaaataacacagctcacctcctgactcctataatgacccaggaatattgtgtcatcaacaacaggttttctaaataatattgcctttaaaaatactttttaaaatatatcaggggcttggaagtttgaacatagtttcagaagtcaattgaatatttccttcatcccagcataaatccaggaaaacagagaaaggcatggagtgggatacacatagtcagagaacactaaggttgggcaacaaagaaagaatgtagtttcatgttcttagaaatattattattaagatgcatttcttgttaccatttttcagtattttgtgattaaaataaatgaggcaacccagtacccgaggttttggatgcatgcttttgataaaaatcctgaaacgagtacatgattacataaggaatcacgcaagttcaatgagcatccaaaagtcccagaacgagcttgtccagcccagggtacgcaggctgcatgcagcccaggatggtttagaatgtggcccaacaccaatttgtaaactttattaaaaccttatgattttttttggcaattcttttttagctcatcagctatcattagtgtgtgtattttatgtatggcccaagacaattcttctttcaatgggcccagggaagccaaaagattggatgcctctattctagaagctgattcactctcagcatcccacatactcccttgttttttattacatattctatagacatcattatttcataggtccaattaaaatgctcagggcttttgttttgttttttagccagttctttgtatgatatatttctcagactaccactatcctgatcagtgtaaaagataagactattattccccttagcatgaatattttgtttctaataatttgctctaaggtcaaaatagtgttgtcatgtgtctcacttcactcacttttctcacagttataaaacaacctcaaggtttctccaaatcaagctgttcttacaacaattttcttcctcctcctactggtttaattcactttggaacttcaagatatttacacaaatattcaacaaacttaatcttattatgttttacctccttgtggtttttgttatttccaaatgttgcctcagtcatgtaacaccttgtttttctcctaagcttttaaccccttgaacatttgataacaatttcttatttgcattcatcaaacataaatcaatttttgacccatagagggttaaagatagaacactccaatcatgaaggacactcatgtacttgacatttatgtatttataaatatattttaggtatggctatgcaaccctattttctcttattttttattttttgtcatgaaaatatttttcaagtttttcttatttttatatatatgaaatattctatactcttttggccactttagctgtcctgtagaccctatctagaccttccggagttttgctatttctttgttgcagattgttgaccagaattacaaacagtatctcatagaaacactgatttctacaaagtgagataaagcttcccattttatttctttggtctgatttcattgtaagagttcagtgagtcattgcctgccaggagtcatctacagtgagtcctagatcagtccacagctgtgacgagttcactattccagaaatacaagtttgaagaacttcctacccaaccctcccttagaaaattacccaaaattgatcatgtaaagcccactttctgcttctccatattcatttttatggcaaagtttccccactggcctggattttcactatgcagaagtgttcagggttatctacaaacataatacctaaattgtatatatttataacacatatatatgtactctatatacacatatattgtactatatatgtgtttatgtactatacatatacgcacacatgtatatgtactatatatacacatacacaaacacatggtttttttttttttattactaacctaaatataaaataagatctctggagaaaattttgttaatgtgtttccatcatgaaaacacacaataaacttgtttattgttctatctataacaaaatatttaaactacttttatcccaattcgaatatcattcttgtggaatttgccaaagtatttttttccttcaaattggaaaacaaacatgggactcttcttgggagatatttatattcttaatcaaagaacttcattatattcatcaaacaccacagcgctggtcacttacatctgtctaatgaattatatttggtgttcattgactctattctttttaatagaggtcatggtttgttatctatggaaccgagaatcattaatcatgacttggaattaatttgaagagatgatttttaaaaacttgtcataggcctgccttttgcagtacagggttcagggttccttgcttcatgataaacatttgcataaaagattgaagcttttagaaccttatcgtgttgttcaaatttagggatattaaaagaggaagaagcctgagatgaacacgggcacggcaactgatagcttcatccactgaagagggattttccagttgcatgcttgtttctctccctacatgtgctaacatttgtttagaaattttatattatgttgagactaaaaaaaatcaactctgaggtataaattttgatagtgcaaggacccatttatcatgcttgacatataatcttttaaattaaatttttattgtgcaatgattacagtttcacctttctttgtaagaagactttagagagatgccgtgtatcctttttatccagtctcctccaatggcatcttgtaacactagagtcaccaccagtatattcactttgatgctttaagaatacaaaatacttccatcaccacaaggacctctcctgttgtcattttgtagcctcacatacttccacttgtattcctcctcaacccctagcaaccactaatttcttggcatcatgaaccagagaatttattcatcactaaatctgttctgccaggatctgccactcttcagccaaaactcctagttactcctgatgacttctaggcatctgccctccttgggcatcaagtttactgccagttgccttctgagtcacctgcagtcaccactggagatgtaattgagtcctcatgtgccaaacttatttggttttcaccttaaaattattttttaaaagactattattcccacattttccctctacacttggtttactaatttgcatgtgtagtttatagggccaagctggcaataagttactgttatactcctctctttatttcccgaatctcctattcatgttccagtttaaactcagctgggaacaccttgtctcattcagaacttaatcacagtctttagatatagtcttttttgttttctttatatgcttattattaacatgtagtatccagtatctaatccagtaacagtcacaaattggcccatcagtggcaagaaatttaaaaaatggacactatagtgaggactaaattcaaaaatgacagccaaactggattttctcaagcacattctgctaatttgtattacgtttaaagagaaaaaattacttttgggtaattgaacatctatatcgcaattgcaatggtggttacacgaatctatgcaactggtaaaacctgtttataacaaaaaaaaagtacataaaaactagttaaatcagaataaaatctgtagtttagttaattttattgtgacaatgccaattttctggctttcatgattgtaccgtatcgtgtagaatgttattattggaggaaacgggggaaggttacataggaactcaactgtattagtccattcttacattgttgtaaagaaatattgagactgggtaaattataaagaaaagaggcttaattggctcatagttccacaggcaggtgaaactgtaatcattgcacaataaaaatttaatttaaaagattatatgtcaagcatgatgaatgggtccttgcactatcaaaatttatacctcagagttgatttttttggtctcaaaatgatataaaatttctaaactaatgttaacacatgtagggagagaaacaagcatgcaattggaaactccctcctcagtggatgaagaggaatcatggtgctagcatctgctcagtttctggagaggcttcgggaaactgtcaatcatggcggaaggtgaaggggaagcaggtgcttctgatgattggactaacaggaagagagtaagggggaggtgccccacactttaaacaatcacatcacgtgagaactcactatcgcgaccaaggaggatcttgctaaaccattagaaagcacccatatgtggctgggcgccgtggctcaagcctgtaattctagcactttgggaggctgaggcaagtggatcacttgaggtcaggagttcagggccagcctgacttacatggtgaaaccccatctctactaaaaataccaaaaaattagccgggtgtggtggcacgcccctgtaatctcagctactccagaggctgagacaagagaatcgcttgaacccgggaagcggatgtttcagtaagccggaatcatgccactgcactccagccctggaaacagagtcagactctgtaagaaaagaaaggaaaggataggagaggggaggggtggggggcagggagaagaaaggggggaggggaggggaggggaagggagggggataggagaggggaggggaggaaggggagggggaagaagggggaggggaagggggaggggagggggaggggaggggaggggaggagggggaggggaggagggggagggggaggggacgggaggggaggggagggggacggggagaagaaagtggggaggggagggcaagggcaaagaaacctcccatatcatccaatcacctcccactaggtcccacctccaacgctgggaattacaattccatatgagatttgggcagggatacatatccaaactgtatcatcaactatttttgcaactactatgtgagtctaaaattatttcaaattaaaaaataaaggcaaaacccatcaaacttacagattattatgtgatttaaagttcctatctctctcattctgtatgtgtgtgtatacattacacgtatatatctcagatagctaaatgcatgtgcttgtttgacatacaggtgtgttgctgttgttttttttttttttaaatttttatatattttttaatttgttgagatcacccaaggtgaaatgcagtgacacgatctggactcactgcaacctccgcctcctgggctcaagcaattctcatgcctcagcctcctgagtagctgggatcacaggtgtgtgctaccacgcctggctaatttttgcctttttagtagagacagggtttcaccatgttggccaggacggtctggaatgcctgacctcaagtgatccacctgcctcagcatcccaaagtgctgggtgccaccgtgcccagcctgacatcgtttttatggatttcaaaatataaatgtatttacattgtttgaaagttcatagtgtatataaaattgaagataggatcctgagatacgtatgaaagcattataatgcacaggtgtttgtgtgaaacatagattgtatctgaggagaaagaaatgacagtagaatactaatatcaaaaatatataaataagatgataggatcccaaagtataattttgtttgctttttagactaacaaaatattaccacatctaaataaatgaaaaacatgaatgacatatgctttttccatcgatttaatttttgttaacaaatataaaatgttttagaattttacttatagaattcaaaaatgtttccttcatatttataataatacttaaatatggaaatgaatacatcatctcaaataacactgagttcattcttggaatgtctttttttttttctgttagagattttctttcattttctttttatttttccccaggatgctatcatgcctacgtttctcctggttagtttcacaggatattttccaaagagaacttgaataaaacagacttgattaccactgttttattctcaaaataagctaatggctattaagacttgttccttgatttgagggggctttttggtatacttattcaaaaaggcagattcaaaataagctctctacttctttattcctcagaatctctgtttgtatgtaattggctaacaaaacccattgcttattagctttgtctcagtgctaaaaaaaaaaaaaaaagtccttaaaattattgcaaacctgcatctgtcacacctgattactccaggaggaaaaacaaaacaaaacagaacagaaaaaaaaaaaaacaaaaaaaagaaaaaaaaaaacttgctttggataacattttatgacaatagctttgcatcaggggacttacttatcttcaatgtgtgctctattcctcatgtcactctttcttccccttaattgaggaaaatgtgttcagaagttaaagttgtggccatctatttaaagttttatattattcagcttagaaaacaaataaaattttcatacgtacaagggaatatagcatcactcaagtaatgcccatcacattgcacaagaagtggataatctttcattacaaaagaaaagatggaaactgcatagatcttctgtaaatcagaagctgtataaccagctacttaactcaaattctaaaagccacctaatgtttgtatgtggatgacaccaatataacaaacatattgcttcaattaagtcaattatgttaatttgttgaaaagaatctgttaactgaatcattcagtatcccttaaacaaaacatagggtgataattttgcaaattattatttcaacttattgagttggcaacgtatgaacaaaaggcaacctgcatctatgttttaggataagtaattaggttctcacagactgagattttcatttaaaaagatttcccttttggacagtttataaagtgaattggaagagagactggaagcagggagagcattctaagagctctcaggggagaaggagggtttggccaaatacagtggccagactcgtgaaaagccgttactggagaggcaggacctccagcacctgggacattgtgaatgtgagtgaggaagaacaagagccatggacatgacagagattctggctggagaactaggaggatggcagcatcagcaaatggtgtgggtggaaaatagaaaataaacacagttttgatgataaaaaggcattttgttaacatcttgtagccattcaaataaagatgtttaatagaaagttggaaattcaggcctagatctcaaaatccaacttagggctggagatgtggatatgggaatcagtctccaatatttagatgggaatgagacctcgtagaaggaggttgagttgaaaaagtcagccgttcttgtccaagaatacaaatgggatcacagtctcatggagaagaaggcattacaagaataccaactgcaccaaaaaggttccttagggttaaaactaataaagaaggcttagatttcactttattagtgcagaagactaattgtagcacagtagaagagagatggaaatgagcttctatccttgaaagtttggatatgaaattgtctcttcaagaagtttgggaggtcaatacaaaataatgcaatattgtaactgaagaagtgagttggaaaggtgagttagttaaaagacatttggtggagtttgttttctttattttttctctgaaatcaagactttaggcttgtttcattaaaagagttgaggccgagagagatgttaaggaatacaggggcaccgtagaggtatagctaatggaacaagggagaatagagttagatgagaagatgggattaaacagcccgagtaggatttgtcccctgttagactgtagaagaaggccagttgggtagtagactgtggctagaccacactttattaatccgtttgtcagtaaatacacatttgagatatttctagattagactgattatgcataaagctaccaggctctcaggaggtcagaaaataaatctaggtagtgaaggaaacagataataacaaaataacaggaataagcaaaatattcctgttgaacttacatttgaagacaaaaaagcagatgatgtcacttgtgagaaagtagcgagaacagcatgacctttaataatccatagaagaagaagaaaaatccaatgaagataaaggagaagcaatcacagatcaaatagacatatgcaaaataagatatgttcttttttttttttttttttttttgagacggagtctcgctctgtcgcccaggctggagggcagtggtgcgatctcggctcactgcaagctccgcctctcgggttcacgccattctcccgtctcagcctcgcgagtagctgggaccacaggcacccgccaccacgcccagctaattttttgtatttttagtagagacgggatttcaccatgttagccaggatggtctccatctcctgacctcatgatccacccgcctcggcctcccaaagtgctggaattacaggcgtgagccactgcgccgggcctaagatacattcttgagtgagaaagattccaggagaagatgactaagggagatattcaagaagaattttaaaaaagattatttcattatcatcagttacctcattatcatcagtgatttttctgatttgatttgaaagaagaaacagcaacgaacaaattgctaaagtttaagagagcatggaagaggagggaaaaactgagcaaacaccatctattagagaagttttgcagtgaaagggaatagaaaaccagacagtacaaatggagaaacataatgtaaaaagggttttttttttttcttcccaggaaagatgaaatccaaatatattggaaaaaatggcttctgtagacccaagaattgtcacttattttagctcttctatattttgaagaaacattacctggtattaatcatccaatagataataaaaatggaagcatatgaaattgaggaagagtaaaattgttaatgctcaaatcagacattacatttagtattagaattattaatatttcatggcataaatttatccaactaaagaatttcacattttgaaaaagataaaattgaaagatggtaatttaccttgctatcacaaataattctcacattaactaaaacttgataattttgttgattgtatgcttataaaaagctcttggttccacattcagaaaaatattttatcccaagtactttccaaagagtatatcatcatatttgctgccattaatacttaacaaatacctgcgaaaagcaatggttttggagggtaacctgagggcagtataatctatctgttcttctagatactgtaaacaatttctagagtaagcttgtcagtagggagctgaatatctatctgcatcaaaagtgttggttactgctataaatttgtgtttactgagctgaggtttggcatttttccatggggctacattgaggaaaactgtaatgtatttcctatgaaatttgttgctgtttttatatggattttcttgaacacttcattctttatgtagcatagtttcttttatgtgaggatttgggaagtttctttctgggctcagtaccttgagtattatgcttctgcaagcaactggttagattttatttaagatgagccttgaaactaattctgtctgcatttatgtgatatgccagaaattttaaagccaaatttttagacaccctcctatgcaacaattgtttttggtttttcatatttttatcaagctagtacatagataagtatttttaatcaatttgtagagaaataagttcatttaacggtaaagttctttttccccaatatcttcttatttcctgttccactctccctttatacttttatatcaatttgttcgcttataaatgtagaatttgcctattggttaatgacttcttgggtcaattactagttagctgacttacttttccacacatctgactacttttagaagttatattaaggccaggcatgatgattcatgtctgtaatcctagcactttaagaggccaaggtgggaggattgcttgagcccaggggtttgaggctgcagtgagctgtgattacaccactgcacttcagcctgggctacagcgcaagaccctgcctcaaaaaatatatataatagatatttttaattctctattggttaattttattacatttaataatatacttacaaataggtctactcttctgtcaaattttggtaatataatttgactcttcacttggaagatgagtatattatttaccacattatttcttctacattttcgtatccatttctacctccaaacctctgcttcttaggttgtattttaacattgccaagattgataatgttagatttgtatttctgtttgtctaaatatttatttaacatatcacaaaatggatagcatttatctaattattttcatcctttcttatggcttgacatgaaggataaagaaaaaattataggaggtttggaaagaaaaataatatatttgagtaaaatttaaaatagatttctgatgctatattagattatcatctgaaaaaatttatttgtcaatatcttagaaattcaaatatgcatccattatataatccagaaattcttctcctaggcatttgtaacaaatgctcacagcaattttatttgtaatagtaaaaaaacctggaaacatcccagtatctatcaatacaaaaatgggtacaggttatagtaaacttagacaatgaaatagtacacagaaaaatagaaatgtgctactgataataacgatatgagggaatcttaacaaaattgttctgagtgaaagaagccagtgatgtttgattactttattatgaagttcaagaaaagtcacaattggctgggtgcagaggcccatgcctgtaatcccagcactttgggaggccaagctgggcagatcacttgaggtcaggagttccagaccagcctgggcaatgtggtgaaacctcatctctactaaaaatacaaaaattagccgggcgtggtggcctgtgcctgtagtcccagctactcaggaggctgaggtggaagaatcacttgaacctgggagatggaggtttctgtgagttgagaccatgccactgcattccagcccggacaacagaaaaagactctgtcaaaacaaaaggcaaaattaactatggttatagaaatcagaaaagtgtatacacacggtgaggagtggcattaattgaaaagaatattgactgaggggattgatgagactaatttctgggataataaaatgttctatatcttgatagggagtgagggtcacgtgagtgatcacatttctcaaaactaatcaaactattcactggttttcagtttactgtattaaaaattattatcattctttttaaaaaaatgacgtattgctccctgaacagtctgcagtttcactgagagatcaaatagtaaacattataattttactattcattataaaatgtattatgatataggtaagcacagaatttcagaatgagcatcaagtaaccccactatgcatttatcaaatctgtttcactttccttctgtggcacatattccagtctcttggacactaaggttaagatcaatatgatacatgaccaatggaatgtatgcagaagtgatattttcttcatcaaatctggccataaatcctaagttcattcctatatgtttgtcttctgtttctgtggtggacttgagaatcagatgttgatgacaaaaaccaaatgaagtgagcccggatccctgaatgactatgtggaacagtgctcctctgtccttttctttctatactgaaatgtgatgtgggcaaaaatcaatcatgtattatagtaaaacgctggaaagaaggaaacaagaaaggaggggaggaaggaaataaagaagaaaagaaagatggaaggaaggaaagaaagagagaaaaaaaggagagagaaaaaggaaggaagttggagagaaggaagaagagggagtcagagagtaagaaaagaattgatggttcttctgccagtgacttagactggagataaataaactatgggaggcaataaagccattaaaaagacagtccacttgttgagtaggctgagaacaaatgatcacaaagaaggaaacctattgaataccatcatcatgtgatgcccctaaagaataaagagaaggaatcaagaatcagatttttaagattttactttattaattttcaaagtcaaattattgcttgcaaaataatgctgttcttaatgcttctagtacgattattctaaaatgctttcacaacattgacaacattaagaagacaagatgtatttatttgggtaaagagcagtagggtctagagaggatattgctgcatatatatatatgtatatatatatatatatatatatatatatatatatatatatatggaatatgttggcatgtctcacaatgtttgacatgattttgcaataaaaaagagtgtatttttagcatagttcaagtgaattacccaagtgaacaagctaaatttgattggggtggggggttaatttttacatctctcctggcagttctctcaagatttttccatgattgttttctttttatcccatgatctctgacatctagccacattacataattataacgacatccccctacaactaggaaacccttacacattaccctggtgtctttttgagtcagtctagcatgctctattttttttcctgtaagatattatcaaatatatggtttttaactaccaatggtaatagaactggtttttgtacatccagaaataacaagacctatgaaatgtagatagatgggaatttggaaatgcacatttatattcatttacttaagcacatttattgaccactgaacactgtggtcatcagatacacagggaccaaagaggtatggtctgaaacctcacagctgacttacatacttctgaatcagttagggagttaatcaaaaacataatgaagtaatcacaattgagtgaagaggggaaaaaaaaaaaaaaaacacaggatgctcttgatacaggcaaactcccaaattggggcttagccaggagagttattggcttcatacaggaaagaactcaagagtacaccaacagaataaagtgcaagcaaagcaagtttattagagtaacagagtagggaaaaacggctgctccatagacagagcaggacatatgcagagtagcacttgtagattgctggctagctatatttatagctactccttaattatatgctaaataagggccaggtaattcatgaattttctagaaaaggagtggggacttcctggaaccaaggattcctctctttttataccatgtaaggtaatttccgggcattgccatgccatctgtaaactgtcttggtgctggcaggagtgccttttagcaagctaatgaaatataatttgtggataacaaacaatgaggacaactagaggttgctttctttgccgtcttcgttttagcttgtttattttctgcatttgaaacaggagttttcccttttcctcttcacagggcaagtgataggggtgtggctcacttcttcagtgctcccctgctcaaacccatagggagagcgtgcagatgggcatgtcatggagctcaaaccccatggcggtgtctagggtttagtgtttacagctcctgaagccctagtgggtgtgtgttaccttgtgctctcttagttttgccatctgcaggtggcttgtgttaatcggttcaattagaccccctgccttactgcaaggacagagagctttctgtaccctgggttcttgccttggtgtatcagaaaaatcggatcacatgtggtcttcaagaatgggtgtaaggttttactgaatggaggcgggtctcagcgaggtggatggggaggtcagaagggggatggagtgggaagctggtcctcccctggagctgggccacccagctgccagactctcctccagcgtcccttggctgaatccggtgtgcttttccactcctctgctcctctcgatgtccagacacttgtggctgtgtccactagggtctcagggtttttgtaggcacaggatgaagggtgtggagggccagagtggtcttagaaaatgcaacatttgagcgcaaaaacagaaatgcctgtctgcacttagttccgtgggcacaggccccagggtggagccccaccaggaccctgcccttctctatccagcacttctctgccctcctcccatatcgcattctgttttgaccagatcctgctttaatcagtagagtcctgactggtgctcagaaaaaaagtcctgctgatctcctactatgaggcaccctatggaacgaggggattgaggggtggcgaggcaaggtccctcctgtcaggaagtgctgtctgagctgagtcctacaagatgtggaaggccagccagatgaaactaatgagcagagactccaggggaagaggccagattggaagggtaacaggtgcagtattttatgaaggtccttcttatcttcctgcctcagcagggaatatagctagtcctggaaactcacatcaaggccgcaaaatggaaaatctatttctacattttgacataagttgttagcatggggaaaataaaatctaaaatctggcaagaaataaaatttcaattaaagggaagtgattgtaatgatcacaggtttagtatattaacataaagaatagtcaatatgtgtttcaatgccacagagtcattttatgttttaagcaagtaagatctctcactttagggaacattcacgtcattctcacataagttcccacctatgagacctgttgtcagtagcgaaaagctcttcctagatttagttacacaatagctaattgttttaggcacttttttttagtcttaagtaaaacctttacatgaagatacagagtctcattcattcgctataggagcttgtgatcttttatgttaggtctcctaaaaagtgaggatttagttaggaataaatatacttattctcatcataaaataatttgtgttacacttcaaaccccataatagtaaatttgagaaaaaaaaaatgttagttcatgcatcatacatagcatacttctagtactttatatagtctcctccagtttgataaattatattttccaagtgattacaaaatacttttccaaagtttactggttcttaactgtcaactggctggaaagtcttagacttgtgcatcctgtctaacttgcaagaaagatttaatttcaaagactcttagtccatgggctggcaaactgtagcccatgggacaaatcttgtccacgcctgttcttttaaagtttgtgagctatgaataatttttacatttcacaagtgtattttttaaaaaaaggaagaataataatatgggacagaggagcatgtgacctgcaaagcctaaaatatttactgtctggtactttgcagaaatgctttgcttcactacctcttagaccatctgaaatattgttttagctagaaaaaacagtgcacctagtggaaaattttcagttattaaaacttcagggatgtttattctaaaattaacattgtggatgacttacaatatgttaaaaaagttctaaattttggtatgtatttgtacaatttataagacaagaactctaaaagtagaaccataggtttaacattttattatattgattttaactttccttaacatcaagctttgtgagatacatatatgctatcttaattataataataaaccctattctaagcatatatacaaatcactgcctctaagagagatttaatagccagaacatgaaattcacaagttgttgtaaatggattttttattctttcaatgataaatttggctggcattttttatgtatctgcaaagcacttgtatactatttgtctaaatgaaggtttgattataaagagtattgttctatgcaagaaagattcaactttgctttaagtttttaatttttgatgcaggtttccaaatcttaaagattgtataaaaactcagctgtgtatctttttttccttttcacacctatatgaaaaactgtaaatgagtttttaaaagagccaagtgatatgaaaaaatgctccttttcaagacctatgatagtttattctttactttagtatttactaaataagatgccccctagctgacaaattcttctttccttttaggaaacagtgtcattcaaacttttaaattacttgtattaaaactgcagaggactttgggtgctgataatcacaaaagaagcttgatttaggtaaatgtgtgagaaaacataatattattgattttgtaaaaatttgtagaaataaaaaataaggagagaagtaaaatatgaacactatattagatgtactatctaataaatagaccagatatcaaatgtgtatctaaaaagtgatatgataaaaagcatccatcagactttaaatttgatattcaaatatataacattaaatatcaaaaataaaatatattgtatataaatgggaagatatttatttctagttgacaatttgattctcaaatgaagagagtggaagaacttgttactttgtcccaagtttgtctttactaggtattcgacatccagttttgttttttttttcccttttttttttttttttttttattgagatggagtttcgctcttgttgtccaggccagagtgcagtggtgcgatcttggctcactgcaacctccacctcccaggttcaagtgattctcctgcctcagcctcctgagtagctgggattacaggtgcatgccaccatgcctggctaattttttgtatttttggcagagacggggtttcaccatgttggccaacttctctgagtctgtttcctgatttgaaaaaatagcatccctgacaattttagagttttctttgaggcacaaacaatacagactatactagaaccgtttaaataatagatatatacatgttagacgttgtttttattaaatcaacggctacatctccttttatgtttcctaccttatcaaatactgatatttatggagacatttcacatatatttacagctttgtaatcaagacaatcaatggttcacgcctatggtattcttttgaaatatttaaagcttcagttaggaaaatgtcttaaatctcaatatgcttggatgaaagaagtggaaaaatcacaatctattggcacacacctatagtcctagctactcaggaggctaaggtgggaggatcgtttgatcacaggaattcaagggttacagttagctatgactgtgccactgtactctagcctgggtgatagagccagaccctgtctctaaaaataaaatataacaataaaaataacaacagaagcacaaactattgattttgagaatcctgaagaaaatatatagcatgcatttttccataagtaaagcaaaggcaaaccttaggtaaagcactattattctaaacctcaaatgtccaataacatcttttaattttgctggtgaaatctcaaatgcagtatatctaaatcttcactaattatctttcccttcaaatattgttgtattagtcaatgttatttcagttgctcagaaacaaacaaataaggaaacagatcaaataatccaaaacaccttagcaagctctggatttagatttctcaaatgatgtcatcgcagatgtgcttactttgtctttctctgacttccactcctttgtaatatcaaaatggccaacagaagctcagtgggaagagcacctccattcctgcagttttgtttgttttcttttcactcagcgtgcattggagatcccaaggtgtggtagctgtcctgctgttcttccacaccaatgttccaaacctctcctccctgaacaacctctgaagcacttgtggccatattatttcatctatcattttgtattttacattatgcaatggtcttctactatcttcttgggaatttctctttactcagagagggggattttagtgctttcattgttaaaaattataagatgtataactttcttgcttaaaactctctagtagatttcccttccagcacacataaatgaaatctagagcgtgatcataatgtacaggccctcctcattctgtccttgacctctccatcttctcccctgttcattccttcttcacactcttccaacaatactgacttccttgctacccccacaaacaggcacagtatgctcatgccatttgcctttctggcctttgcataaacgatatatgtaattgtataattataggatttacatataaaaacatatataacaatatgtacatattacatataacatagtgtcagtattgtatgtgtaggtatacatatatgtgtatgtgtgtatgtgtatatatatagacacatattcaggttcaggagtacatgtgaaggtttgttacacaggtaaacactcatgtgacaggggtttgttgtacagattatttcatcacccaggtattaagcccagtacccaatagttatcctttctgctcctctccctccttccaccctccactctccaggagaccccagtgtctgctgtttccttctttgtgtttattagttctcatcatttagctcccacttacaaatgagaacatgtggtatttggttttctgttcctgcatttgtttgctaagtataatagactccagctccatctcattcttttttattgctgcataattttccatggtgtatatgtagcacattttcttcatccaatctgggttgattctatgcctttgctattgtgaatagtgccagagtgaacatttgcatgcatgtgtctttgtggtagaatgatttatattcctctgagtatattccccataatgggattgctgggtcaaatggtagtttttcttttagctctttgaggaatcatcatactgctttccacaatggttaaactaatttccatgctcaccaacagtgtataagtatttccttttctccaaaacctaaatgtaaaacccaaaattataaaaactctggaagacaacctaggcaataccatcctggacataggaatgggcaaagatttcatgccaaagacatgaaaagcaatcataacaaagcaaatattgacaaatgggatctaattaaacctaagagcttctgcacagcaaaagaagctgtcaacagagtataacagacaatctatagaatgggaaaaatatttgcaaactttgcacctgacaaaggtctaatatccagcatcgataaggaacttaaacaaatttacaagagtaaaacaaccctgctaaaaagtgggaaaaggatatgaacagacacttttcaaaagtggccaacaagcctatgaaaaaaagctcactatgtagtttaataatataaatgccatgaaaactgcaactctgtctacattgttgatttgaacaatatctgctacatagaagactctcaaatatctcctgagtgaatgaaaggtgaatgaataaatacgtaagtaaatgtatgaatgaagcattttagcagaagggctaaaactgagtctcattgagttaggtgcccacccctggtggtagggagtagtgtctgcctctctagcatcatatggattaagagtgaatttttttttttttttttttttttttttgagacagagtctggctctgtcacccaggctggagtacagtggcgtgatttcaactccctgaaacccctgcctcctgggttcaagtgattctcctgcctcagccttccaagtagctgggattacaggcgtgcatgaccacacctggctgatttttgtatttttagtagagatagggtatcagcatgttggccagactggtcttgaactcctgacctcaagcgatcagcccaccttggtctcccaaagtgctgtgattacaggtgtgagccactgcgcctggggaagagtagaatattaagagtgaactttttaaagaaaagccagatgctattactcaaagggaagaggttgctgagcagtcgagcaataaatgttcatcatatctttccctctcttcccttttctgtcaccaatgcctgcacactaatatcttggaataggttgattatatcttctactcccttctttcaagatgttaataattcttcttttgaaatatcaaatctgtcttttatttatttattgcccctaccaccacattggtgttgaccttcaattacttgttgctaatcttcttgctcccagtatgatttcccattaccctggatctcattaatatggcttttattgttatttcttaacaacaagaacaacaacaacaatacatgctatattattttgtctctaatcagacagaacctgttaaaagatttatgatttttttcaacataactactttctgccagtcagacttgtgtctttattcctattccttgtgtattcctgaacacccttggttcatgtttcccgagaatctacaatcttagttcaaaaattcattttaccaataagcgcatcaaatctttttgtgagagacatacaggggaaaggaaaagtattttttttaagtcctagagaggctacccatacaaagcaaaatttcagcataactatccctggactctgggtcttataccctaggtctgaaatcctcctttatgccaacctattcttcaatatatcctagcccctttctctcttgtctttcaaacaccactctgtccttctatgcagctgagctctaactctgtagaatttgcctgattacatagccttcagggaactccaaatatcggtaaaattactagttacgtaatgcacttccatagttccttttaatgctgccttttgcaatatctttttagattttattttaggcctcataagactgcagatgtcttagagacagtgtttcaggagagatttttgttgtttttctaaatattgacataaaacctagcaacatgctaagcatatagttaattttcaagttgaaattgtttggtggcttttgttgagtattatttaagatcataaattttggattaacccatatccaattgtagatttaattcaagtgattttggtcaaggattctaattgttcttgcatttgaagccagagaacccaatagagatctgaaaatatagccatggtttaatggaatgcttgtttagatttttagattctttgtaaaactaacagctggctagaaaagtacctacaaagaaaatgtctttttagaaattgtttttctgatgaaattttgtcaacaagatgcaatgaggatgctctattaagtgttaaaattcaagacatactgctcaaatagttttgttttatggattacagaagtgtatggctatttttaaaaggcagtggtagtacgcagctcatttgagaaaaccaagaagagcacagcaggaatcgtcacagaagaacatcccaatttttaaaacatgtaattgtccatgttatagactaaatattatccattatgtggattgctggtaccatctaaaggttacataaaattgtttcaatgcggaggaaatctttcagtatacttctcataattactaggccttacattacacattttgtatttcggagcgcaggaatttgaccggggaatgcgggttggataacagatctactacaaacttgcatttgtgttgcttggatgaacttaagccagtgctttcaattccgaagctactctgtatttttttttaattaaaaacatctctcgctctttactttgtatgagtagtctaactttaaaacatcattattaaagataatttttttaaaagacaaaactcctggttttagatagaagcaaattcagtccttaggcaaagaagacaacatactaacaatgtaatataatgcctgtgttgcatcttttcatgatttaaaaaataatttttaaaatttctatttgtatgattttaagataatttaaatctgaaagttaatatcttctaaaagataaggctaaaacctcaagttatctattatagggacatttagaatgcatatttgtatgattttaagataatttaaataaatcgaaaagagaatatcttctaaaagataatgctaaagcctcaacttgtctattatagggacatttagaatgcatatatgaagctgaaactgctcatgtttaaaatagcacaagctttcatttatttgaattatatcttctaaaatataatagtttctttctttaaatcttccttgaattataactttatactgacattttctttttcattagatggtaattttttgagagtcgagtctatggtttcacacatccttgaatatcccatattatcttgctctaacttatgaaatagatagtttgtaaatccttgttgaatgatcgttatgtatgcctcccaaaaaatccatttgttctccgctgagaggaaaaaaataaaaaataaaattaaaaaaaaagacaatgtgaactttcagtatcagataaaaattcatggataattattcttttgacagaatcttctataatgaaaaaaactgaattaacatgtttctgatccattgaacaaattctctaaatgtgtctactccaataaaaggtagaaaaccctgacctcttcacaacgtgttcaattgttcttcttctctcactaatgttgaaatgttatctttaaatttctaatggttttatgggagaaaatgtggaggagaattttagagagcaagacatatggttagatgctataaaaatcatttattgtataaattaaatgcaaaatattagaactcatttcaatgtgtatggaacacaacagtggatgccatttagtctttcattcttttaacgtatgtttacatggatgaaaagacccacagaaaatctgacctgttttccacttaaaactggacctattttcacattaagagtaaggaagcagctttcttcaaattatttacggtgtaagaaatcacaagccctaccattggatgacatttgtgtttattctagtagacagaggacatgattgtttctaaagtatttttcccaatttttaaaatactatttccttttccaggcatttcccggaaacattaactctgacggtgtggtccggcacgaattacagcatccgattattgcccgctatgtgcgcatagtgcctctggattggaatggagaaggtcgcattggactcagaattgaagtttatggctgttcttactgtgagtatcgtattgtttaaatttgtggcaggttttatctttatttaaatagtaagctgttttattttaaattatttaacattacttgctttctctgacaataaactaccttctcatttacatatatatgtatctatgcatagatacatatatatataataaaaggttgtgtctctatttgcatgttataaatgtatattataaacacgtacagagactgacatgtcatatatcttaattatactttaggttgaagatttggaaaggttttttttgttcaatagactaaataataaagcttattaataaaattgccttgccttatgaaatatttaaaaaggggaaacctatattgttatctatgtatttgggtctttattatgggttttgaaaacatttcgaagaacttccttcgggttcactaagtatctctcttcagttatgcctattcctatactaaagccaatcactgggttttaaagtcaatgacgctttctctaccaaatttaatttattttttcaaattgatttggtcatctaaagaggttattttcccttaaatatattttaaagctcccttgttatttcttaaatacattatgcatatatctaaggattccaacatatgaatttgggggattataattcttctgtctattgttgctgctaatttttgcaaatggtacttgttttctcctactcctcttcctctctctttttcttcttatcttgtttgcctgtctgtcctttttatccttatccttatgcttatccatattctttactgtgacctcaatttctttaaaattttatctgtggaaatttgtttgggccaaggttgatggtgaattcttcttgagaggatatatctttgcttatttgcttctgtgaaggcgataccaacacagaactgctttcaagattatctccagttgtggttgttgtttctttatgagactgctagatagtataaatttaatctacgaacacgtgatttgcaaacattggcttcaaaatatgaattccctagtaaaatatactttcctcattcccggaaatttttcttccagctgttacaattccctgggggaacaaagatgctgggtatgaacaaggaggggatttggtttctctatgttatgcaaaaagtctcttattagcccgtttcctactcattcctataaacccacaaaaatgagttcacactaagcagaaaatttcaaatgcccccgttggacaagctttctaaaatgccctagacacttagtattttatataaaagaatatatgaagctttcacctctgtacacatttagtaacagaaattggtcaaaatattagctataatagtgcccgaatactgtcttattaattcataggcaatagtgttatgtgcaaactacaataaaggggtcatggaggtcatttaaaaattctcaaaaactgtttatttggttaccattttattgtagcagataaaattagtagagagacaaaagatttagctcttcaggagaatgtagctctttaaaaggaaaatttagcatttctggtaaggcccaaaaagaggtctaacataaattagaatctttggtcctatgtggtctagacattcatgaacagagtgtcatgttcacacatagtcttgctctcagcatagcatcatgacgggaaggccagaagaaaatgtgatatttttgtgaccatcacaaattttgttaagagccatgtttaacttttagtaaataaatacagacacacacacacatatatataggtatatatacacacacatatacatacacacacacacatatacgtgcatatatatatatataatccttcatggagactacgtgtatgtgcaatttattttattagcaattatttaatgagcacttttcatgtgtgataaatatattaaatggtagcattaccacagtagatgagaaagacatggtctttgtgagatgaagtgggacaaataatttaatagagttaataataataaaaatagtaaaagttaaaatttacccaaaagcacatagcctgagtgataggtctgaaagggaacccaggtagtctggtacagtgccaaagctcactatcaccgttctgtttttaatcccagcaaaataagcacccacctgaccgtccacagtttaatcaaaacatcatgtcaacaccccgcaaccactgagtaggccttctcccagttactgcaactccttaaacataaaaattcacctgatttgtatcaccaaagattagttcttgtttttcaaaaaaatttcacacagatggagtcataaaagatgcattattttacacttgacttctttagttacaaatcatatttctgagaattatctgtgctgatattagagatattagtttcttttcctcagtattattctatcttgtgaatattctacaatcatttgtttatttcatgctgatgaacgtttgagttgtttctagatgttggctatttatacagaattactaaaaatgtttccaatgggtatagacttgggggggtaataacaaactagcatatatgtgtgttcacctttggccaataacaacacaaatttttctaatttggttatatcaatttaaagtctccaatgcaattaactggagttcctgatgcttacaaattaagatatttagtattgtttaaaagtttaggccgggcgcggtggctcacacctgtaatcccagcactttgggaggccaaggagggcggatcacgaggtcaggagatcgagaccatcctggataacacggtgaaaccccgtctctactaaaaatacaaaacaaaattaactgggcattgtggcgggcgcctgtagtcccagctactcaggaggctgaagcaggagaatggcgtgaacccgggaggtggagcttgcagtgagccaagattgcaccactgtactccaacctgggcgacagagccagactccgtgtcaaaaaaaaaaaaaaaaaaagtgtagccattctggtgagtgtttgtcatgtctcattttagttaagttatgtttctttttttttttttttttttttgagacgtagtctcgatttgccacccaggctggagtgcagttgtgcaatcttggctcactgcatgctctgcctcccgggttcatgccattgtcctgcctcagcctcccgagtagctgggactacaggtgaccaccaccacgcccggctaatttttttttttttttttttgtatttttactagagatggggtttcaccatattagccaggatggtcttgatttgctgacctcatgatccgcccacctgggcttgtttctgatttttgaaagaggttatgcttattggtcatacgtataccttttttttaagtgttcaagaatcttgctcatatttctatggattcccatttatctatctatttatatatctatcatctatatagcaatcatctgtttgattgttttaagtagtttttgcaggcaactcttcttcattctcattacaattgctagacacgtatttatttttgaggtgacatttttttaacaataataattttaaagcaaacattgtcaatgaagttacttaagatccacaggtgtagacttaaactgtgaccacatgttctgtaattgttacaagtagatttataaagttgtgagtttgtgctgtcatgggcttttccatcaagcctgggctttgacaattacaagacaagaaggaaaaataactgaagcaaatcaggaagcgagacttttccactgtataagtccctttgggggaaaatcatatagctttgggaaactgtattaacatttatatcaatagatgccagtggagtaagtaacttagcaacacaaaatttaaaaagtagcatttcagttggatgtagtaggttgggtaatggcctatcataacataaagcctttattcttggaagttgtaagcatataagtatttgcagatgtgactaagttaacaatcatgacacggagagacaatttttttttttttttttttttttttgagatggagtctcgctctgttgctcaggctggagtgcagtggcgtgatctcggctcactgcaagctctgcctcccgggttcacgccattctcctggggagaggcaattttacattagccaggtgggccctaagtgcaatcacatgtgtcattgtaaaaggtagacagggagagatttcacagatgggaaagaaggagagaatgtgaacaccttggaaccagaggctgtagtgatatggcgataagccaaggaaggccagcagctcaaaaggcagatttttctctggagggaatgtgatcttgccaacacatcgatttcactcagtgatgctgctttggaacttctgacctccgaagttgtgaaagaacaaatttctgttattttaagccactaagtttgggataatctgttatagcaacaacatgaaactaatacaagagtcaatatattttagaaaagaaaagacaaaaatcggcctgagcaatgttctctgatagaactttctacaaagatgtagatgttgtcaatatgctctagccactaaccatatgtggctactagcatgtgaaatatagctaagacaactgtggaaccaaatttttaatttaatttaatttttaattcatttaaattcaaatttaaataatgtgactactggctaccatattagacagtgcagcttagaggaaccaaaacatcatgtatgtttttcatgtctttttataacataaaggacctataaaagttatgttttaagtgtcagtctctattgttttttcttagtttggaaaacaaaaatttaatcatcctgaaaactgtctttactgtcaataatgtaataaccagtcatcttactaaccacacagtcttagtctgttttgtgttactataacagaatatctgagactgggtaatctagaaagaacacaggtgtatttcttaccgttctggaggctggggagctcaaggtcaagggacctgcatctggcgaaggccttcttttcccattgtctcataacaggaaacagagccctcgtgacctactcatgtcttaaaagtcccacctctcaacactgttgcattggggattaagtttccaaaacatgaactttgaaggacgcattcataccacagcgtacaccaaatgtccagataagattctttttcatttattatttttgaagaatgaaaattacacttatctcttttccaagaaaaatatacatgtttacattttaaaatatatatatgttaaacatatttgttacgaaacactttccaaaagttacttccaaaaatttactggctaatgtaaattttctatactagagttcaaactagaatgagtccttagaagatgatactctgttcttgagcttagtgaactgttgtctcaagagctttctttggatttttcaatgagaaaaggaatcatataactttgagtggggaatgtagattagacacagccccccattttggcttcctagagaatagcagtgctgtgtactctagggtctcagcaaggagaaacatagttttgatcctgcccgtggaagagagatgaattctctaatctgtctggaaactcctgaaagggtgtacctgggatctatcttaaacctgcaagagagggaatggggcttctttcactgcaaagtttgccagaaaactagagagagagagagaaatcacaatgtgagcactgtttctgtttgactgtgtgtctggtgcaactccccttgtgtttgtcatctttcctttgtgcagttcctccatgatcactttgtcatctgagaaatgaggtacttctcaaggctgaaataagacgctgactctattccaggtggagaatttcgttccaggccactgctctgaagcctttagggcttctattgttcctacttcctgacttgtcttgaatataatatgaattccaatttcaataaatctaaactcatttgaaatcattctgcttcctctacgtttggttttccctcaagtttagttgaaacaagtgcatgcagttatttttaaaacttagcaatatgtcccatgccttttgattcagtgagctttctcccacagcgcagacactaatcttcttacgcgataccagtgggacttcataaagcaaaaggaagaggtctcagattaataatttcaaaaaatcatttatggctgcattactcaaacattcattttaaaaagccaaacacagtgcactgattaaagtactgagcgtttttgatggcaaatacttaattagtttttagtcagagtcctcttaaaagtaaggacggcaccttgggaaaccaaggtacacacatcgaaactaatttttatataggcttttaatttggatgaataaataataaaacctgtatgtcattcaatgcaaatcgtgatggaaaactgtcttgctgcctgagaaaaaaagaaaacatatcaggagaagttaaatacaaataagtaaaagacagtgtttggtcattttcatgctgtgttgatggcacgtctgcatctctagtgagaataccctcttctagggtcacacactaactcccctcactctcattcttcccaggcaagagatgctgccatgtacagatgtgttagtttcctggggtctctgtaaaacagttctgcaatcttaagatgaaatttaagacgatggaaaggtattctatcatggatctagagggcacagtctgaagtcaaggtgttagcaagggtagttccttctggaagcttggagagagaaacagttccatgtccctcgcccatctcctggtggtggccagaagtccttgatgttctttggctcattgctgcctcatttcaatctctcctttgggttcacattcacatgaacttcttcgcttttgtctgtgtctctgtgtcttcaaatagtcttcttctaaggacatcggttattggaattaggatctaccctaaaccaggatgaccttatcttaacaagctatatccacaaagacccacttttgaaataaggccacgctttgaggttttggctggacatggacttttggaaacactattaaacacaatattatatatacatatatatgtatatatatatatatatataaatcattaagaatttatgtttacatcagtttaagtgagcaaaaaataaaaaatcagttctggaagtcaacctgtgtgttcctacttaaattagatgtttaattttgtatcatacagaagcatcccagatacttatattttgtgtttataatttcttcaatttattcagtgaacctgtatcgcattcaggcatttagaaacaacctaaagcatgaactctgccctcaaggagatgaatttttggcagaataaatgaataagttaatagtttaaatactctatgataaatgctatgacagagaagcaagcctcgcctatgttgattaatgaaataaggtttcactaagaagcaacagaaattaggggtaaaggagcattcaagacaagaactaacattttcaaagactaagagacacagaggtaagaacataatttatttcatatttggagtttttagttagcaacataagtctcatttcagtgtacaaaaatatacaaattattatgttgcttagaggatcaatatatttgtgacagatttgttaatcttattaatattaataagaataaaaacattgaattatactattttaaaggcattttgctaattttaaatcttaagtgcaaatctgaccatattacatctgggctgactacacgttaatgatgctacattgcctataaagtccaagctgtttgtttgaaatttaatttctgcccacccactgactacctctgtagtcttaaatccagtcatattgtgttttatgctccaaatatgaatacaagctatatttcctaatacatgagtgacctgcttgtttaacaggcagtcattggagatactttctctaaccaaaatagcctctccatcatcctttacctgaccaatcttttttatctttcaagattcagttgaaatgcagtctttaatgagaatcatctgaatttccacaatgagtcatgtgtttattttcatatgaatatttatcagatatcatataccattatattacataaatatttccaatggaatatttaacaaaataattcaaaataaagtcaactgcaagatactgggaggaggagacagcaagtgtcaccttattcatcactagcatccccttaaatggcaggctccctgtacacaataaatgtttgctgaaatgaactgacatcaaatgtaaatgatacaggcgtaatttattccctcagtgaaaactgattactatttgaggatgcatagattcttttattggtggaacagggcatgattatattgtatcatattgaacagtgctctaaggggcctacaaaatattgaaataattaccaaactaaatataataatagatgttcaaacagagctatagacagcaaataactcagtgtttttttctaatttaaatatttgtataacttgtattattatttctggttattattttaaatcacacttttttgaggctgcttcatgggttatgtatatggattgcttatcagaggaaaaaaaaccacccaagatccagagtaatgtgaaaataaaagtaacttaacataaaaatagatttaataaatatcactgccaagttatacaagataaactgataattaatgaggtaattaaaattgtcatgtgctgtatgacatatttgggatatgctatgtttctaagttttcatgttattagatttaaaaaaaatactgtaagttgtaaccagagatgttcttgccattaagagatctggaacttagatttgagcacatgtagtattctttagtgcttttaagtatagtttgggtttcaaactagaattggagtgctttgtaatagacagctgtggattgtcattcagtgtcagtttgagataatgacttcctggtctgtacatataaatattattgtagggataaggctaatgatgaaagtgcacatgatagatactttcacataatttgggtataagccttttttgcaggggttggctaaggtagatagctagtggatcagatactcagtggatctcattcctgggttaccatttgagggtgacatttgaaatgaacaaatttaaagcatggaaatatatgttctaattttttattctatggggaaacagctatcagtatttaattgttttttttctagtgtaatttgtttacttggaagaaacttacaattgactttgttcagtgagagaacatggtgagcctacctttatatttaggaacaagacagttacaattggcagctagcttatattttggagaactatttaatatgtcactgatatagagctagagtcacatcatattactgtaaaatctaaatttaaatttactctcaagaactttcaaagttaaactgacatataaaatcaagagtgtcgatttaaaagcaaattaaaatttctggcagagagtaatatgcaattagacctatgtctgtcactctgaaatatgaataacagtatactttctagaataagggagggtataacttttattatacatattagtccaaaatttttcataaaataatttcccaagaaatgtaaacatattaaaacaaaagtatatatacacattttggtgcctggttaaagagaagaataaagtaatgaaaaagaactatgtttcactgtggtttataaataagatattttgattactacaaagaggagccatatgtgtactctataagaacttcaaagctgaaaagttcccaagagaccatccagcccaatcctctattttactaacgaggaaaccaaaacccacagagttatgcgacttgcataagcgaattaatcgcagacctagaaatcctgcataacaatctagagcatagcttcctctctgacatttaatacctctctcctctggttcattcttctttgtttcttcttcacccgtaagggctttttataatcttagtgatggcctacagaaaatacaattttgtgaattctaatgaccatagaaatgctttggcctatcaattatcaccgtaagaatatataggagatatccagtaagaaaagtatctcactagtactgtgcattctacatgtccagcagaaaaatttaaatgactaatcttcataatgtactcattggagaacagcttgcaaataaacataactcaagctttaattgcattttggtgcagaaagtttatcaatatcagttagtgtattttctcaggtaatcttacctcctgagatacgttaactactttttatatatatgttaatttttatttatgatagatgattgcagagagtactagagcctaaattacagttatacagtccatcaacatttcacttataatccgtttaatgtaaggaaagcaataaaatttaaaatgctgcaaatatatataagtgattcctttattagcttttattcttatgttgttagttttcattatcacctatttaaattagctagggagagaagagcaaatatttaagatggcagtaattgtcctcatgaattaaaagtaacaacataataaaataattatttagtatgcacactttaaaaatttcaagcaatttaaattacttgaattagaaatcagtgattttcagagattaaatattcttactcctatcagaatagtatcagatcttttatagttagacttgaaaagaagtaatccagattttcaatttgagatttttatattttctatgcttctaaatgaagcatgtatatttttctcacatgctcaaaatactgtcatattaggtttttcacctttcatgctcgtttggctggacaggaggagttaaagaaactgtcagtgttctcttttattaccaattaatgggggaataatctcaagaattaaagaaagcattcaacccgtaccaatcattttgtaaacatctgaatactctaccctcaggcacccccaaataataatatttgctaggaaaaaagtccttatttatggaatgtttttagcaagatatccctgtgttaggttgcttatggtaaacacttagcaactttagatttatgatcacggctctatggaaaatcacttatcagctagatgaccatggaggaatgaaatggagatgcttcataaccgaaatgcttctgcgtgaggcaataaactgcatagcttattaaggactgtccctattactctaggccagagagcacatgtctgatgaaagaagaaaaagcctgaggaactatgcagtgtgtatcagatcccaccttgctttgcttgtccctctgttttaattacctcctctttatcccatgggtaagggaggattcctgtcctggggttatgggtatgacggaacacctgacacctgacgtaaagcaactgagaccaacagcagtttattagtggcatttccacacaggctttgagagaaaggcatctcaagtctcgcaggggacatgggggttgtccttgggaacagagtgagcaatcagacactgcgggaggcaggatttgttgtatcaagagagtggtcttccccctggttcccaccggaggatgtgattggcttgttcgaataattctgtgggtgtagggtaggagggaacggaagcccaatactcaaggagaagtggaatatgcctgatccccgagggaagcagcgtctttttattggaggacatatccgcaggaacaaagttgggaggggagcttgcagtgaggtcactggagaccctccaggcttttcccagatgtcaaagcacacataaactgggccttacttttcggccttataccacaagctcttaatgttttgttttctacaattattaataatctttggctctacataagatgtttgctttgtgtaaatttgatttaacaatccgaatttaatatcaccgtataggttgcattaattactaactttagccaaatcaacaacatgaacaacatgtaaaatcccatataaaattttttcttccctgttatcagaacagaaaagaaaaacttccctgtttttcttccctgttataaaaattatttcttccttcttaaccaaccatttatcatgtctatttagctgtatgtgctcttttaaacttgctgtgttggctgtatttgtgtatcataaatataaactagaaaatggacaagtagcttcctaaactttgaagtgcaaatgttttattaagggaaaaaaaaaccctctttcccatggcattgcacttccatagaaaatataattatttcccccaaatccttttacagggttttgctatgttccaaaggacagggactgagctcactttgatttgagttggactctgaacatggttggattaacagcctcggtcattaatctctactccaaatttcagcatgctgtgtccatctattacaggtgtgggtgtgttttttgttgaaacaaaataatgtatacttactaatgctaaagttaacgaacaaaagcaaggttagtaatttttgcaacaaaacctacccagtgagggtcccagaaggctatctgagtaatacagtggggcaaatggtttcaattcaatctctggatgagctttgtttgtttgtttgttcatttgtttgtttgttttggagacattctcactctgtcaccgagtctgcagtgcagtggtatgatcatgactcactgtagcctcgacctcctgggcttaagcaatcctcctgccccagcctctgaagcaactgggactacaggtgcacaccaccatccctagcttattttttttatttatatttttgtagagatggggttattttttttttggtttgtttgtttgtttgttttccccacgttggttttagactcctgggcttaagcaatccttctaccttggcctcccaaagtgttgggattacaggtgtgagccactgcaccaggccaagatgatccttttcaacagcgtctaagttaaaatatgctacaaatttatttaagatcttgctgtaaaataaatcatttgaagtcgatatcatgaaacaacaggagaatgcaatgtgtttcctcctttgtcaaccaacagtgtggacccagcctggacttgcccacaaacagctgagcctaaagcctgcttcatccatcacctgaccttccataatgactctatatcacctcatttcttctattttttttaaaaattatgctgctctttctctttaatctagtttttcttcttcttatatcttctttctaaaataaaagagcacataaatgttttaaaacaaattagattttcaactttcagtaaagataaagttttgtcagtagggattaaagtttgccatcctcgacattgttgatatttctggctctataattcttggctttggaggaaagggctgtctcgtacactggaatcttttgcaacatccctggcttctacccattcaatactagaagtgcatcatatttccctcagttgtgacaaccaaaattaacccaaaagtctcctagtggcaaaactgcccctgggtaagaactgctgatatagatggtgctaaagtgtcacctagaaatcagttcattgtgttcctaggaactacgaaaggaaaattgacacattgtaagaattgactcaacattcatttgatttatatagcagtgtctgttatttgcagaaagcacgtactgcatgctgagatttccatagacttcatattgataaggacaatatttatggtgttaaagtatgcctacatatatagatctcctatatatgtactgcagataaaaatactattatgtcacctcatcagcataaatattgcaaaagaaaatgacctcttgaattctcatatcgtttgtctgtgatttgtggagaattacacaacattacttctaaacattttcaatctaagtggttttatttttattaattaggcattactttttattttgccattaaggatatcatcttttcaaccaggatcaatttgaatctgtaatctcctttggttaattggacattttccttattgtgaatttaagtttgggatcaagaggagattgattagatctgccacatagtttggccggggattatttatatagctgtttctttgcatttcacttttgctaaaaaagtagacattcaaaacaatataaatttgtagtctgttagcaaagtgtattctctaatattctattatagatatagtatgttctatagagtatattacactatattctattctattatagaatacactttgctaacagaataaaatttatattgttttcacgcactctattcacatttaagaaacattaaccttcataaatagcataaaggctgattttctctaaaacagagcaaacaaatcaataaaataactttgccccacttcttagcttccacctcaaagggttcttttttgttcgtttgttttgtttttgtttttgctttttgagatggagtctcgctctgtcatccaggctggagtgcagtggcgtgatctcggctcactgcaacctctgcctcccgggttcaagtgattctcttgcctcagcctcccaagtagctgggactacagatgtgtgccaccacgcccagctaatttttgtatttttagtagagacggggtttcaccatgttggacaggctggttttgagctcctgacctcgtgatccacctgccttggcctcccaaagtgctgggattacaggcatgagccaccattcccgtccctcaaagggctcttttcctactaaggaagtaaacgatgcaggcctgattgtgtgtttttttgcacttttaataacaccttcattgaccatgtgacaccacacaataccactccttggtgatgtgcttagcaatcccaaacaaacctttccaattcacataaaatgccacacaccctattcctccctacctcttagggttgtcataagaatttgaatgatacatgtgaatgctcttctgattttgaggatgaagtcactgtgtcatcttaatcatgcttatttggagttgtgcctagaggggcataatacacagtgtgaaaatatgttctattgaaagttcaaacgattgctttagtggttgatgccattaaattggtttggaggatgttttattgcatttaaattggactgaccacctcaaagagctatttggataactctaggcaacctcagtctggcacagataatccagttacttagtaagagtcttgagcacaaaactggggagggggttatatgataattctgattttttttttttttttttgcaaataaaaagatactcttgactgtgatcttatttccaattgtacaatgggttcaccttacaaaattaagtatagtactatccccatgcttgctttttaattgaggaaatagtgggtggtttggttaactaaacaaccatttgttagattaattctcactagcttgattcagaactatacctagtaggaaatattggagctaggaactgagcaataagcagcatttatttagggtgtctggctcatatatattgtgtccttacaacaaagatgcaaaacaggtaattattcccccattttgcaaatgacaaaaccgaagttgaagaagtgaattaacttactctcataacaagcaatgtcactttaatttttggcctttctaccaaagcatgttacctcttaaagacagcataaaatcagagcataacagattcatagaaagaatggttataataataattactatcattactactataattatagtttgtatccagaattgattaatcattgattataggtcagatattgtgctaagttccttatttaaaacctcacgatactgctacaactatcttcattaggaactatcttcattttaacaatatgaaaatgaaggacaaaataattttttgtttattcattcaatcactaagtgtaaaaataagagcgattatgtatttgcttgtttagtggtgccatattctcaaaggtcccaaagtaacaatttaaaaaaaaaaatgtatctgtccttgaggggaacacagtacatctatagtacaatttttcctaagagtagttatttgaaagtcatgacaaaaagggaagtggtcaaataaactgtgttgaacagccattgcaaattatttaaagcaattttaatggcaacaacaacaaaaatatgtattaggtgaagaaaagcagaatataaaattgttaatacagatcaatatctctttcacttagcagtttgatttcaaaatgtgcaggctgggcacgatggctcacgcatgtaatcccaacactttgggaggcaaacacaggtggagcacaaggtcaggagatcgagaccatcctggcaaacacggtgaaaccctgtctctactaaaagtacaaaaaaaatatctggggccgggcgcggtggctcacgcctgtaatctcagcactctgggaggccgaggcgggcggatcacgaggtcaggagatagagaccatctggctaacacggtgaaaccccgtctctactaaaaaatacaaaaaaattagccaggcgtggtggcgggcgcctgtagtcccagctactctggaggctgaggcaggagaatggcgtgaacctgggaggcggagcttgcagtgagccgagaccgcgccactgcactccagcctgggggacagagcgagactctgtctcaaaaaaaaaatagaaaaagaaaaagaaaaaaactgcgcaaaaattacatcaaaatactaatcatatttctgagatgtagtattatggataaccttttttatgtttttctgcattaatattcaataactttattactaatattcaaatattactataatcgctgaaagacaaatgctgtatgattcaacttatataaggcatctaaaatagtcacattgatagaatcaaagagttgagcggtgggtgccaggggccggggaggaagaggaaatgtagaattactattaatgggcatgaagttgagcaagatgaataaattctaggaatgtgctacacaccattgtacttacagtcagaaataatgcattgaacacttacaaatttgttaagagagtagatctcatgtgtttttaccattgtaaaataaaattaaaaaaatgattagtcaaaattgtgaaaaatacaaaacatatataatttgctttaaatatcattttaaaatatgtacaagatttgtatctcaatgtataaattcagatgcacataaaagttctcatccctttatttatcagttttaattttaagcttccatcttgctgttctttcgaaaggcttactctaagtcaatcctggtttcattttatttcagggtcttatcgtgtcattgtgtgcacacacttgtatgtacatacagtgatgcatgtgtgtatacactcatgtgttcccagagactagttgtgatacttacagtggcccctgtttgtatttcctcctccacgattcagtgattctctgctgcttttcctgcagtcttgggaacttgaatcaattgggaatgtgttgatggtccacctataaataattatcccaaaatagcaaccaattactttatttgaaaacaaaacaaaacaaaacaaaaaaacactagctgaataaactagtatacttagtattcggatactaataacataattcaaaaacagttctttggccgggcacggtggctcacgcctgtaatcccagcactttgggaggtgggcggatcacgaggtcaggagattgagaccatcctggctcacacggtgaaaccccatctctactaaaaatacaaaaatttagccaggcgtggtggcgggcgcctgtagtcccagctactcaggaggctgaggcaggagaatggagtgaacccgggaggcagagcttgcagtgagccgagatcgcaccactgcactccagcctgggcgacagagcgagactccgtctcaaaaaaaaaaaaaaaaaaaaaaaaaaaaaaaaaaaaaaaaaaaccagttctttatgatatatataaaattaaaaccatagacagtacctacaatctatattttcaatatcacattaaaaaagcagtgtaatatcagtatattattgtgatttatatgtcacaatttatccctgcttaaatatcatatagaatgcttaaaattgtattaattcaaagaattattcacaatgtcattcccaatgtcactttttagtttagagcagagtatgcatgcacagggattatttgtggtaaccatattatgaagtgtagcattatcttttattataaatgatatgatataatcaaaagagatggccttttgggtttaaagacaaaataaatgccacgtttactaaatgggtatatttgagatgattgcttaagctttccaaatcccatttttgccactcataataggaataagaatgcttacttcatagatttgtcatgaagattaaattagataataaatgccaagtgcttagcaccatggctggctgaaggtaaggatttatacatattagcccttattattattgctgctgttgttcttagttcttccctttggtagtgcatagagtcatgtagtaactgtttgtacttcctatattctcaactctgaaatgaattttattatctagcgtctgttcttaacctcacaagaaaacatgccttaaacattaaataagcataaaaatgaggtcttgatgctcacacagagaaataagcattttccagaaggagttgccttcaaatcaaaatataattgatactactcagaaaagagattttctctctgcactgattgacttgaaagcagaatagaagactggagtcacggagccagaaaatgtttagaggtggctggcttcacatgtattttctagtccaactattaagtttgcagatgaagaactgagaactccctgaaagaggaaacggctcctcctgagacttccccataaggaactagtagcagaaccgtattggatttggttttagtgcttagccccatgctcttccactatattacatttaaggtaacatgtacgttttcatttctattagaagtcatcaatgggtggactttgagtgtgagcattttgccttgcatgtaatagatattcttaaaatagttgtgaaagaatgaatccctcttttatctatcctatatatgaaatgactttgttggtaaaaaaaaatggccaattgctcagcaatttacactagaggataattttacaaccgcaggtatgggacacacttgggttcctttccacacttggacattttatagatgcatttttaagggaggaggagataacagcaatctcagtttttttctggaaaataaaaataattgttgtatgcccagtggaactatgaaggagcatattgggcccaagaaagtaaagaatgtctacacttaagctatttttaaataataaattaattcataggagaaacaggaatgagaggcaaaaatgtctagtaattaatataaagtccagcaaaatgacttaaaaacagttatatttgcaaagaagactcagcacacttatgtcataaaaatccttgtctagtcacagttttaatttatatataaaattaaaaccatagacagtacctaaaatctatattttcaatatcacattaaaaaagcagtgtaatataaaaaatataaaagcagtataaaaaatcttatctagtcacagtttcaatttctcacaattgtatgatcattttgacattataggagagtaaggatatgtaagttagctaagaattacagcagctttcgagaaagataagacagagaagtgagagatggaaagaaatagggacaactcatcgaaatcaatataaaatatgttagttaatagcactgtttgcaatctttaacaaatgtcctctagtggtttttaagtatagcacttcataagccttttgaaatggcatgttaaagtagtattaaaaggctgacttaccattagcatgctatttaatgtgtcattttaatttttaattttggagagttcctagaaatagtgtattgagtgagcattaacaaaagattattaaaactccaatgtcaacttaattgatatatcagaattcttatgacaaatagttcataaatttgtttcacacattatgaaatggaaaaaagtaacaggcacatgctctgtatattgctgttaagtgcatatcctaccataaaaacctctccattgtataacaagaggcttgtgagatacttgatgaaagggtagcatctcacctgctaaatgatgtggaagaattctttgactgaccacaccatctatagagatttgacattttccctgtgcctcacatagcattcttcacaaaaggtgagtgttgtttgtattaccttgaatgcacacacaccgcctttctttcctcccatttctttcccatctccagtcacagttcttatagtgtatttttctgtaagtagttgcaaaatattcaattaatagcagaggggacttattcaatgtcaatatatccttaaataaagaataataaagaagaaattactgtagggaatggaaaatcattctctccatctccaacaaaactatataaaacaaatccattttctaaaaatgttaaaatcttcccagttggctgaccttgtttcagtccagaaagacacagatttttagaactaagactgtgaagcccacatcaattttgcagtttcaagagctcaaattccttatgaaataagctgatgaaagtgtttaacctgtccaaatgaaaaataaaatgctgagtatttaaatgcctctgaaattaagtaaatctgttctatacatgtttttcttctaatttctgcttctgatagaaaatagtttagatgagattgttttaaatgcacaaatggacaagaaatctactgtaatataaagccctgtccaaattccagctcttcccttattagctatgaagccttaagcaagtcattgacctttttggagctcagtttcctatatgtaaggtgaatgtgataatagccgttatttaatattgttaattattaattgaaaagtttaatggaaaatgtcttgcacatagtaattattaagcaaatggcaaccatttgaatcttcactagaggctattttgtattctaagtcaagaaatatattggataagaatgaaattaagttgactacagatgaacttttgatgtaagtatgagcctatttgttctaactaactattcagaaattggggcagtgtaattcttaagtacaatttaagatgatcttttccaactctcatatttaaacaccaggtaaacaacattaggagtggctgtagtttgttggttgccaactagctggttagtggcagacacagatttgaacctacatgtctgttgtgtggataaagttttcctcttatatcctgtcacttatatgttcagtttcccttgtatcttaaaattttatgaggaattaattatgcttttttagtatattcttcaagtccattatcaatttcttaaagacacaaactggttattatactgaattcctactcttctcagcatctcaaaatgtaagttgcacaaagctaataggcatttttaagttgattgttagaagtagaaattattataagtaaaaatcattagaaatatatttctgattttacttacattttagtcaatattaaaattaggagttttaattaggaaaattaagaaaataaagacggtgattttctcatgaagttgactcatatcttttgtacctgtctcctttccaaactctgaagtataaaaaaggtggaaaaggtggttttataaaacaaaacaaaacaaaacaaaaaacaaagaaacaaaaaaccttacaagttaattcagaggtctaaaagcaaaagcttgatatctgcaacaggagcttgatgtacagaaactagaaggcaacaaaggtcacactgacctattatttaattagaaagaacaaaagttttctcaatgaccctaacagttctttaaactgaattgaagatgctggtagactgtaactttcagcagatcgtcgtcagttctaaggttatttcgtcagttctgttaccattacagccaagacatcatacgacagactacttcaaatctcacctctacttgccaaatccgggatgagaacaggacaggtgacacagcagacggtggcttctccacgctcatggttggctgaagttgccttctagatgggctttcctttttataaaactaaacagcatatcacactggaaattgtttttgccttgtagatatatctggtaacaaattctgacatattggattttataaattctatttaagccttacaggagattttaagtttcctaaaattcttgctgtgttcattcccaattatagactagtaagtgttcacacagactctaacgagtttttcttactgagaaagggtgcacaaactcataatgggggagaatagtcaagataaaaaatgttggcatcagtaattaaacaggtttgctttccctaatgccaaccatggtgggtatttatttcctctttattttgaagaccacatgttagactgtcttttagtcaggtaagattgctgtaacaaattaccatagattgggtgattgtaaacaatataaatttatttcttatagttttggggactggaaatctaagatcagggtgctagcatcatcgagtttgggtgaaggccctgtacaaggttgcagactgctagttccttgttgtatcaccatatagcgaagagaacgagctagctgtctggtcacttcttaaggtgggactaggctgggcgcattggctgacgcctgtaatcccagcactttgggaggctgaggtgggtggatcacgaggtcaagagaccgaggccatcctggccaacatggtgaaaccccatctctactaaaaatacaaaaattagccgggcatggtggcacacacctgtaatctcagctactcaggaggctgaagcaggagaatcactggaactcatgaggcggaagttgcagtgagccaaggtcacgccaatgcactccagcctggtgacagagtgagactccgtctcaaaaaaaaaaaaaaaaaaaaaaaaggactaatcccattcataaggcctccaccctcatgacctaattaactcacaaaggccccacctccaaatgctgttttattgggggtcagatttcaacatgaattttgggaggggacaccaacatttgggcaatgagggattagatctactaaactcaaaaaactgtgtattgctattccaaagaatggtattttttcataattcttttttatgagtatgctataatatttacaatgtagcagtgactaatcaaaaacccacctgtccgacattaattcaggcatccataagaagagataatctgaactgtccctagaatacaaatcttgaatctgacaggtactatttcactttgggcaaactacttaatttttgagcttcaacttctttatccttaaagatgaaacaaagaaattcttcattgatagaaagaaaataatttcaacaagcattctgttgagtatcttatgaagtctcctcagctcagtgccacacttacctaatcctctcgattcgcattcggttgttctcttcccattccattttgtgttagtttcttatatggcacaatttccacaaacttatgccttagaacagacatttattattttactgtttttgtggaccaggtgtctgggcatggcctagcccatcggcgtgtcagcctaggctgtggtctgggctgagattcaggcttcttgtgcaagctcgaatactgttggcagaagtctttttatcgcagctatagaactcaggatggtttacttcttcagggatggcaggagagacagcctttgttgctacaaatctcaaatctctgtatcctcttttaaaggggtcatctgcctaactcaggcccactaaggatggtcactcttctgacctaaaatcaactaattggagacctgtgagcatcagttgtatgtgtccatttggcaaggctaccttcttgggttggccaatcaaacattaacttaggtgttgtatggaagtattttatagacaagattaaactccataataaattgactttatttatttatttgtttgtttgttttttccaagacatagtcttgctctgtcgcccaggctgaagtgcagtgactcaatctcagctcactgcaacctccgcctcccaggttcaagctgattctcctgcctccacctcccaagcagctgggattacaggcatatgccaccacgccaagctaacttttgtatttttagtagagatggggtttcaccatgttgaccaggctggtctcgagctcctggactcgtgatccgccaacctcagcctcccaaagtgctggaactacaggcatgagccactgcgcttggccacaaactccataataaatttactttaagtaaaggaggctatctccaatagtctagctggtcctgggcttcttcccaagagtttccagtctgcctttcctgacagcctgtcctatggacttcagaactgccaaatcatcccctacattgcataagccaatttcgtgaaatacatcttaatatttgtgtatcctcccgtgtgttagtcctttctgcattgctgtaaaggaatacctgcagctaggtcatttataaaacaaaagagtttatttggctcatggttctgcaggctgtacaggaagtgctggcgtcttctggtgagacctcagaaacttttactcgtggcagaaggcaagggaaatctgttttcacatggcgagagagggagtgaaagagagaggaagtgccaggccatttttaacaatcagatctcatggggaaaatatagagcaagaattcactcatcacccggggaagggcacagagccatttatgagggatccacccccatgacccaaacacctctcactaggccccacctccaacattaggaattacatttcaatgttagaatggcagggtagggggagagcataaatatgcaaactctatcatcctggttctgtttcttcagtgaatccctggctgatataggaccttaattacatatactaaatccacttactatgctgtataacataaccataatcagaaaagaaaacccatcatattcacagattctgttcaccctcagaagaaggggattatacaggtcacctgtcccagaggcaaggacatataggggccatctcagaattctgtcttccacatattctccaactatttactttttattttctaataaattctattcacggagaacaaacagtatgactttctgggatgggacagtaagaaagcagttggtaggggagggaagaggtcacataaataatggaattaaagctttacgtaacatagagattgagtaaagatataaaagctggccctttctgacaatcggagatccagttccccaaactcattagctgctaatctcaaagttgcttacttactatcattctctgttttctagtaggtagagttgtccaatagaattttctgtgatagaggaaatattccacttctgctttgttcaatacagtagccactagccatatgtagctatggagcattcaaaatgtggctatagtggctgagaaacagaatttttgttattaactaatttaaatttaagttcaattaatcatattgggatagtggctgcagtattagacaacacagcatagaggaataatctatcggtcacagctggatttctacaggaaacttgacagctttggctataaataagacctgtgatatgtctgcagtttcaacatttgttttattaatgtgtacctgacaaacaaatgacctgaaaatctcttttcaaccagaaacaaaatagactggctcagtactatgctttttacatattgcaattttatgtgctttgttttcactttaaagaaaatatattgtgcctatctacaatctcagagggaaattaggtatatagcatagtctcttttcacgtggaatcttttgagggggactagattcatccgaaacactcaaataaaaatataaatagacataaatgcagaggcagaaaaagcacattgcctgtcggggaaaaatgagctatcaattcttctgtagccaaaaccacatatggttagctcattttcaaggttcaaatgctctgagaagtgtcatcgtattaaccacacctaagaacggatattcggggaattctgagatcctaactgacagtctgatcagaagttgggtcctagagagctcagaaggactgttagaatgctgatctgatccagagattacccaatgctaggattttagtctttgatttctatatagcctacctgtggttccagggaatttgaagagctttgcatttgtcattaaactgaaagagtcatatagccttgccagggaaagaagacagggatgcaactgctgattaaggccccatgtttttatgtccttcttagagtacggattccatgtcaggcaactttaactagctttcacaaatttctcttgaatatactcatattgttggctggaaggtttaaggaattatttgagaaggcttctcatttacgatggaaatgtatcagaacatgatttaaaactaaatagcagagacctctgttttcaaaagaagcataattaaaggaaatttaccactggcagtgtgtgtgtgtgtgtgtgtatttgcttcactccaggcccaggacctgggtatatggtttggcctctctttttctcccaggacctcattatgtatccctctgtgtcttcaactctgtgggactcttgcttgacttcttccagctgtttcaccatagacacattccttttattttgctgtgtaaagcaattcaacccagccttctgactggtgctctagggcctataatttcatcggcaaatggcccatcaaagtgtttagttaaattttctccataacagaaattttcaagcaatgttttaaaatagtgactttttcttctttttaacaaataatgaagtgatacttttaaagttattcagctaacaggtataaagcagattatcctgcaaaaaaaaaaaaaagatgtatacattcctccaaccatactctgtgggaacagcagcaggactgccccgtgcatctttcagcaagcaggagatgcatccctctcttgtaccatttatattaggctttaattatctctctacataactgcagtccccaaatatgaaatgagttcctgatggcagaaaaagcttcatatcaatttttgtaaccccaggccctagtatgctctctggcacctaattatagcaatcagtgaatacttgatagggtcatcattcacttaacagatattccctggccacatatgagaaagtgacatttaagctgagatctgtaaaatgagtaagagtgagacatgtggaaaagaagatacgggtagttaaggctgagggagtggcacagaatgaatcaactagcaagttaatgaatgaccaaaaatgctggtctatgtagtactagacagaggatcacaaatatcttgtttcaagtcattcttgagagttctggccatctgtatcaaaaacttttgtttggtcataataacaatcattgattcagtaacaatgactaagaaccaaccatgtactaggggctggatatgcccagggtatcatgatgaaaataaaaaccagtctctgcctttgtggggagactgacattacagatctgcacagtggaggtcatattgcacctgtactcatcctggaggatggtagtgctctcaaggtaatagaagccaacggaaatgtgacttcagtagtgatctgagggagaacttctccagggaggtgatggctggttgagctttggaaagtaggtgaaggtaggaggaagggtcatatttcaggtaaacaaaagagcataaacagaactcttggggcagaaagacaaggctggtgtggctgcagcaccgagattgaagggtgatttggtatgaaataaggctggagagttgacaaatcctgcaatagatggctttttaggcaatgttcctgatttctggttttgattccattagaaacccaaagagatgccaccaaactatcttaagccaacagtttgtatgtgttggagtgatggacatggaggaagcatatcatgatcatgtctgctctgggtaagccttgctctggctgtggtgtagaggacaggtctgaaggcagaaagagaagacttggtaacacctgtcacaggatatgactgcagtgccagggtgagacctggcagcctagactaggatggtggtagcagagtggaaatatctgggaggattgaagagctattagaaggtaaaatctacagaacttggttgtgggttacatgtgggctgtggtggaaaaaagtgctggaaatgcctcccatgtgtcagtctggttttacctggtattgggcaataccatgcaggtatggactgatgggagagactcagatttaaagaaaggatcacacatctgttgttttttttatttttgaggaggtgaacttaacactctgggtctttatttccttttcttcctttattcttttttttttttttttttttttgagatggagtcttgctctgttgcccaggctggagtgcagtggtgtgatctcggctcactgcaagctccacctcctgggttcacaccattctcctgcctcagcctcccaagtagctgggactacaggcacccgccaccacgcccggctaattttttgcatttttagtagagatggggtttcaccgtgttagccaggatggtctcgatctcctgacctcatgatccacccgcctcggcctcccaaagccttttcttttttttttttttttaacttttattttaagttcaggactacatatgcaggtttgttttatggataagaaaatgtggtacatatattccacaaaatactatgtagccataaaaagaatgagatcatgtcctttgcagggacacggatgaaactggagagcatcatccttagtaaactaatgcaggaatgtaaaaaaaaaaaaaaaaccacaaatactgtatgttctcgcttgtaagtggcagctaaataatgagcacacatggtaaatgttgaatccgaagtgcctttacggcatctacaaggtgttgcgtggataactaaataaaggagtcaagatctcagcttggataggacaaacgacaaattgtgacttagctatgcataggagaggtaattgaaaccgtgtttggatgagatcacctaagggtgagaatagagggtgagaaaagaagagcatctaagactggtccttagatctaaaaataatggctgaataatggaacataagcttcaaagcagacagagaatgagtggcaggtaggtcaggggaaatctagaagggagatgtgacaagaaagcatgccaggaagacagaaatgggcaccagggatgagcactgctaagagatcatgcaagatgaggactaaaatattgtccaggaaattagtaaaattgaagttgttggtgaccatagcatgagttgtttatggaagggacggaaatttaaacctgggtgatgtgaatggagtatggggatgaagggtggggttaggagattgagtcagaaaatgcagtgtggcatttccaaatgaaacacagcatcagataataggataaagatgaggcatttcatttgttcgctcttttaaacagcctgcttttggaatcaagatggtgaattcaattaacctattattatttcttggtatatgacagttcactagctattgcactccgtagaatttatttcattctattcaccctggctgaagaaccataggtaagatccaacattttcagtggcagcccctcaaaaccaacgtgtttccctgataatcattctgcttcccttcttttgttgtttctggagatctccatctgctcttccatttatcatctgcttgatattcttggatggtgtgcttggttggcctatgctatgggttcagataggcaagtaactatattccccttccccattacagatgatgtgcctcatttagctatgataaatatttgctcatttcctcacatctgcatatggcactgctaccaatccatcttttcctccccatcctcatctctgctaagttcttttcctgccaccatttctatggttgaccagttagcatttaagaaaatatgctgacagtagccgcatcatggattagcatttcttcatgttcataatgcaaaagccccattagatgtaaaaaacttgctttcttatctttcctttgttacacttatatggaaccttttagaagttctatttataagtagaatgatatgaataaatagaaatgtgccagtgaaatagaataggccaaaatatacatcatattaaaaatgaaaatcaatcatttaaataatattatggctctttgaaataatattataccctatatcaggaggtttgtgttttgtcttatttcattttcagtatgtttctattgaaagtgagattgccatcaagaattctcaaaaccttctggggtgagatttcagagcttcaactatgttaatagctgtgcttggcatatctaatggtgttttgctccttctgaagcattttttttaattagacaatacatttataaccaagctcagtgagggtccagattgtggatgaggattaaattgagattaagatataagtgtctggtccattttaggaagttgtcaaacaccgttaagagtacacagtaatgttattctctgattgttgaatataggcaagtttcaaaaggacccttcacagttatgaaacttttaagtttgctatagtgaaaagattgatacatgggaataaaaattcactcatgaatctcattttataaataaatgcttcatttatgtaaattgtttgtactttgtgtgggtaaacaatattgattgcacatctagttgaaattactggatgagaagtattagtatcctattcttatgtgtcgatttaacctacagcctgggttctcttgactgccacattcctttaatttcctttacttttatatactcatttatctagaacttaagaaatccccatggcttgtggtaacatgaactgaagatggtattacaacacatttccttctagctctacccagcacgaaagctttattataaggattctggttcttcttgctatttggggagtaatattttgaaaattcataagattatgtccatcaagcattccagactaacaataataatagtatatgaatgtatgaaataccataacatttttaatatgatatttttaaatgaataaatttcttcttttttcttttttttaaattatactttaagttctagggtacatgtgtacaacgtgcaggtttgttacatatgtatacatgtgccatgttggtgtgctacacccattaactggtcatttacattaggtatatctcctaatgctatccctcccccttccccctaccccacgataggccccagtgtgtgatgttccccaccctgtgtccaaatattctcattgttcaattcccatctatgagtgagaacatgtggtgtttggttttctgtacctgcgatagtttgctcagaatgatggtttccagcttcatccatttccctacaaagaacctgaactcatccttttttatggctgcgtagtattccatggtgtatatatgccacattttcttaatccagtctatcattgatggacatttgggttggttccaagtctttgctattgtgaatagtgctgcagtaaacatacgtgtgcaagtgtctttatagcagcatgatttataatcctttgggtatatacccagtaatgggacagctgggtcaaatagtatttctagttctagatccttgaggaatcgccacactgtcttccacaaaggttgaactagtttacagtcccaccaacagtgtaaaagtgttcctatttctccacatcctctccagcaccggttgtttcctgacttgttaatgaacaccattctaactggtgtgagatggtatctcattgtggttttgatttgcatttccccgatggccagtgatgatgagcattttttcatgtgtctgttggctgcataaatgtcttcttttgagaagtgtctgttcatatcctttgcccactttttgatggggttgtttgattttttcttgcaaatttgtttaagttctttgtagattctggatattagccctttgtcagatgggtagtatttttaagtgaataaatttctaagtgaaatcagttatgactttcaaagcaatttttaatctgctgcatttttattagtgatgaaaagtatatgagttttaatcatgaacacaatttaaaaagtcaaccaaagacttcaggatgttgttccttgttacttctgtcagtgtaaatttcattaatactatgggtgatgaataatatgcaatgtttaagctgtttatattttctactttaatagacgttctggctttactatcaaaaagaatgcaagatttataatttagaaaacaagaagaaaaagagcattgtgaaggtcaaactagctatttgcattttaaaatagctacttctcttttaatggacgttgctacaaatgtatagcaataacccctcagctggcaaataaggaacattgtattagtttcctgagtttctttaaaacacaactgcttcgtttcctcccacagatactatggtattagatgttttaattgaattacttagaaaatatatcgtttagcttcttaatataaaactaattttaatctgagaaaatttaaaaaagtattttctcatccttaaattcttttttccattgttttccaatttagccctattgtgtctacaactcagattttaatcttttttttactaaaacaaatttattatttaaaaaaattaacttttctttttttccttataaaagtaacctacatttgtatctttagttctaaaattacaggtggccctaattcttttctctttggtatctggagaaagtgaatgcaattatgattagcagaaatgcttttttttcaattgcacactttatttagtggaaacaaaagatgcatgtatgattcaacttcacaaaaggaaaagactcaaagcaacactggtgatgagccgtttcatattcttaggtagacgcaagatccccgtacttcctgaaaccttatctaatagtaaaatattttctgactgtttctccagtcttttaccactcttgtcaatggatacacaccaaatacataaataatgtatgcaggttcattttgggtaccatctagctacacagcccagtggagtggttgagtacaaaagccagcctagcttgaaatttcaagctttgacattttctagcttccttgggcaagttacttagcctttctgtgcctcagttttcttacctataaaatgagaataatgatagtaccctcataatagggtgattatgaggattgcatcaggtaactttgtaaaggttctggaacatatagcaagtactatataaatgtaatacgtatgcaattaaaataggcttcaagatacacagattacagataaagaaatagctgtagacagaacatatcactttattcactccacattattactttttacattttcaggcttcttactaccaactaacagggtatattattagttctcttgtctatgacatctgatataccttccttcctttcaaagagtgccaaacattttaaatgatacttacatttttctccaatgtatgctgcacaattaagtagattgatagatatttttcatcagcacaaagagaggatcgcaatacatataagactttatctctgctgcaaaatataccttgaaagaattacatgtataatgaaaataaccctgacaatgccaactttatctgcgaaatcactggccgttgactttctgtgaaagagttaagtacgttgctgtatcaaatattcagttactcattaattaaagtagaacaaagtcaatactttttttgttcagcagattaaccaaaaactaccatgtaccatgtttgcaatttatattcatcctataaactgcatatgcattaaacatttccatctggagccccgatgactgtttttctcccatctcatgcttgataagctgttactgattagacagggaattctgaagctgttgaaagcacagatttttttaaagctctatcaccttggtattctttatctcttaacagaccttgcttgatgcctgcaggttccattttggctgcaatccagataggaactataggtcccctggccacgatggtctaacacagacaacgttatttggtatctatctaattattcctccattaaaaaaaactctctatctagtctaatttctaatattgaatttttcttctttaattgtctcatttaatttttttttttttgagatagagtctcactgtgtcccccaggctggagtgcagtggtgagatctcagttcactgcaacttctgcctcccagattcaagcaattctcctacgtcagtctcccgagtagctgggattacaggtgtgcgccaccatgcccagctaattttttttattttcagtagagacagggtttcaccatgttggccaggttggtctcgaacttctgacctcaggtgatctgctcaccttggcctcccagagtgctgggattacaggtgtgagccactggcctggccgtcttatttaatttgatgtcaaaccttaatttagtctgtgacatactctgtaatataacataactagcatattttggtgcatggtgttttctaactattgttataaagattttacgcattttgactgatttaatcctcactaactgtgctacgaggtagatgttattattatccccatttagtaggaaaactgaggtcacagggaggttgagtaacacagctaggaggcagtagagctcagccaggaacccagagcttctaattctgggacctgtgctacctgccaccacaccacggcctgacagagctgtcttcatcccaccgttagtgggacatgcagtttgggatgttgctcccgtgaaaaacagtattcaaaagacccacagcctgactccttctttataatacacaccctggatagcattaggagatatacctaatgctaaatgacaagttaatggttgcggcacaccaacatggcatatgtatacatatgtaacaaaactgcatgttgtgcacatgtaccctaaaacttaaagtataataataataataatgataataataataataatgctaataataataaattaattataatacactccctgcctgactccttctttataatacacaccctgccactttgtgctacctgataggaatcatttaatagattaaaaatggagtatataatctgtgtgctattaataattaaaaacaatgacaacagcaaacacaataacaatcccatagctgctgtttgttgagaatccccacgtgtttgtcctttcacagtgtctgtaagccgcgagacttactgtcatgtgtcatcagcacctgatgagatattttaaatatcacttcatactgagactcagaaaagtgctctttcttgtaaaagggcacaaagttagtaagtagtagaaccagaattcaaagcctagtccttttttttttttttttttgcatagccatatgctctcttatatactaattggttagaaccctctagcttgaaagcaactcagctagccagcaaatatccccccaattaggaggtgactgatgtcataaccagattgctccctgttctctttttgtttgctataaacttgatcctttggatttgtgcatattctaaagatcaccctgtcaccatgcctggaggcaattaagtataagggagtagtgtttcaagataatctcccactgtgaaaacatgggaataattatccaacgtaaacatgtcatttcttttctaaattacatggattccttttttgcactttaaacctggattatacatcttactcaacttcgtatccagacccaggcatataccagccaggtgtatagcatgaacttaataaatgttgattaagtgaagagacttaataattaataattaactaatatatgatgaaagaattttaaaaattcacttgtttgtccatagtttcatgtagtcaacaaatgcaatcaaaaggccaatgatatccatgaagataacatttattttttaactaaaatcctatgttttctgtaattgtatggtagcatagaattttatatatataacatacattcatatataacatatataacatgtatatgacatatatataacatatatatctatatataaaataaatatatataaatatatatataaaactttgtgtcatttcaatcctgagctattttttatttttctgcctcatgtcaattagaatcagtctccccctttgattccagtcaattcaaccaccagtcgttttcctacctcttcctgacctcctcaccaatattgactctggctatgtatcctgaaaagtgagaaagattgaactgatatgaatgaaaattagaataaatgtaaaattcacacataatattgtttatttctcctcatatggtacacaaatatacacttaaattttatttcatatgacatcaacatagtgtatattcaacaaaatataactcctgatcctgtcttaaggagtatataatctaatgaaagattgaacacacaacagtgctaagaaccaacagctatgaagaaggtgcaatattcacaaagaaactgtctttgtgatttcaggtagtgctccttagtatcggattgttgagccacatttgaaagaatgattgtgaatttatgagaacatacaccaacgagtggacagtgggatgcctctatccagcaacacaggccactgtctcatagttcctcatcagctgctacaggattcactccaaatttcactataggacctgccagcttgtatttttgtctcttgagtctacgccaaaaccaaaactggcaatcccaaccactcatcacttaaaaactaagagattcttttttttttttttttctgagacagagtctcactctgtcgccaggctggagtgcagtggcgcaatctcagctcaccaccttctccgcctcccgggttcaagcgattctcctccctcagactcctgagtagctgggactacaggcgcaccaccacacccggctaatttgtgtgtgtgtgtgtgtgtgtgtgtgtgtgtgtgtgtgtgtgtgtatttttaatagagatggggtttcaccatattggccaggatgatattgatctcctgaccttgtgatctgcccacctcagcctctgaaagtgctgggattacaggcgtgagccaccgcacccggccgagattcattaatcttaaaggcttggtcaaagagcaagtattaaaacaggaatgtcactttcagtttcatcttgtgccgttggccattcataccttcctgctacatctgtacagtcttccacgcccagcttgtgcttctagaaggaaatcaaatgagacgatttgtatgctggtgctctgaaaaggagggagctagaggatcaataggctctagctaatagttttttggatccgaataataatgtttatagaactggaagactgcagtttagaatggtccttgatcacttattcattggtctgttcaagcaggaaatacaatggtttcattgagtgctaggaaaaaaaagaaaggtaaagggtgttgaattcagccactggctgggctttgaccagaagggaaaatcagggattggatgctgctatttaaacattagcatttacaaattaattggtaccacgaagaaaggaaaaagaaactgaaaactgtgattaccaaagaatagtttaggaccaacatgctccccttttctttacatttgcttaggccttttatcgctgcctctttgaactgaggctgagattcacttttttgtttataagggcttacttgttactgagaacagagccaaaatgggcttgcagcatctgctcataactcattaaccagaacttggtcgtgtgaccaccaacacttagatgcaaaggagaatagaaaactagtctgagttctgtagccacgtacccagctaaaagctgcaatttgtatcactaaagtaaagctcaccttgcgctttcattgaacagctagcagtctctgccgtgcgatttacttcctcgcccctagacaaatggaggagagaattcctcctcttctgtgctttgaaagatcacaattgtcataatttttaagaggaaatttaaaatatacatttaaggaaggtttaatctttagttcttactaaaaattctgatctgactcaaactgattcaaaaagcaaggaaattcagtttcctatatgatggaagtgtcagggtggaacagatctcaggaattagttgacccactgacctgatgctttgggagccatttgggagccattccggcatcactgcgtgtcctgagcctggctcccatcttggggtcaagatggccacaccctttcagttctcacagacacacactgcaatttccagaggcagggtgaggccatctgctctgccgccatgttcttctcaggaatcggcggccttcccaaaggtgttctcagcacgcctctcatcctctctcgctgtagctgagtcacatccccatgtttcatccaagtagcggcaaggaaatgggattgcctcggttgacttggatagttcaggactggctcccttgcagagaaaagagagtcgcttcccttgaattatatgaggactggatggacactggacacccaatgagtaaaatcaaggcttgtctgaggtcaacagtaacaccaccaaaagcaacaaagaggaaatggatgttaggtcggcaaacactgtctgctacagttcataacgtagtttcgagagccttcaaaagtattaatgacaaactaacgtttggaatatggggaacactgtattttgcttctagtgatttggagaagtaggcaataatgtcgctcacctctactaaatgtatattgtaatgtgtacattaaatttaaaattgtacaaatgatttctcatcctcaaaagactaactcgttttcaggttaaaagtaaacatcattttatatatatatatacatatatatatatgtatatatatatatacacatatatatgtatatatatatacacacacacgtctataatgctatatataaaaaatatatctgtatgtgtgtatatatctataatgctatatatacatatataatacatattatatatgatacatagatatataatgtattatatatttatatagcatgtgtatatacatatatgctatatataggattatatatgtgtatacacatatatgtatatattatatatacatatacacatgtatgtacatattatatacatatacacatgtatgtacatattatatacatatacacatgtatgtacatattatatacatatacacatgtatgtatatattatatgcatatatacatatacacatgtatgtatatattatatagcattatatatagcattatatatgtgtatacacatatatgtatatataatacatatatacataatgctatatatgtatatataatacatatatgcataatgctatatatgtatatataatacatatatgcataatgctatatatgtatatataatacatatatgcataatgctatatatgtatatataatacatatatgcataatgctatatatgtatatataatacatatatgcataatgctatatatgtatatataatacatatatgcataatgctatatatgtatatataatacatatatgcataatgctatatatgtatatataatacatatatgcataatgctatatatgtatatataatccatatatgcataatgctatatatgtatatataatatatgcataatgctatatatgtatatataatatatgcataatgctatatatgtatatataatacatatatgcataatgctatatatgtatatataatacatatatgcataatgctatatatgtatatacacatatatgcacatagcatgcttataaatgctctatattgtatatacatataatactatatataatatataataatataataatatatacatgtatatacatatgtacatatagcatatataatgctatataagcatgctatatgtatatatgtatatacatgtatacgttataccatatactatataatatatagcatatataagcatgctatatgtatacataatgcatatataatatataatgctgtatgataattatatataatgtatataatatgtgatatatgatatataatatgtaacatgatgatgtaatacatataattttatgtattttattatatataatttatatatatgctatgtataggcacacacatatagtgtttgtgtgtgtatatatatgtagcatgaggttgtgagctagtcaaactttagtcatatcatttaatatctcaagtttacattgatgaaatatttataatgaaatcctttgctacccactaactctgagaggtttgagtacttataaaatcaggcttatttttttctcaaagttgagaaaagcattttttctccaagttagaaaagcattttttgttgtttattaataaaccaatcaaagctgatgtcttttggtttgagaaaaacaaataattttcttaagaaaagtgtgatgaaaattatagcatctttaatgactttgttctccatctcctagtattgttatctttgtatgtatcccttttgcctgggctgggaaaactgtactgtaggtcaggggttcccagcctccaggccacggacctatactggtccatggcttgttaggaacccggccacagcatcagaaggtgcccagtgggcaagcgaatgttcccacctgagctctgcctcctgtcagatgagtgcccgcattagattctcataggagcactaaccctactgtgaactgcacatgcaagggatctaggatgaacactcatgagaatctagtgcctgatgatctgaagtggaacaacttcatcccaaaacccacccccaagcccaacctgtccgtggaaaaattgtctcccaaaacactggccctggtgccagaaaggttggagatcgctgccataggtgatatctctcctagaaccatacacctctggttttaagagctaaaaacatacagacttattctgtaagtgtaaacattttactgtgtgttacctggccaattcttcacagctgatcattgtatatttttaaattctcttcatgtctcatcgttttattagcgtgtttcttcccattatgccattctgaaatccttttacaagttgtcctctggtccagtgatctggtgatacaaatgattgatagcaataaacatatcatttgcatctgcaacccaaatgtcctgtgtgttcctgtagaaattatgtagctaagacacgcacacgaaagctctgtaagtcaaagagtagcgtcgtgtttttccaaataaatttttctttaaaccttggagcctcattgaagcacaacttgaaatggtagaaaaacccagtggggcatgtcaccaaaagcagtttcctaccgcagcttccaagagaacttcattagtgttttcaacctgaatactaatcaatggcataaactctaaggaaattttaatatgaatatttttaaaggagcattttaatgtgaacgtagtgaaaatacaaaatcatatttaaataggaaagaaagggatatctctgggctcaatgagttttgaaagaggagaggtttgaagaataaatgagtttacagaaaataaacaaaaatatgaaacaaagaagaaaatagatacagagaagcaaaagtataaaaatagcaacatttaaaatttttatctatgctctttttgatacatccacagaaaatatgtttctctttctttttcttttcataaaatttatttttatttttaatttttttaaattacttttttgagacagatttctctctatcacccagaatggagtgcaatggcatgatcatggctcatggcagcctcagtttcctggctcagtcagtaatcccacctcagcctcctaagtagctgaaaacaggcatgcaccaccatatgtagctaatattttttaaattatttctgtggagacagggtctctctatgttgcccaggctggctcaaactcctgggctccagcgattctccaccccagcctcccaaatcgctggaattataagcatgaccacctagtctggccatacagaagatacataatcttagacccccttcctcatgtaacatgtagcactttctctaactatatcaaataatgtctgggaaacagcaattttaaatctttagtatggtataattattgtcaaagcaaaacaagatgaaacttcagaaaagtctagtacagagcttcaacgaattcaagttaagttttacacctgttactccctgatacttagaaaagttttatgcttgcctctattgtgcttagagagaatgttgtggtttgtaggaaaatagacactggtaagtgtaactgtatctgaaatttgcacacttcaccagtgtgtctggttattatctacatggtggaccttcagtgactggaggacctctctttccattcaagctgtctttttattaaccgttctctggggcctcaagttccctctgcagcatttatttccctttgagttaagtattgttcccattattgtcttagaaacgttaagtatcattagatacagtatctcattgtggattatgttatcagattctttgcaatgtgtctcttaacaaaaggatattgagtggcagagtggggagtggaaaatcactgaaaaaagaggacaccgaagagacacatgaattttctttgttctgttttttttaaccagtggtcatccctagcaaagatgtgtgtaagtgcattaaaaacatttgtgtgtagcgaaagtggtgaatttctctatgcaacatatttaaaagtcattgtttgtacctcacttgcatggctatttggccctataaatattggctcttgtctaatgacattttctatttcactttttaatagaatttgctgtaaaatggatactacagaaacagcattttattttcattcttggcaaaatcatttccacccaaagtgggggagctcctaacaatggttgcttctactttatttataagaaaaataatcaaggccgggcatggtggctcatgcctgtaatcccagcactttgggaggccaaggtaggtggatcatatgaggtcagagtttgaaaccagcctggacaacatggtgaaaccccatctctactaaaaaatacaaaaattagctgggcatggtggcgcacacctgtagtcccagctacttgggaggctgaggcaggagatccccttgaacccgggaggtagaggttgcagtaggccgagattgtgccactgcactccagcctaggcaacacagccagactccacctcaaaaacaaaaaaacaaaaaaaacagccatcaagcagacatggtcatcttttgcctgtagtgcaacagaactgtttaaaacacagtttaggccttaacgtggaaattcttgcttgcagcttccactaatcaatctcgctaacctcaggactctaactttcattttcctaattcacatttcaaaacctttctaaatttcaagagggaatgatttatcaaatcatctaactctttcaaattttggagaaataaatctcacttggatcactaaaaataaagaaaaggatcactatggaataatgaccctttaatagaaaaagaaaatatttctaacataaatattggagcttttctgtggtagctgtcaaatccaggagtttggaaattggaaaactagaaattagaaaagaacaaaaaatagatgttttaaagttgcaaagctccttttctaaccttaaattttgaggttacaatcagtttaaattttaaggtttaaagccagtttctaaatcttaaaactatattatttacaagacaattcaagtgacaaaatacatagtagtcagtcataaactaaatcagattctaaaatattatgtcatattatgaagcagtatgtaactaaagggctggtgattgagccctgaagggccgtgtcaggtcttctacttgttttcaaaatcaaggctgaagctgggtgcagttcccacctgtaattccaacactttggaaggccaaggcaggaaaatggcttgagcctacgagttcaagatcagcctgcaacatagagagaccccatctctacacaaaaatacaaaaattagctggacatggtggtgcctccctgtaatcctagctactcaggaggctgaggcaggaagattgcttgagccccggagttcaaggctgcagtgggctgtgatcataccacttcaatccagcctgggtgacagagcaagatgctgtctccaaataaataaatgaaagaagaaagaaagagaaagagagaaagagagacagagagatagagagagaaagagagaaagagaaagagaaagagaaagaaaagcaagactgcttctcccagcaatttgttaggatcctggctgtccgcccaagatgggttagatgaatggctgacaaggaatttgttttctaccactgtcacatgggagctacattaccccagctgttgcccctgcagagagaattatctgtatgttccgtgtatgcatcccaccttttcaacatcttgtagcagttccacttgagaagtttcaagtgatcggagtcctggccctcccacttcattgtctccataatccctagcattgcacttctctgtttgtcaatgtctataaatggtctctttgcaaggcttctcatgctatgtataaaacctttataaatagcatccactgcgactcacacagagccacttggaaaaacattcttgtcttgtttttctcacatatgtctaaaattttacactttttcctttatttttacttgatttagctaatttattcttaaccacagcattgtggtttagtaattgagacattttcttcattttgaactccagagtctcatcaactttagtcatgaaatacaaaaattggaaataagtctttgttataaatctaggccttgggtaggagttaactaagtttggtagtttgaaagttatagaaaccaaagtttacattgaatacatacagccaaccaggtgttatgacactgaattcctatattcaataaatattagttgttttctgggtggcaaattcataagctataaagaaattctggcttatattatgctgatgtggacagaattacagatgatggacttgaaggtgttcatataagcacccgtcctcactctgcaccaaaggtgtctcagggcctagtgagggggcagtgccagaagcctccaaaatacttgtttctctgaaatgttcttcagtacagaaagcagtggaagcagagtagactgaattatgtattttttcagctttcactttatgtctctacagtttgctctcttcctcactggggagaaaataaaccagctacctcagggaagtcagcacaaatacagaacagtaagggagggtcccatagtcaccaagcaagacgcccaatttgtcctaaatccattcatgcatgttatggtaaaaatatggccctgttctccttccaggcatgagtcaatgttgctaagtgggtggattagaatagtcattatttcaaatcaattagacaaatacttaatatgttgccactccagctactgtgaaccagatcttgatttagtaaagaagactgatatagaacatataagcgtgtgtgtgtgtgtgtgtgtgtgtgtgtgttacaattctctggtatttacaacaagggctgtactgttgtgctaggctaaatattagcaaaaagagagggaaatatgacatgttttacctgaatgggattaaatcttttattttacacttgctcaaggtcatacatttattcttactggtcccaggtaactgcagccatgaatatttttcttaatttattcagatacttttttaatgttctagaattaaaataatttaatcttcagaaatgtgtatctcttttagcattatcaagcaactaagaatataagtaataattataaattgttgtgttagattttacttctaacaccttccaattgtttattaaaacaattgatataattattctttgtaaaaattaacaatattgacaattatatgtggtttttaggatgtaatatttttgctgcaattggctaattttgatacttttcttacataaattttaagtgattgtccagtcacccgtgaaagcgtttcaatgtctgtggattttatgttttaaaattgcatttgaaatagtccaattcataatgtgctaaaataatcaagaaatgttctctaaaatcctgaattcttccatttaggatctaacttaaaattcaaaattaaaaataaatgaaaaattaagcttgggcaagtcaatcagaataagagatgcttaatttctgtagttgaagggagaaaattaaagtgatgtcagctttctcatgacccaagaagtatgtagttgaatcaatagcatcatgaacgccccatcggatgatcatggagtctcttagattcctcgtccccttccttctttccttaaacagacccagaaagtgaatcggtttcctcatgggcaaataaaccaagcctagatcctgatctctgggctcagagccaatgctcttctgtatcctgatgggatggtcatgatgctattgactcaactacgtatttcttcggtcatgagaaagctggcatcactttaattttctgaaaaatgctctgcctcagcatgctctttgtcgtgccaacccttggaatgaaggcatgtgctatgattctaagtttatattaaagaaactcaaccatatacttttttcttttttctttttttgagacaagagtctcgctctatcaccaggctggagtgcagtggcacgatctcggctcactgcaacctccgcctacggggttcaaaagattctcttgcctcagcttccctagtagctgggactacaggtgcgcaccaccacacccagctaatttttttttttttttcttgctctgttgcccaggctggagtgcagtggtgcgatctcggctcactgcaagctccgcctcccaggttgaagccattctcctgcctcagcgtcccgggtagctgggactacaggtcccctccatcatgcccggctattttttttgtatttttagtagagacggaatttcaccatgttagccaggatgatctcgatctcctgacctcgtgatccacctgtctgggcctcccaaagtgctgggattacaggcgtgagccaccgcgccaggccattttttgtatttttaatagagacggggtttcaccatgtcagtcaggatggtgtcgatctcctgacctcgtgatctgcccacctccacctcccaaagtgctgggactagaggcgtgagccaccactcctggccaaccattgtcattttaaggacttaaccaccctactataaatagcacttgtaacagcactatatctgtcatgccttgggaaatgcataaattgttaagattgacctaagctgtaaaaatgcaggaagttgaaacacagatgtgtaggcactgtatcaaatgtatcctgtttccaagttcagttcctttcccaatgaccccctcaaaaatgtttttctaaaattaactggatttgtgatatatctgtccttatattttctgaattcaaaataatttccttcttgaagctacagaattctgcaactttgcaataggtttctaatatttccaatatctcaggcctttattcaaaagaaaatgccagatcttttcaagagaaaccctgaatttatgttagaaagagaaattcaagctataaattgtacaaaataatatctaaaattcttatagtataagaagtcaacttcaagcttatttatagctttaaagtaatttagggtttagagagaagagagattaatgttcctattctagtagactcaataaaatatttgtttttatgttgcaatttttaagcagaatattttctacaaagtcaggaaaagtaggcaatcatcaaatagctttaaaaaattctgagcttcaccatagagggaatgtaaattgaaaaatgtgatttggattctgtgattctttaggaatctcagattctacatacctctgtactacaaaaactaaacttattgttgatatagtggttagtgaattttaataattaggtatataaaccacagtgtttagttgcagcaagcatgtcaggaatgagtgattggcctttgtatgttctacttgtaagttgcatgtactaaatggcacgtccatgctgtggaaggaaaaggggtatggccgggcgcggtggctcacgcctgtaatcccagcactttgggaggccgaggcaggcggatcacgacgtcaggagatcgagaccatcctggctaacacggtgaaaccctgtctctactaaaaatacaaatacatatatatatatatatatattagccgggcgtggtggcggatgcctgtagtcccagctactcaggaggctgaggcaggagaatggcgtgaactcgggaggcggagcttgcagtgagctgagatcgcaccactgcactccagcctgggcgaaagagcgagactccatctcaaaaaaaaaaaaaaaaaaagaaaaagaaaaggtgtacgtatgtcagatgatacaatgcagcattatacttatttttgaagagatttgctgtttgttaatcatttgcctcaagattaaattaaatatttattatattctgctgacatatatgtggtagtttgaaatggttctctactttcttgtgtaaaggtaaataaatgcaacgtaaacacaagcagtcttcattattgatagtaattatgtgctataaagttgccaggaacactgatttagcgaatactgaattatttctcctaggggaagtataggtttaggtttcagtgagcctctggtcactacagtttttgagaggacacaaacactcataccgtagcgttctgccccaaaaccccaaaattcacacaattctcacacacaaaatgcgtttattccatctcaatagccccaacagtcttaattcatttcaacatcaattttaaattctaactccaaagtctcatctaaataacatctaaatcagatgtgggtgagactcaaggtgtgattcatccagggcaaactgctctcctgctgtgaacttgtgaaatcaaacaagttgtgtacttcgaaaatacaatgtgggacacacatagaatagacattatcactttaaaaggaaaaaaaataggaaagaagaaaaaggtaacaggtcccaatttaaagtcccaagccccgaatatcctgccacctagatggttctctgcagtagccccacctccatggtggctctgtgcctgggtcaccagctcacggctctttcatgctagaatcacacactggtggcttctaccggttttgatggcggcaaaacttggggcagccgcaaccccatggcacctctatacattgccctagaagggactctgtggagatcttgcagagcaacagatctcttcctgagttctgcaacttcccagggcatcctcatttctgtctgagacctcatcggaatggcctttatcacccaaatttctatcaacattctgttcacggccacttaggtataccttaagaagattgaggttctttctacagctctcctcttttcttcttaagtcctcaccagaattacccttaaaggtccattcagaataatgtagccttttattattattattccttttttttttttttttcttttggagaaggagtcttgctgtcacccaggctggagtgcggtgccgcgatctcggctcactgcaagctccgcctcctgggttcacgccattctcctgcctcagcctcccgcgtagctgggactacaggcgtccgccaccacgcctggctattttttttttttgtatttttagtagagacggggtttcactgtgttagccagtatgatctctatctcctgacctcgtgatccgcctgtctcggcctccgaaagtgctgggattattattattatttttttaaagcatgaactttgtaagccttccagcctctgcccatggccatgctccaaaaatgttcctacgtttttagtatttgctgcagcaggactctacttgagtagcaattttctgtcttagtctgtttggcctgctataacagaataatataaactagatagcttataaataacagaaatctaattttgcaagttctaatgtctgagaagtccaaaatctaggtaccaagagatttggtatctgatgagggtccactttctggttcttagatgatgccttcttgctgtgtgcaagggcaacgcatctttctggggcaactttattttttttgtttttgtttttagagacagagtcttgctctgtcacccaggctggagtgcaatggcgcagtctcggctcactgcaaccttcgtctaccgggttcaagcgattctcctgcctgagcctcccgagtagctgggactataggcatgcaccaccacgcctggctaatttttttttttttttttttttgtattttcagtacagatggggtttcaccatgttggtcaggctggtctcgaactctttacctgaaatgatcctcccacctcggcctcccaaagtgctgggatttcaggcgtgagccaccgcacccagcctctggggcagcttttatgagagaactaatttcattcatgaggacttcaccatcataacctaatcacatctaaaggccccaactcctaacactgtaacattaagaataaggttttaacataggaattttgggaggacacaaacattcagaacatagcagttaataaaatatttgtaaaatttatatatgtatatatatatattttctttttagtaagttctatttcaaatctcagtgaataagtttcagatgtatgttgtttcattgtctttcattgtttttcttgcttctttctttttttcttttgaatctgacatcactacaatattgatttttgtttctaccttcattttataatcatataccttaccaagctacagaaacgaggcagaaaaacaatttccattttatttcagtacatcttcctaaaactggatcctggtttgcttagttgttattaacaacacttgatgagctattattaattaaataattatcttttatctcaaatgtggaggttcttgttcctatgaagcccacccttccctttagcagcagcaacaacaaaacgacaggcagcttctcccttcatatgggtcctgacagatgagccttttggacccctcgtaaaagtagtaaatgcacctttttcttttatttacattaacatttgttttttcttaaccatgctctctctattgatttagcattaatcatgttgtttcctacagaatttaccttttgaaaaataaaaacacaggcagatacatactggttattcacaggaaaattagggtgtaattattagcagactaattgtttcagatttactatgatccatgaagtcttgtatttgacagcttaaagaactatgtggccaagaagacataaatgtgggccagtagctagcagcctctgcataatacaactccaaatcaactggtgaacatttaaattggagtaatttaattaaaaatttgaatttctgggcttccttgaaaatgtattgtttgaataacaccagcattcctgcatatcataagttacctccatgtgaatagggacagccccttttatccacaacatatcccaaacactgcatgaatcctctgccatcatggctgagcttttaatctcttcattagaatctctttttggttgattttctaatcagggaaatatgtctctcttggtcatattgctatcaaaagtaagaaagtaaaagatcaatagaacgacatgatatttataaccagccagcatcacacatttgtataaactgcttgtcttctctgagcattgaagttgtgacttctaattttagaagctacaaatcattttatctctgtcaggactggttctcgccacaagttgtgtaagtactgctcatttatgaaaataaattaattcaacctcttcttcatggccccagtgagtgtgcaggtgtcatgaagtaatggacagcacccaagttcacagtgaatcagattccctccaatgcccaaatcactgaggtgtgttcacgagcagaccacagagtactgtttttagtgttttaccagacaggacctaactgctctagcaaagaggaaagagaacattatctcacaacatgtgtaccttttgagctttactaagcctattttatggttgaggtaaaattttcacccaaaggtatgtgaaatcaaaccaaaattacagaattgttgtaatatattgcaccatatgcataacctcaaaagatactgcacacatatgtcccaatctctcacaaataagagaaaatcatttgtaccaactaatttagctttcaggaaagcacagaaagtaaaataaataaaaatgacattttttcctaatcacctattacatattgctactcgtcctgacaaatttgtaggggttgttgatggatgtatagcgttcagaacattaatgattttacaagtttaaagtaatggtgtttgttcatgtacatatgtgtggatgaatagttgtatggatggatggatgatgtattagttggttttcatgctgctgataaagatgtacccaacactgggcactttacaaaagaaagaggtttaatggacttacaattcctcatggctagggaggcctcaccatcatggcggaaggtggaggggaccttgaacatggcggcagcaagagaaagaatgagagccaagagaaacgggtttccctttatcaaaccatcagacgttgtgagacttattcactcccactagaacagtatgagggaaacggtccctatgattcagttatctcccaccagatccctcccacaacacgtgggaattatgggagtacaattcaagatgagatttgggtggagaaacagagacaaagcatatcagatgaatttgaaaaggatagcgcatagaaattttggatagctaaagaagtaacaaactaagattctgtgtaaaaattaagatggtgggaaaatgaattcgaatatgtagcgtgtttcaaagaggaatttttgacattttgtttttgttttcagggtactgtcaatttcattttaaattctgaggctttgtaatattggatttatcatacacctggagtcagccacaactgtaaattttgatctgaaattcttcagttagtataaaatccctaactgctttgaaattctgtgtagtgataatgcatcatctgaatgctttgcatcctttaatgacataggtatcttctgaattctggctttgcgtaactgttgccaacactgtaagaacatcagctcgtttgaggctgggtctttgttctctctgtttctgggccctttccacgccctttctcctctccctcactagcacaggagttatctttccaatgcaaacctggacatgcattttccacttagaataccatcattacacacatgggccctcagcttcctcagggagcattaagtctttaatcttccaattctcaccctgcacatgaattgtaagccttatgtagtaaagtcacaaacaactgagcgtttttagaacagtcgaatgtgctattcccctatctgtctgaatttatcttactcagtcttaattctcttttcactggaaagttcctgtattgttttttgtttgttttttaactcaccccattacttccacaaccccagtcttgacacaatgttatggatgtagaagatacttcagagtccagaagttgatcttagacatttaataatggtttctaaaatttgctttaaaggagctttttgcaggtctatggactaacttttgccaacaattcctaggcttttgtttgatcaaaactgatttttcacttcttttctaagatatggtaaaataattttctgtactgagtgttttctaatatagtttattagtagaaaatttgagacacagtaaggccaacatatcagaaaacacctaccgtgaaaagatactaatattttattactttattaatactttatattattgatacgatatttataaccagccagcatcacacatttgtataaactgcttgtcttctctgagcattgaagttattttattttatataaatacaattattactttattaaaatacatgacatttatttactttattacttttattactgtggcaggccatcccacagggtgtagaccagaggtagggagctcagggaagcaccaggatctgtcaggaggtagaggggatgagggaactgtgggcaaggtcctttattgtagtttccatgggaagggataggtgcagcagggtaagcaggcttaggtctggctaactggaataattattccagtgagttctggggcacagaggctgatcctagttgtcttgtacctgattctgggatgaatagggaagacggatcatggtccagaagagagaaagctggataaaggaagcagttggggtgtggactctggattgattgctttatatttggaaagtgtgcttaccatctctagaaattggctaactctgggaagaccagtccctctagggtcagcaaggccccagatgtcaaagcattggagcacagagattaaaatacatggtcaggatagaggggaagttgaagccatggcagctccaagaaatgacacaggtggctgccattacccctgctcccaccctccacagctaccagcctccgtttactcatagggataattgattttttcctcaatattatataaattactatgaaaagagtgcctaaaaacaagttgcttatcactatttgtaactaaactgctatctttatatagtatcaaaatttggacagaacactgacaatgatattttaaatggaattagaaggtgaactgaatagagattttaaaaattccgaaataaatgttgggaataatttaaatcaaaagacattctgaggagtttcttgatgtctggtttctttcctcatctgtgtagcatttacttaggatttataattctagatagtcttttcgccagcaaaaaaactagattttgtgtggtcaaaagttgtagagctattttcagtaaacagcgaaggcgagaaggcgagtctaatttatttgactttttgatttacaaaaataaataaaaacagcttccacatggatttcctacaaatagattatatgctaattttcagaaattgttattatttctgcattattggatatatgagagttataaccctgcttagaaatagatcactctgattttctgatatcttgtgggtaatgagtggatgagagcgaggacagaatataggtgtgtgcatgtgtttgtgtgtatgtgtatggggggtgtatgtgtgtgtgaatgtccattttgggaggcatagggtacctcagtgggcttttttgtctcttcacgttgaataatgtgatatctaatgctataactttaaaaagttactaatattttcctgtgtctgttttttgtgattcattgggccaaccagatgattagccatttatggtttatcatatatacattttttatggagtaagtcaaaaattaaaatatgtaggagtcaattgatcttgcctctgaaaatcaataaccatttcagattagcatacaatgactgctctaaaaggtgtttaaaacttagtgactttaatcttggaatatgcaagttcctcattaatgcatttaattcaaaggaaattatatattctttatttaaactcatacaggagttcaatgttttggcctttgacttataaacaaataactccagtgtaagtataataaaagcatgttatgtttaaaccatttattcatatcagacactcatagttgtaagagttgtgtagccttaaatcatgtataaatctgtactcttagaaagtaaactgcacggtcacaggcatagtttagaggggaaataataacacagtggaattctccttttgccttgtttcaaacctaaatgatgtttcaatcagtttagaaagtgtttatgctgccaggaatccaaaacggaacaatccaaagcctgtatcctagaagagcttcaagtccacaggaaaaatcacgcccaaaagaagataacttcaatataatgtgagaagtaaaatgataaaagtatgcaaggaactaggggacaatagaccaaggctgtttcacacaggcaggctttctagtggtgaggcttatctgaggcttagaagatgcctaaaagtaaactagaacaagaaaaatggctgctcactgaagaaagtgagcatagcccgaggaaaggtgctatgtgaagtttgcgaggaattcaatccgtttaccatcaggagcacataaaaagaaagatggcactaaaaatgagcctggacgggaaggcaggagctatatcattgagggtggtataggccacactgaagaacctggcttttgatcttttttggaaagagtttatttcaaaaaggtctttccagcttctgtgtgatggttttaagacgggagagttccctggaccccttcacgggacttgcaacaagggtgtggctccatttctcgctcaagccccttttgggaggaggagcatgcaggtgagctggagcgagcgcttttgggccctggctccacggcagtgtctaggggtgttgcagtgctcttttagctttgccatctgtggatggttaagtgttaaccagttcagtggagagtcagggtgacagccttttataccctgtcctcttgatacgcaggtccttgtctggcattcagaaagaatcaggtcacatggacttgaaggatggtgaatgcagggattttactgagtgatggaggtggctctcagcgggatggatggggagctggaaaggagatggagtgggaagatgatcttcccctggagttcaaccaccccacggccattctcctatctgactgtccccagccaaacccctcttgatgtacagacgcttcctctcttctctccttctctgctgtgccgctcttctgttctactgctcgtctgttcatggagcctggggtttggatttatgagtataggatggggagcacggcaggccagggtggttttgaaagaagcaacaattgggcaggaaaacaggataactgttctcatttagcaccacggtttgcgggcttgagggcggagcctttgccggggaaccaccctcttgtctcctgttcatatcagttggatttaagagaaataagaccaaaggatgagaattggtcatttaacaatgttaatacaataggcaacatgtgaggtaatggtaggctcatgatagtacatataaaagtaaactatgagttttaaaaatatcaaagtgaaatatcaaattgaaatatcaaatttcaattaacaatcattgcacctcaaatgaactcattggctatatgatactgccactgcacaaagctctatatttcacaggtcttggaagtcgctaaatgtaggtaggcaaaaagaaaaaaaaaaaaaaagaagctcaagaaagttccagatctctggcttgagtgactggataatggatataataaaagtagtggggcccagagaaagaattatatgttgagcaggtagagtgagatgtgcctgtggaatatccatgtggatcagccttccaagttactggattggaatctaaatggtatgcagaaatgaaatcagagtcctttgatattgttgtcactgtcctagggaatatcaagcactgaaggggaaagcaacatattttaagcagaaatattgcacaaactgtgagatgctggccttcaggaaagaagagccttgaggttttttgttttgttccattttccccaaagtagaagtgattttcagattctatctctagatcatttttaaaggatctggagaaggctcatttgctactattactctaaattagctataatgacattttgaaattattttatctgtttaggtttatatcatagatacattgaaaaaaagaaaggcagtgggttaggaggaagaaagtattcagataaaagcaatgtgtagatggaatgagattgagtccaccagagttgtgtctgttctaggactgagtcaatttaaaataatggaatacattcttgcccaccaccacagctccccaaaagtaacctaatgttaccagtcttttcatctgactattgaaacctcaagtatatttgtagttgtagcaccaagatgggtcagcgagattcttgaaatttcttccaatctagtgactctaattttttaatgaagtatgaaataatagtgtttattataccttaatccaattaatagaaatatgagtgacaacattcacacattctacaaatatttaataaatattcactgtttttcaggcactgttttaagtgctgggctttagaatggaacaaaactaagtctcagaggagatatgctgtaaatatacaaacatcaatgtatcaggtagagataaattccataaaaatgaataaagctgcgtgaatagagaggaggtaaagttggcagtcacactttttataaagaatgatcaatgtatctaaaatattgacatctgacaatgaaaataatacacagatttgcatgtgtgtgaaacttgcaaaataagcaaattctatcttctagtatttttaaacttcagtttcagaaatgaaatgtatttcaaactcttgaagtgacttggtatttatttgcataaactatatagtattcgattctgtactaactggttaatatacatttttactatttttttagattcatatgctttatatgtatttgagaaatatatatgcttttacaaaatttaaagttccaaatttactagtttttaattagtttattttttataaaagaagtctttaattttgtttccttttttctctaaaaatctatataattttttacctttattgaattattatataattgaaaaataaaaattgtatatatttgagatatatgattccacaactctgtgatattctccccaaatatcaataatgcagtctagtcctaagaaaacgtcagacaaatccaaactgagaaagattctacaaagcacctggctggtgctcttctagagggtcaaggttatgaaagacaaggaaagaattggaaactgttgcagattagaagtgactagggaggcatcataactaaatgcaatctgagatcctggattgaatcctagaacagcaacaaaaaagtattagtgaaaccctggtgaagtccaagtataatctgtatttgagtgaatgccacttaagttagtattttcattttgacaaatgtgccaggttatataaaatgttaatattagaggaagctgggtgaaacatatgagaattctatctttccaactaccttttcagcttttctctaaatctaaaatttttccaaaataaaaagtttgtgaaaataaaaacaaaacttccaccacaatttttattgaagaagttggacatttaactaatggtacatttttagctaatcaaaatcctgttttagaaaacaaaattatgaaataaggtttaaaaaatgtacagtaacaaaaatcaaacacaaactatatacagtattatccatatgtgtatctatgtacatacgtaaagattctttatatgcaatttaaaataatcacaaatagtatattatcattggttatttcagtaaaaaatgaaataatgccttttaaattttttttctttaaacctttttgtttctttcggatcccctataaaagtaactgaaaacatttgatggggaaacggtattaaaagtaactcttgaatatttatttgttgatatgctatatttacatactttttaattttttcaaataagtagactacagtttcaaattatatattcttttataagtgtcttttattaagattaataaaaaattttaattaaaccatgcaatttccctgtactataaatattatatcaccccaaactcaaattattagtgtacattttggaccatgactaactgaaatgaaattctccctctctctctcccactgtctttattcttctcccttcctccctcatatatatatatatatatatatatatatatatatatatatatatgaattattccataccttatatagttggatagatatttaggtaaatatgtaaaatgtaggatatgcaccagttaagtacccattaacactggtgatttttcgtggttgggattcactctctactttctatatttctgtattgcttaatttcttttgatcaatagacatagtttgtaataaaatatatagcaaagatatcttttaaaattaaaatatcaaataaacttaaaattttaatattaaaatgtttatatggtaaacacttcttcaaattatcttattcaaagttagaaagtgaagactaaggaacaataaaatgtttttgaaaaagcgttttctaccatgatgatttgatgaattgggcatattaccagcttgctgagcttttgttaggaacaaaattgtggaaacactatgattttgcattcattttttgactagccattattgttcagattgcttaaacagttcaaccatacatatttaatcaccgcatcgaaaacttaattctagggagtgataagcaatcaggataatagaagaaaaaagtggcttgtccccaaataagcacagcgcattattagatatcaaatgaaattttaatctatttttgtaggaaacagagccaaactgtgatggatgttctttacattgttgtagaatatcccagactttttaaagagtacatggtatgtgttaaagtgtaaatatcatagattacttctagaaattttataattttcaagccagctctgagcttacatccacaagaggatgtgctgatattttggaagcatttaacccattcatagaataacaacttttaaattttgttttagatagatggatagataggtgggaaaatatgttgaaactttttctttttctttgtagggaatctaggttacagagaattttgtttcccagctgaccctgacaacttaccatttgtaaagtgagacttggtctacatgaatagctgtccttcctgtttttattaatatcttaggattgtctgaaaaaaataagccatcttcatcttttctgtcacattttctcattgctctaaaagtaagacaggaatgcattaacatttgcgtaaatcattactctgtacctagaactaaatgtgttttgatttagaagaaagtatagaggaggtgattcttgttccctgagtaaaagctcagggaacgtttacttcctgaaagatgaattagaaatattttatgtcaattaaaatatgctaaaggtgtataaaacaagatgtgtctattatttaactgtcactgataggaaattgactgcaaaactactgtctagagttcagaatttactgtcatctgtttttcttttattcacttttcaagataaaaagtatcatcaactgctggattatacgttctcctttatttctcattgcacatgaaaaagatattgccattgaaattcagctgtgacagtatataggattaagctgaagtttaattggctttgcagtgttagcagaagccaaaattaaacgattgattttttccctcatattaaaataaacctctgtgattcacagtctcagagaacagaattctgttgattaagaaagtctttttatgggcaataaagagctgattataagaattaaaatttaaagtttaaggtcatattttttctgaatgttttataatataacattgtacaaacttatttaaaagcataaatatttgagatactagcatagatattttcaaagtatgtgaaagccatcaatgatttgaaaggcatgcttagatttcattttattcgaagtaactgtatgcacaacaattcactttatagaattaagtaaactcaacacaaaaaaggagtggatgtggttctggcagccctgcatctctactgtggcccccaaaggaatttatttggtggtatgctccacttacaaggcaaaccaaagtgttcctcgtggtgattggagtaaacaagtgccagagaactaggacatgaaatgagaaaatatttctctgacaggctttaaactggctattatttttctccaatgtctccctctggagttctttagccagaccttacccaaaacctagaggctagctttgtccagacttgtaattctaaagttattagagctgttccgtttgactaggctttctatgatttaaaaatgaaaagcttacagaaatagtctattgaaaagatttttaacagtgaagatttgatcatggtaacgaagcttctatttgaactcaatatttgatttgaatggttacattgcattttgaatcattctatgaatcgagaatgcattgaccaatagtgcctaataaataatatcatctcatttttatttctggtgtgaaataaatagtagttatcaaatgaatcctcacagtcacatatttctgatcatatttcccattttttaaaaagtttacatactttccttattttaatctattcccctgaaactaaaattagagctgctgtagtcatacgctggatatttgttctttaaactcatatatggataagtgaagatatctgtgtccaatgtagtgaaaaaacaaacaatggtgcccaattctccattccaaatgcaaggaggtaataagaaatttgagacacactgcttcctaagaataaatggtaagaagtttctgaaaattcgattggttgtaaactctgaatactacaacaaggtttactaaaattgtggtgaaatataaaaaccatttaaaaaaaagagaatagcataaaagattacattccaagtgccttcattcttacatcaaagaaaacaactttttgaataaaatatatacttaaaatcatgaagaattatcattaaggaatcaaacatttaagtctcataatctgtttgagatttaaaaattttacgattttggtctaaactctagatttctaagttaagatttgaagcatataacccattgaatttatattactaattttgtaattaaagtaaaatgttcaactgatagagcttttatgagcatttttatcaatactctccataaaacctcctttaaaacaaacacagtaaatcaaaagaaggaatagaagaaaaacagaggactgtcaatttctcaagaaaaacacttacttaattctcatttattctttgcagacacctgttggaagtggatggtaacatacatggctgaactaatatgttatttttttttttgttttaggggctgatgttatcaactttgatggccatgttgtattaccatatagattcagaaacaagaagatgaaaacactgaaagatgtcattgccttgaactttaagacgtctgaaagtgaaggagtaatcctgcacggagaaggacagcaaggagattacattaccttggaactgaaaaaagccaagctggtcctcagtttaaacttaggtgtgttctgactgtcagttctattctttccgttatggatgttcccattaggaatatgttcatgttgctcaattctttaaaatgtaaattataaaaagagctcatgttatatttcaattcatacttaatctataacagtaggtatataatgaaacacctagtcattcaaaaaatatttattaaacacctctactatacaagttactatactagtctttggcctacagcaaggaacaaatagacaagatccttaagctcattaagttcatgacctaacggaggaatcagaccatatagcatttattattcttattttaaaacaactaagcaaaaatgaatgtcttcaaataatatatattatgaaccagttgaacagattaatatgataaagggactaggttaatacgtcctgttcaaaggcaacagggctaatattagaatgtgtggtgaagaaagactgctctggggagaaaatatttaagatgagatcagagtgatgaaaaggaattagccatgaaaacatgagagaaagaagattacataggaagagaacatggaagaccaaaagcacgctcaagaagcaggaaggatgccgccgtgcataaatgctgtgagttattaagacaaaagatgaagtccaagaggtggaaattgcccaaatcctgtgggatcctgcagggcattacaaattgtttagatattatttttaagaataggaagctgttggaagtcattaaactgtatggctttatcatcttattttttatcaagcgcattgagacttctgtaagaagaattacttgtgtagatatgagagtcgcagcagaacttctgcatagtttgggtgagagatagtactgcttgtatgaggtggttatcaggggagatgcagagaaatatgtcaattaaggaaataattttagtggtacattcagcatgacttatgatgggttggatatagcctaagaagaaaagagtagaaataaagaatgagccctaggatttgggcttgagcaccaaatggacattagtgccattttcagaaatagagaagactttaggaggaattctagagatcagtttggacatggttaatttgagctgcttatgaaacatctaagtagaactttcgattatggaagttgatatatgagactgagagaggaagactaaaatggagactaagtaattgtgaatattgagtaggagaaaatgaagaaagtgtagtatcacagaaatcaaggaaacaaaagaggttgtcaactgttgaattcatctaaatgtcatgtaagatgaagacagagaggcaaatattgggcttaacaacatggaggttactgttaatttctactctgtggaatagaaaagacaaattttgtaggtaaaaaagagaatgaaaggcgttaagtaaatattttgactaactagagaggaagaacagttagttaactgttaactagaaagaaagaacatagagaaatgaaatgttggctgctgaaagatctgaactcaaattactgttttatgtggggttgttgttatttgtatttatttatttatttatttatttatttatttatttacttatttttgagtcagagtctcaccctgtcacccaggctggagtgcagtggcatgatctctgctcactgccacctctgcctcccaggcttaagtgatgctcctgcctcagcctcccgagtagctgggattacaggcacctaccaccatgcccggttaatttttgtatttttagtagagatggggtttcaccatgttggccaggttgttttcaaactcctgacctcaaatgatccacctgccttggccttccaaagtgctgggattacaagccaccgtgcctggccctgttgttgtttttaaatggacaagaccaatgtatgtttgtatgttgatgatgtagctaggatttacttaaagctaaagtgaagatctgcaagattggtactggcattcaaaattacagtttaggcaaagtaatggtacctttttcttttttttttttaaatttaagttcatgaatgcatgggcaggatgtacaactttgttacataggtaaacgtgtgccgtgacggttgtctgcacagatcatcccatcacctaagtattaaggctggcatccattagctattattcttgatgctttccttcctcaccacctaaacctccgacagaccccatgtgtgttgttcctctctatgtgtccatatgttctcatcattcagttctcacttataagtgagaacatgtggtatttggctttctgttcctgcattagtttgctgaggacaatagcctccagctccatccatgtgcccgcaaaggacaggatctcattcctttttatggctgcgtagtattccatggtgtatatgtaccacattttctttacccagtctatcattgatgggcatttaggttgatttcatgtctttgctattgtgaatagtgctgcaatgaacatatgtatgcatgtatctttataatagaataaattatattcctttgggtttatatccagtaatgggattgctgggtcaaatggtatttctgcctctaggtctttgaggaatcttcacgctgtcttccacaatgattgaactaatttcccctcccaccaacagcataaaagctttcctttttctctgcagcatcaccagcatctgttgttttttgactttttaataatagtcattttgactggtgtgagatggtatctcattgcagttttgatttgcatttctctaatgatcagtgatgtagagattttttttcatgtttgttggccacatgtatatcttcttttgagaattgtctgttcatgtcctttgcccacatttttatgaggttgtttttgtcttgtaaatttaagttccttgcagaagctagatattagacctttgtcagatggatagattgcaaaatttgtttctcattctgtaggttgtctgttcactctgatgacagtttcttttactgtgcagaagcacttcagtttaattatatcccatctgtcaatttttgcttttgttgcaattgcttttggcatctccatcatgaaatctttgcctgtgcccatgtcctgaatggaattgcctatatagtcttctaaggtttttagagttttgggttttaaattaaagtctttaattcattttgaattgatttttttgtacagtgtaaggaaggggtccagtttcaattttctgcatatgactagccagttcttccagcaccatttattcaatgaggaatccttttcccattgcttgtttttgtcaggtttgttgaagatcaggtggttataggtgtatggtcttatttctgagttctatactgtgtcccattggtctatgtgtctgttcatatcagtaccatgctgttttggttacagtagccttgcagtagagtttgaagttgggtagtgtgatgcctccagctttgttcttttttcttaggattgtgttggccattggactcttttttggttccatgtgaatttttaaatagtttttttaaattctctgaagaatggtcaatggtagtttaatgggaatagtattgaatctatgtattgctttgggcaatatggccattttcatgatgttgattattcctattctccctatccatgagcatggaatgtttttccatttatttgtgtcatctctgatttctttgagcagaggtttgtagttcttcttaataaggtccttcacttcccttgttagctatatcttaggtattttatattatttttggcaattgtgaatgagagttcattcataatttgactctctgattgcttattgttggcttataggaatgcttgtgatttttatacattgattttgtatcctgagactttgctgaagttgcttatcggcttaagaatcttttgggctgagatgatgaggtttcctagttacaggatcatgacatctgcaaagataatttgacttcctttcttcctatttgaataccctttgtttctttctcttgtctgattgccctggccaggatagccaatactgtgttgaatagtcacggtgagagaaggcatccttgtcttgtgacagttttctgtggaatgcttccagcttttccccattcagtatgatattggctgtgggtttgtcatagatggctcttactattttgaggtatgttccttcaaaacctagttaactgagagtttttaatataaagggatgttgaattttattcaagaacttttctgcatctactgagataatcatgtggtttttgtctttagatctctttgtgtgattaatcacatttattgatatgtgtatgttgaaccaaccctacatctcagggatgaggcctacatgattacagtgaatacccattttgatgtgctgctggattcagtttgccataactttgttaagcatttttgcatagatgttcatcaaaaatatttgcccgaagttttgttgttgttgttgttgttgttgttgttgtatatccaccaggttttggtaccaggatgatgctggcctcatagagtgtgctagagaggagtccttccttttcaggtttttggaatagtttgaataggcatgttatcagctcttctttggacctctggtagaatgcagctgtgagtctgtctcgtcctgggctttttctggttggtaggctatttattactgcctcaatttcagaagtcattattggtctggcttagggaatcaatttctttctggttcagtcttgggagggtgcatgtgtccagaaattttccatttcttctagattttctagtttatgtgcatagaggtgttcatagcattctctgatggtacagagaatactataaaaataatagagaaatacaaacatatttctatagggaaatacaaatgtatttctgtgaggtcagtggtgatgccccccttacgatttctggttgtgtttatttgaatcgtctctcttttcttctttattattctagctaatggactattttattaattatttcaaaaaaccagtgtattaaattctcacactggtataaagaactgcccaagactgagtgatttattaaaaaaaaaaaagaggtttacttgacttacagtttcacatggctggagaggcctcaggaaacttacaatcagggccgaaagggaagcaaacacatccttcttcacatggcggcaggagagagaagtgcagagtgaagtcggggaaagccctttataaaaacaccagatgtcatgagaactcaatcactatgatgagaacagcaaggggaaccacccccatgacgtccctcccccaacacatggggattataatttggattacaattcaagatacgatttgggtgggaacacagagccagatcatatcaaccagctccaggatttattgattttttgaaggatttttttgtgtgtgcctctctattccacttcagtttagctctgatcttggttatttcttgtcttctactagctttggggtttgtttgctcttggttctctaattcttttagttgtgatgctaggttgctaacttgaggtacttctagctgtttgatgtgggcatttagggccacaaatttccctcttaacactgctttaactgcatcccagagattctggtactttgtatctttgttctcattagtttcaaagaaattcttgatttctgccttaatttcattatttacccaagagtcactaaggagcaggttgttcactttccatgtagttgtgtcgttttgagagaatttcttaatcataagttctaatttgattgtgctgtggtctgagagactgttatgatttcagtcctttttcatttgctgttgagtgttttactttcaattatgtcatcaattttagagtaagtgctgtgtagtgatgagaagtatgcatattctgttgtcttgggatggagaattctgtatatatctatcaggtctacttgatccaaagctgagttcaagtcctggatgtctttgttaattttctgcctcgatgatctgtctaatattgtcagtggggtattaaagtctcccactattattgtgtaggaatctaagtctctttgaagatctctaagaacttgctttatgaatctgggtgctcctgtactgggtgcatatatatttatgatagttaactcttcttgttgaatttagccttttaccattaggtaatgcccttctttgtgttttttgatctttggtgggttaaagtctgttttgtcagaaactacaattgcaacccctgcttttttctgttttccatttgcttggtacatttttctccatcctttattttgagcttatgtgtgtgtttgcatgtgagatgggtctcttgaagacagcataccattgggtcttggctctttatccagcttgccagtctgtgtcttttaactggggcatttaacccatttacatttaaggttagtattgttatgtgtggatttgatcctgtcatcatgctgctagctggttagtttgcaggcttgtttatgtgattgcttcatagtgtcactggtctgtgtatttcgatgtgtttctgtagtggctggtaatggtttttccttttcatatttagtgctttcttcaggagctcttgcaaggcaggactggtggtaataaattctctcagcatttgcttgtctgaaaaggatcttatttctccttcacttatgaagcttagtttgactggatgtgaagttctgggttggaaattcttttctttaagaatattgattattggcccccaatctcttctagcttgtagagtttctgctgagagggctgcttttagtcagatgggcttcccttagtgggtgacctggcctttcagcctttctctctggctgcctttaacattttttctttaatttcaacctcagagaatctgatgattatgtgtcttggggatgatcatcttgtggagtatcttactgaggttctctgcatttcctgaatttgaatgttggccttcttcctaggttggggaagttctcctggatcatatcctgaagtatgttttccaacttgattccattctcccggtctctcccaggtacaccaatcagttgaaggtttagtttctttacataattccatatttctcagaggttttgttaattccttttcattcttttttctctattcttgtctgcctgtcttatttcagaaagttaggcttcaagctctgagatttcttcctctgcttggtctgcctgctattaatacttgtgattgcattgtagtagtgtgtttttcagctctaacatgtcaattatattcctctctaacctgggtgttctggctatcagatcccatattgtattaccatgattcttagcttctctgcatggggtacaacatgctcctttacttcagtgaagtttgttattacccaccttctgcagcctacttctgtcatttcagccatctcagccttagcccagttctgagcgcttgctggagaggtgttgcaatcatttggaggaaaaggggcactcggctttttgatttttcagaattttttgcattgattgcttctcatctttggtgtcttatctaccttcaatgtttgaagttgctgatttggagatggagttttgtggggtttgttgttgttgttgttttgtgtttgtttttcttttaatagccctgtagaagtctggccactcatccatagggctattgtggtttgctgggagtccactcgagacactagttgcctctgtttttcctgtacctggaagtataatatcagcaatgaagcctgcaggacagcaaagttggcagcctgctgcttcctctggaagttccatgctagggataactgacctattgctggcccaagtgtgcctggaggaagtggttggagactactgttgggaggtctcattcagtcaggaggaatgaggtcagggattgacttaaaaaagcagtctggctgctttttgatagagccactgtgctgtgttggagatttcttcagcccctaatcggtttgggctctccaaggcccacaggctggactagctgagaagcctgaatgtccaagttggtgacctgccccacccttcaggcactttgtcccgtggagaacacaggcaggggtggccagaggccccagctgggacaacctgccctgggaagaagaatggatggggggatggggcagttaaagaaacagtctggtcacaccttgacaaaacagctatgttgtggtgaggaactgcctctgcccccatcagcttggactctccaaagcccacaggctgtggaatgactgaattgtccaaacaacccaggtggtgaccctcccctcccttggtcactccatcccagggatagaaaatagctctgtcatgcaggcaggtgtggttggagggccccagctgggaggtcccacccagtaggaagaatggatcagggctctgcttaaagaagcagtctggccatgatctggcaaagccactgtgttacgctgctggggaaaccttcctccttgtctggactctttggactctccaaagcccacaggctgcaaaggcccagtcgaccaaatagcagagatggtgtctgtacctctcctcgaggctccatctggtctcaagaaggctttgtcctgatgacagtggctggctgaaattccaagccagtgggtcttttcttgtagggtgccatggaaatggggcccacagaacaatgccattcggctccctggattctgcccccttcctaggagtatgtgcagacctcccgccttgcctgagttgcagacacctttgttggaaatcccagggtggagtttgtaaagctccaccctgtctctgtgcatgattgagcagttgttctgccaagactccacacagctctgtgtgtcagacccaaggctctggtgtcatgggctcacaagatctcctaatctgtgagttgcagaaatccatgggagaagcatggtttcttggggtcacatagtcactcactgcttcccttggcaggggttgggggttcccttggctccacgtcgctcctgggtaggctgtagccccatcctgctttccttcattctccttgtgtgaagttgtttccctaatccgtctccatgtgagaacctgaatatttcatttgaaaaggctgtatttactgatcccttccattcctctccttgagcactgcagacttcagctgcttctcatcagccatcttggcccctgtctcacctgtttctcttgattggctaaaaattctaggctatttgatttatttggcaattaccaatttgagtggtccaaacattcctgaatatgacttgtatctcatatattaacttttattactttgaaattcagtattatactaaaaattgcaacttcacttaggctatttttgtaggtaatgatacattaccttaaagatgtacccttgattataaaacttttcacattaaagatctgatctgatagacacaatagcttctataacaaagaagaaaagtcacacaaaattcgccatcacttagttacataaaatattattttttacattaaaataaaagtaacattaaaatgcatgcaaaacctgggaaatacaaatgtcaaatatactggtttaatataaatcatgaataagaaattataccactgcataataataccaagacattaggagaaaatataggcaaatgatatacaagataactcataaaagaaaaaaatattatataaacacccaatgcttaatttttatcaagtaagtaaatacattttaaagtgatactttcagtgttggtatttgacaaaatggatcctttgtattgttctgcaagtcagaaaatactttcaggaaaatagctagacagtatgtcttcggacacttgaaatctcttacaatacagtattttggtccaaaaatcataaggcaaaaaaagaaatgaccactaggatttaagtccaaatatgtaatttgcaacattaattacaatgtcaaaaattgggaaaaaattaaacacatagaaatatgttgatagcatttaaaatgtgctaacttttaattgtatggggaaatatataatattaagtaaaacttgtaggatacaaaatgtatcaatctatcgatctaattaaatatatgcagtcatgtgtcactttaaaatggggatgcgttctgagaaattctgtgtgagtttcaacactttgtaaatacaagagtctgcaaagacaaacgtaaattgtatagcctattacacacctaggctatatggtagagcttattgctcctagtgtagaaatctgtatagcatgttactgtactgaatactttaggcaactgtgtaaaaaactggtaagtatttgcatatcaaaaaatagaatggatacagtgaaaatacagtattaaatttgatgttaacaccattatatatgaagcccatcgttgaaagaaatgtcattatgtggtgcatgactgtttgtggaaaacatatgaaagaaaatagaccaaattatttttagaggtggaaatatttttgcattacatttcacttgtttcttcataatattctctgcttctaataacgaacgtgtattcattgtgctaccaggggaaaatagcctgaaattatttttaaaacaagacccaatagaggaaaagaaggaagagcagggggagagtaaccagaaacaaaagacatttttgttttttgtacacataaaaacattttatgtgtacttccataaaatatgcacacatgcacacgtgtgcacacacacacactgcagttgaattatatctaaagatgtttattttttcaaacttttcattttttatcccaaatgaaacatgtagagtaaccttttaaaatcaactgtggcttatagcagtgtgacattactgttttcaaagaagtaactgactttgtgaccttaccaaaaaaagtttattagctttacattggaaagcagtttactgatggagttttactgactgactggaatttacaacagccagggagaaatatccactcaaatatctactgccattctttaatgcagttacctaaatatcagacgtgtctacctgctgctcagtctactagtgtaaatatttaaataaaactcagtgtgaccttttcacttagttctgaattttcttcctctctcttcctcttcctcctcttgtccctctccttttccttgtctcattttacgcatacacactgatttaccatcacacatcaacatttgatttcatcaccataaaagaagaaaatatgttctaggaagataatagaaaatgtaaggtatgggggcattagcatacaaagggagaaaggaaggaaggaaggaaggagggagtgtgggaggggaaagaaagggagaggaaagaaagaaagaaggaaaggaaggaaggaaggaaggaagaatttagtgtgacagtcaattgtttatctcttatttccattatgctatttattctgaaaccctattatatttttatagtgattaattttgcctgaccataaaaagcaattcttgaatagacaacatagatgaaacaaactatgtaaactttatccagggatgaccttaataaatatgttagattctaacaatcttttacttttatttatagttttgttgctatggagatcttatttcagaactaaaagctacatatataattctgaatgttatcattttaattaaaagataacaagtaaattttctatgccattaacaattgcatattgttctctttacaacaatgtcttttggagtcaatgaaaattaaaaatggtcttgctatgtggtcttaataataattataacagtcataaaagattaacaggtaacagttatgttcactatatgccagaaagtgtattaaattctttgcctgtactaactcattgaatcctcatgcaaccttacaaagcaggtactattatcttccctattgtatatatgagaaaatggagaccaagcattctcaacttgtcctggaacccaagctaaaagtggagccagcatcagaacccagaaggcttctgtaaaagcccacgtgacactgactttataacaaacctaccaaaatttagcagaattcattgcacagtcataaaacactcattttccccctttttaaaaaagcacttttttccatgtttaataacttgtacgtactttgaacataaagtatttttttactattacattttattttatttatttatttatttttcttttttttcatttattattattatactttaagttttagggtacatgtgcacaatgtgctggttagttacatatgtatacatgtgacatgctggtgcgctgcacccactaactcgtcatctagcattaggtatatctcccaatgctatccctcccccctacccccaacccacaacagtccccagaacataaagtatttttaagtgtcgttacttactggtatcccaggttaactcgaatggatagagctttgatggaatgtcagcctctaggtgctgtaaatgaaagatcttctgcttcacagagttggccatagcatcattgcattgtttctttttcacttctgtgtacgcaggaagcaaccagcttggccccatatatggccacacatcagtgatgacaggaagtttgctggatgaccaccactggcactctgtggtcattgagcgccaggggcggagcattaacctcactctggacaggagcatgcagcacttccgtaccaatggagagtttgactacctggacttggactatgaggtacatgtgatgacgtagaaattgtaataaaatgtcaagcaattgtgtcactctcctactgtattgtattattgttaattatattactacttacaccttttttattttcttctctaaacaagacactgacaattttaaaaacctgattaattcgtttcattttatttctaaatttataatcatgagtacttgaactattataaaaatcttagtaccaatgtaataatttgaagagaggaaccatgctatccaggccatttaataaattcagaataaatttaatttgtaatcctttcattggtagttaatcatgttatcaattcttcttgagaatgtgcagtacattatatgcagagggttgtctaatatttattataaagtattgaataagaaatcttagtttctggtttatattaagtcatttagaaactcatgactgtagatgggtcttttgacaagctctgttttctcagaatcaatatcacaaaagcaataaagtaaaatacagactattttaaaaagattgttcatgaacaaaaagacatatattaccttctcaataattagagattaaaaataatcaatgatcacgtttatataaataaaaatatattctcataggttaaaagtaggtatatcatatttttaaattatttggagagcaattcaaccttaaaatatccattaaaactgttaatcatatacgtaggtgagctctttaagatgtttgtcagccgggcgtggtggcgcatgcctgtaatctcagcactttgggaggctgacgcgggcggatcacagggtcaggagttcaagaccagccggacaaacatggtgaaactccgtctctgctaaaaatacaaaaattagctggttgtggtggcacgtgcctgtaatcccagctactcaggaggctgaggcaggagaatcgcttgaacccaggaggtggaggtggcagtgagctgagattgtgcccctgcactccagcctgggcaacagagcaaaactgcctcaaaaaaaacaacaacgaaaaaaagatgtttgtcacagtattatacatcctaggagaaaaggataacactatacatacaaaagcagcagaacggtaagataaaagggacacaatgctattacttagccagaagtttccgaactttcttagttcatggagcccttagtgtcttcgaactttttccacagcagtcctgagccgttaggtccaaacaacctaaaaatttacgtcctaagactttggtagccatttagagaaataaacacaaaataaaagtgaaagtagatttttatttcattcttaaacaacagcaattattactaatgggatgagtgctattgcactgtacgactggcagaaatggggatcagatttgccaatggcattctaattttctgttccacttttactctacatgatactctgtcttaatcagagtaatgagagtaatgaccaaatccaaaattcacaaagacagcacatcattaaaaggaatgacacattatctaatactggaacagtaaactaccttaagctagagtttcacacaatgtccaaaaggtgtcaaatattgttgtgttttctttaaaaatttcaaacatgctatggcacccctattagttttctgcaccaccttcatgttccttggcacccagttctgaaattggagatgtattcatatatatatgtgtgtgttatgtatatttatgtataattttataagaatatggaatatgctcatcataaaataaatggaaaaaacaggattaatagctgtgttttctattatctttatgtttaaatagtttctagttttttgcaatatgaatatacgatatatattcttaaataaaaaatttagagtagaatatgctatataaacactgatggagactttattaacattaaatgaatttaagattattggaaagtattttatccctccccctaaaaaaaactcttaaaagcaaactgattgttaaaagaaaatgtatgtgaacatcccagaaatttctatcttctctaaattagtatgtgtcttggctcatgtgacttatctcccaatgtatgagagatcttaaagatgaattattcatcctctgttaataaactttgaagtaccatagaagaggtgaaaattctggaacattaagaatgaagaaatataattctaattttcaaaaaaccaaattaaaaatttggggtcataaaccctgttgagtgtgtgacgaagtctatgactattcacgcacacacaacacttgctatatcggatcagcagtttcatggacactttgaagcccatctatatacaatgtcgtgtttgagaactgcaggtatagactaaaatacctggaacttatttattagacagaaacagtaggaagaaatttaaattaactgacaaagaatcagggtagacttaccatttctggctactgccagattatggtcctcttagagactgcaattattggcatgaaatgtaataaaagtggctgtgcttacctttatattgctacacttttctcttaatggaaagggactccctttgcttatttgtttagaaaaaacctcagggactgggccaggcatggtggctcacgcctgtaatcctagcactttgggaggccaaggcgggtggttcacctgtgctcaggagtttaagaccagcctggccaatgtggtgaaacccccgtctccactaaaaatacaaaaattagccaggcatggtggcaggcatctgtaatcccagctacttgggaggctgaggcaggagaatcacttgaactcaggaggcagaggtttcagtgagccaaaatcatgccattgcactccagcttgggcaaaaagagtgaaattccatctcaaaaacaaaacaaaaaacaaacaaacacctcacggactgtattagagtcagtctctagttttgttgtacttatctccttgatatatccacacactaactatactcaaacctcacagactgcatgaaaattagcttcaaacctaaaataatacaaattatacaacattcattcctgaactatttaaaggctttggcctaaaggaagagaaagctcgtcttgttatcttcacaaaacctgaagatgcaatgtcctgcttccccaagattatactgcctcaatcaattcttccagagtacactaaggacaaaggcattgaggcccaaaggtggaggtatgctggtaaatgcttaacaaccagctctctccagggaggaatggtcaggaatgccctgatatatagcatttgttaattttcatggtgcgaatttcccaccatggttgatttcatgctaccatatatggaactgagcagggagttgcaaagaggtgcctaatagcactatatgacggtatttccatcatatagttgcaataaatataaatgacctcaagaacatatacgaaagtaaagtgtagagataaattctgaataggtatgaattttgtgtttcatgtaatttacttaatttatagcttatgtagtggaagttttaataatagctctgcttagcagtcggttcttgtgaaccagtatgagtgggattcagcacagcactgctagcgtaaattaaatatacttaccacaatttctggagatgaacatcatgaaagaagtgatggaatacaagttcactcctttgatgtaactctatgtggacatttcctttttttcctttttttttttttttttttttttgagatgaagtcttgctctatcactaggctggagtgcagtggcgcgattttggctcactgcaacctccgcctcccgggttcaagtgattctcctggctcagcctcctgagtagctgggactacaggcacctgccactatgcccggctatttttttgtatttttagtagagatggggtttcactgtgttagccaggatggtctcgatctcctgacctcatgatccacccacctcggcctcccaaagtgctgggattacaggtgtaagccaccccacccagccctaatttttgtatttttagtatagatggggtttcaccatgtcgaccaggatggtctcgatctcttggcctcgtgatctgcccgcctcagcctcccaaaatgctgggattacagacataagtcaccgctcccggcatatatggacattttttgtgacctagtcctaagagtttgtctcatcccctcctcttgtagctgcctacactgcaaagtgggccaatcaccacctgcaatgaggctgctagctacagggtggcttgagactgtgtggtgatatatacgtgcacttcacttcatttttcctcagcgtagtcaataaaaaccaaaggggagagcagcaaaatggtgtttggcttagattctctctgttcttcagaggacacccactgtggatattatgctgttgtcttttgcaatacagctctgctagggaagtagaggaatgactctcttgaccattgcagaaccacagactgcctaggaagaaaatcagtcacaggaggagaagcccgagtttgaacctgtttctgccctttaatggttgtgtgacagtggacaattcatattcccctttgatgaaatgaatctaatcgcattctttccatagggtttatgaggaggcaacaggaagtaatagaaaaaaatgtgtgtgagttaagattacataggctacatttaatggatgcacgtttattctcctttatgtaaaagaagactggaggcaaatggctgctccacgatcttcaagatcacagtcctttttaatcttgctcttcctctatccctgttgcaaatcactcaaagacggctgctaacatttcactttgcacttcagctagcaagaaggaagagagagtaaacaagactgtgtcctccccctcttaatgacagttcttagaatcgcatacagcccttccacttaaatatcatgagaccaaaactggcttcaaagaagttgataatttattatattgactggggagcaatgtgcccagctgaaaagcattattttttttccctaatgagggtaggaagaaaggatatgtagaggtatccaatagtccctgcgacattttgtgtacacttgaaagctaacaaaatcgttactgcagttatttctttagaggcaaggttattggatggcaaggtcattaataaatgtatcatatgagccacaggaataattgaatattaatcggacaactgcaacaatatttgttactatcagcttcgttaaagtgtcagaaaatattctgtggtccaaccagtttattttaccaatgagaattttattttattattattaatatttgagacggactctttctctgtatgcccaggctggagtgcaatggcaagatctcagctcaccgcaatctccgcctcctgggttcaagttattctcctgtttcagcctcccaaatagctgggattacaggcatgcaccaccacgcccagctaattttgtatttttagtagagatggggtttctccatgttgatcaggctggtctcgaactcctgatctcaggtgatccacccgccttggcctcccaaagtgctgggattacaggtgtgagccaccatgcctggcccaccaatgagaatttataactagaaagaataaatgacaacctaatatcctataattagttaccttaggaattggggtcagaattcactaaattgttcggatctgttaacttgagcctgcattgcttttccagagcaccttgatgaggtggacttgtgcctagagttgctgaaaacagggaaactgtaaggataatttgaatcccctgcagaaagtgaaaggtccgaattaaagaaatatgcacacagaggaatatgtatttaataatattaaacattgacggtattattactgtcagttggggaaaaattgttcaaaaagattgtaaacaggagacgtagtactccattttagtatcaaaaatgattgcctttggtactaggcacacttaggtagtacctaatatgttcatttcagtgcaacttgaaaacattttcccaataattctactttagattactatttcttctttgtagttttctgattctttgggatatatttttcctcaattttccttttaccttcttatatatgaactgtgtggcaaataatacatattcagctaaccattattaataataattgattttattgtaaatgaggcctttgtttttttttttaccatcacctcataaaccacaatttgtgtttccccccctaaaagtacttaagcatttaagatgccataacactaaatcatagaacataatttgttcatggaccttccagaacacagaatatttgacttatgcttcaaatatgaagtcgtgatttttaaaaatgtcttcactgttgctttcatttcaccccatcaaacatgctctggaaaagcaccacaggctcaagttaacagattcctaaccatttagtgagttctaaccccaatccctaatgtaactaatgataggatattaggctgtcattgattctttatagttatatattctcattgaaaataaagtggttggaccacagagcattttctgacattttaatgaagctgatagtaaaaaaaatagataatggtaatattgtatgataatttaaaagatatatattacaagtattgtatatcttgatattataattagcggttggcttcatttactactaattcactattcatagtaaatatcatccttgaccatgcaaatactaaatgcaattttgtatcatataaatttaatgctatagtgtatattgatcaaaaatgtataagaaatggatattttctttctataagcgatagcagccagagaaacacagtaagtagcattgtcttatttcttaagatttaaaagacctataatatctttaagcctacacagctcaactttgagttcccaaatcctaagtggtccctaatcaatattgtaatgatattttttgaactattttctacatccaaaataaatctaatgaatttttgacaataatggtcattagactacaagtctgcatagggtaaatacgatatcccttgctttgggctgcagttttatcagcttattaaattagtgctgattatctcatgcttactggaggcatttattgatagtatgtctttgaatgataaacataaaaatatatttctaatattatttgatacaagaagtttgctgaataaaaatcttttaaaatattctcaagaaaatttataaaatgcctttggggcagtaaaattgcaaaggatcattgcttttttttgttcaagttataatctaattatcagaatgaatgactccattagacacttcaacaacaacataatttaatatgccatagattttggaggcagaatgctataatatttgtatattttggttgaggtatagatacttgaccttcactgtattcatagttttgtctagttcatcataatacaatgtggacgtttacatttaatttctttttctcaaagataacctttggaggcatccctttctctggcaagcccagctccagcagtagaaagaatttcaaaggctgcatggaaagcatcaactacaatggcgtcaacattactgatcttgccagaaggaagaaattagagccctcaaatgtggtaaggattttcacccgcaaaatattggtctataaaatatcaagtaacatttttgttttttggattattgaacaacaacaaaatcatgacatttttcatcatatttgtgtttgggcaaaatgatgtaaaacaaacattagagttatcagaattagtatagatacttgctattctttgagaatagctaatgggactagcttgaagtaggtggttggttttattcccacggagcacagaatgttagactcaatatttctggatgactcgtggcacgtgcttcatcccagcagttagcagcccttaaaccggcagcatcgtgttttcaaatatctcatcacatgtgctctaagttacttgcttatggtttaatttaatatttttaaagtttttaaatcagggactttattatatttactcctgtgcttccaaagatgatttgtttgaatatgtaaataaatacactttttagcaaatctctaaccagactaaatattacacagttaaataaagcttgatttccactgcatagccaaagctgtgccacagaagttcacagtgatttttttctgccttttgtgtgagttggtgccaggtttcattagattttggaaggagagcaaaagtcaaagaaagccccagcacacatgcttccaaacgacactactccacatccctaaaagacacttagtttgcaattttagtatgagagttccctatggctctgcaagaccaggagctgctttagcccagagaggctatttgggagagcttagaattccagagacccatacaataagaagatattatgcactataagtacaataatgtcatgagtgtttgcactgtgctccaaaagagctctgatggtctcgttgcctcaaatttgagcccagggtttcataaaatgatttgacaaatggaaatccctgaatgaataaacagttcaggttgaatatggaaggtttaaaacaataacttcatgcaaatgattatttaataaataattttcttaaagtaatcataaatttatactagaaattaaaacttgaactttggttaaattttctcataaagtatattgactatggaaaaataataatagctccatttataggcaacaggtattgtgctaggcaagtcgtattttatatttaggatgatctgagaacaatactgcaagaaggatacaaacattttgtagatgaaaacattgcgatttaacatggaaaaaataagttattttatgagaaaaataacttttattttatgagtaggagataaaaagatagatgtatagcctggtatagtgggttgctgctgtaatcccaacactgtgggaggccaaggcaggaggatcacttgagtccaggagtttgagaccagcctgggcaacatagtgagaccatgtctctacaacaagttaagaaaattaaaattaaaaaaataaatcaaattgaattaaaaaattagctgggcataatggtgcatgcatgtagtcctagctgcttgagaggctgaggtaggaggatcacttgagcccacaagtttgaggctgcagtgagccatgattgaactactgcattccagcctgggcaacagactgagactctgtccccccaaaaataaaagaataaaaaaagattatggattcacaatatgtgagtttgattatgctctataattacattttattttaacaaataattgcagtgagaaaacatagaataaacttttgaatcaaaatatacatacatacagaaaatcttagatgggatagagacaaataggacattttgcaagcaaccctgcaaagacaagtgtttatataagaaatgtactttcaaagatgttgggtgctggtatttcagtgaaattgactgagcactcattctacctcctcttcccccacatactcattccctcattatgcattgactccaaagtcagcaccgttactctggaaggatctttaattttgctagggagacaatcccctcaaaagaggtatgtggtcagttataaaatctcaattattatgcataggcagttctttttatcagtaaaagcgagcatttaaaaataatcatctgtgatggtacagagcaaatttaatttgaatattaattcagagagactgcctgccttagatttaatggttattgtgctaaaatggaagaaatcagcatcaggtatatatatatatacacatatatatatgtgtatatatatgtgtgtatatatatgtatatatgtgtatatatacacacacatatatataccatatacatatatataccatatacatatacatgtaccatatacatatatatgtaccatatacatatacatataccatacacatgtataccatatacatatacatataccatacacatgtataccatatacatataccatatacatatatatggtgttgttaaaaatatatagagaaaaagagagacagacatagagatagaaccaatgaaaatatcatccaattacattccttaaaatattatgataggataaaagaagttagaagcaaatacagatttttagacctgtaaagagaatgtagttaggcactgaaatatacaatttagtgtatctgaatgataaatatttttttcttttttttcttttgcttataccaaggaggaggagtatagaaggggaggggaaagcctgaattattgcaaattttatctccatttagcccatttatagtgctagttatacaggaattaatgcattgtgatataagcacaattcatgggaatttaaatgggattttgagttggatactaaaataatctccaacaaccacaattacattaatgctgaaaacttaatatctatctatctatatatgcatatacaaggtatatagataaaaatccaaatatatttccctaaaatatcagtttcataaattgcaaacatatgaccatagtccccactgagaccagagtaatatgttaattaatgttggcattgaccacccagaataggacagagcatctctctccctgacttatgttcggccagcagtagctttgctgtcttcagaaagtctagtgatccacagtcacacccacaacacacatacacactttacaactcatggtcagcctatcacatcaggctgtctggctgtcaatcccatggtggaagctgcttgttatagttagacagccaactgctgctcagtagtaggtcttacactccaagtagatccgtagtggtgcatccagtcactgaatccatgctctgctgctgtgtgtgagtttagcttaggctcaggctgtgcttcaaaacttgtagaactatactttcatcagtggtctgacatggatgttcattttattctgtgttttcctcagagcctgtctttctattttacagggaaatttgagcttttcttgtgtggaaccctatacggtgcctgtctttttcaacgctacaagttacctggaggtgcccggacggcttaaccaggacctgttctcagtcagtttccagtttaggacatggaaccccaatggtctcctggtcttcagtcactttgcggataatttgggcaatgtggagattgacctcactgaaagcaaagtgggtgttcacatcaacatcacacagaccaagatgagccaaatcgatatttcctcaggtcagtgaaacctatttgacatttgttcctgaaacttattgcaatttccagagttaatgttgtgctttgtttggttttgctggtgttacacgctcaggattaggttttaattcagatcttcaagacgcttacttggttgtagtgtgtgctgattgaataaagaaaacttggaaagttgttgagagagcaaggcatgggtgaaggagaaaattggttgagattggaaaagcaaaatctattccttaccaatgctagtttatttttaatagataaattgctcttcttttaagtgaataatttatgtttaaaaacaaggaatgtttattttaaaaacacaattgtatctggtatcttttctctttatcaacattcgtgtaccttttactattagtaacaagattatactaattttaactttaaggaatattccactgctggaatcagaacttcaaaatgatcttgctaaaattatgcaaatggttggaaaagaaaacgaaagtgaatataaaggtggaatgacaagatttgtgtatcaactgacggaagactggcttaggcaaaaataggataattttaaatttggctttgtagtgatatgacaaatagaggcttaggtaatattcttgttatttgaatagacttcgcaaccttggaagttctttgataaatacagtacaaagaaaggtgacattgtaaattgtgatgttataagcaaagaaaaattagtctcaatattggactgataaatagtaactgttttcatctatttttcttgagatagtctttgcaatagtcatacatatatattgtgaagaactacttagaaatgggagatacaaagaaaactaacatttactgaacacttagtacagatgtagcagatactgaaaggagtcatgacagagagctcaattgggtgaccatggactctgatttctgaatatgccatatactctcatggcaccctatgcatatacctgacacggtttctaacacactatgatttttgtccctctcttttcccctctaggctccatgctccttgacagcagggaccatgctcctttttcttctgtctctggcatatagaatagtacctgtaagaggtgctctccaatatttgttgaattcaatactctgacccctttcaactaacagaatatcccctgctatagaacatatatattttcttgtaaaataggctttatgtttgtgtgtggcctgaatgtatggtctattactgaaaaggattcaaggaagccacaagaaatgttatgtcagagatgtgcctaaattattgaaatcaaaggtattgggaaatacctagttattcactttctccatttctgctttattagttttgctttttccttgaatgtctagtcaaaatgattaatcaaccatattttatcactacattcgtttataagtatacctagggaggtttacagcaaatcgaaaatatctggagagaccagaaaaacagataaaacaaaaacaaaagcaaatgtttgccacagttgaaaaactcccacattatattgttatgattaatgattattgcctaatgactaaacataaaaatattagtatgaaggcctgtctccttgcagtctctgagcaaatccgatttgctggtgggtttccatgtaacaggagccaatatatttgaaaggataagatattaaccctagtggtcaataaacatgtattaatttgatttggtgtaatttagtactccaagatactctcacctaatttaagctgtgtttattttgaaaattaaagatagaatgaacaaagaaatccaatacatgacagttaattcaccttaatagatttgcttaaacctaataaaaatggactgaagagtttttgtcaatttagccaagaatctgtgcaaattaattgaaaagatataaaatctaaagatttccgtagtattacccttctataatccagtgaaaataccttactgcttcaagcattttatataaatatatatatatacagacatacatacacacatacatacatagtggaaactaagtgctcatatttgagaaacattagttgaaaaaaaaattcaaccatttaaaaaagttatattttatattcattcattcaatctaaaagtacatatggaaaccataggacataatttcctctgtcttttaatgtattttatcaaattcaattaaatgtgtaaataagttagtaaagtggcaacactgagaaaacagttaagtcaggattctaatgtttgctttaacaaagggaaatatatctgtatcacagctattctactcttatcagcatgagcattgaagaatgtcagtccacttctccttttgtcaaatattttgattgaaagaatttagaaaatgcagaaaatctagaaaagaaaaataaccagtgataaaattttggtgtacacacacaaagtagtgcactgagaaggtaatatagagactctcagatactgttaatatatactggtaacttagtttttatttaataaattccatggtccaggatgaatgtaacccaattagatcaaaaacctttttttccatcttggtcaacactgttctttgggaattaatttaaaatattaaatacatcttacaagtaaaataatgtttaatatattgttcaccctatctttgtatctttctttccaagttgtgattactgtcttcaagagtctcattagtaatcaacagtagacttgacttatgaaattcagtcaaactcagtagccttgaatttacagagtggattatcttaccatgaaaatattgaacaagttgcaacatcaacgttttctgatggatagccaaaaacaaacaaacaaacaacaacaacaaaaaaccctacttactttttgaaataagtttttatttcaaagtgactcaattttatcccagtacatcattttttaggacagaagttactgatttatgaatacatatttaggcattacttttaactaggcataaatgataatattaaacaggtgcaaaaagggtctaatgaataatagctgttcattctgggcataattttcattttaactttaaaattcaaaactctggggaaggtggacctagaaccatgtttttcaaataattttgatcaaagtacagtaagaaaatattttatgtcatacccaaaacctactgacacaaagtttgatgaaataaaacttgccttgctattttagatgcactatgataagtgtgatattttcttttcttttgctttattcttaaaaaaaaaaaaagccataacccactataataatttcatgtcctaaatacagtttggaaaacaccgacctgacctgcattctttttcttatttgaagtgttggaatttttaaaagttttagttgcctggaagtattaactccatcactctatattggaaaactaaatttgtcttatgggaacagtattataatattataatggtagtaaaaaagcattaatgtacattactatttgaattatagcaaaaaaaaaaacctaccttttgaagtaagtttttatttcaaaatgcctcaattttatgccactaaatacaaacatatttagaacaatactcagttgtcgtctgccaatattaacaaggtaatacaatgtgattcagcatttattatagtggggagaaagtgatttatcttaatattctctctcagttattggaaaaaaattaacttctctccatgtataaacaaagcctttccaaaaagtcattcagaatatgtcctgtcctaaatcagctgttttcttatactcaagtattggaacatccttgttttgttaatgtaggtattgcttcaattttcgaatggctgttcagtgtccacactgtctcagaaatatgtaatcagaaaagattttctcatttgtattttcatctccaaaggaaatcttctgtggacttgttttatttactttgcttcttagtaaaatttcctttgtaaatcattgtgttccattgggtgtctcaagggaggagtgggagttttcttggttcagtgtgtggctgggagcatgctgggaaatagttctcagttcaatctgggcaaatgtgtttgggaacactccaggcagtgtctattctaagcaattaaaatatctctgttcttgattttatgaacacttggaaatgtagccagcatattaatatttctttaaaaaattaatttataccgttttccaaagttcagtgataacttgccccatgagacatccttttcatcatatgagaaaaaaggtctcatttgaaatacaatttttgatgttttagttgtttactgaaaattttttttcagttctatactgatattatttcaaaatgtcttaaattcttgtaactcaaaaactaaatgtttcagcattactacaaatactttaagagatttgttttattatgttttacagcaaaataattggagacttatttaacaagatatgttctctaattcaagtttaaaccatatttattagaagccttaaaagatgttacttccctttgatccattaaatttaagtttttctgattctaagaaaataaagaagcacccagagttatttatcacaacatatatacaataaccaaagtaattgaaaacaaactactgaaaatggacatgtgattttaaagagtgtatttttatgtggaatactattatgtcattataaatcacatttcttatataaaatttaataacatggtaaaaaatgctaagaataaaatttttaataaaaacttaagtagactatgaatctaatgtcattattataaatataggaattttatttcattccaaatcagaatgaaataatataatactaatgttgatcatctctaattggtgggttatcagtccattatattaactttttaatatattttctctaatatctatattttctccaataaacatcaattgttctcagaagtcaaaaacaatatgctacaaaacaattgaggataaaatgatatttctgaaaagtatgatgcttaacaatgttacaaatggaaattaaatagcatatcaatttaaaaattctaatttccttacttagaaacatgtacagccaatttcttaaaagtttcaccttaaataataagcttcaacagaatttcaattgcatttacatacaaatggagcattttataatcaggtgcagaaatttggaggttgtgtctataatgtttaattatttgaaaatattcataactcattttgaacaaattccgcaccatctatgtaattttaaaactatttttcaacctgggtaaataattggatagataagtagataaatgattggaaaatagatagatacgtagatagatagatagatagatagatagatagatagatagataggtagatagataaaaagtattgtcccttaaaactattgctagctatcaggtaacaacatattcctttttctcaataaaggaatagattgaataaataaataaatcatcactttattcccaaataatctacatacaccatacttttacaaaataagtggctaaaaagtaatttttagatttttgtaccttttgatgggcttgtagatatctaaaaatttccggtaaaggcaaatccatcatcttaagatacaaaagataaaacatggctctgtattcttagggcgaaaatggagcctaagaaattctgattcatagagcactgtactcactttaattaggagcctagaactgagctggaaaggaatagattctattgtttggtggatcccaaaagtgagatagataaagatctgagtactagatctaaatagacacatagaaataagatacccttggacatatctaaaacatattttgctgattttattccctgaaattcacaaatagacttgctgtgagagccacatggtaccaagtaaaaggcatttgagtcaatggtatgttgctcctgggtagcttcacccaactgactttttattatatatcaattcctagtgtggctgtaccactatcatgcgaactgagtggaaatctacctttaattatactgcagtgaatgctggtgcacatttttcatcaatagaagcattatagtgcagaatgaaaggaaaaaaaggaccgggggagagttttatgatgttagatattgacttattctttagaaagcaaaagggacattttaatttataatcacactccaggacaccatttccattctagtttctacaatatttttgagccttttaaaatgttctatgcctttttcagggaagatgaataaaacatgttgtgtgtatgtgtgtataataattttttaaaattccaaaaaggcaataaagttttagtaactttgttggataaaatggaggcaaaaggtgccaatgagaaccagactgtgtttcaaaagcttcagtttactgtacaaataaatcgaagagaaaaaaaaatcagatatcactagttgatactaagagaataaaaatgaattatgaaagaatagcaaagaacatagcccaggaactccaaaaataatatatgcatgtagttgaagatgtttctaagacaagaacagggaggacatagaagcaaattaactttgctgaaaagccagtatatttctcagttaacagataatattgtatctacttaacatgtacagaatgatgtcctgaagtacatatacaatgtggtcctttacctttcatttaagtgtaagggctgacacttcatgtaaggttgaaacttttgtagtggataaatgagtaattggtaaatttaagcaatatggatttacatagtagagatatatctaagtcaactttagatgtttttgcaattgcgtgtctaattttgtttcaaatagttaacaaaataaatagtgttggcatgaaacaatcagggatgatgtaccttcataatcagaaaaaacacaaagcagtcattggtttggaaccttccccacaccacttcccactccccccattaacctcatgttgagaattaccagggataattaacttgaccaggaaattcagactgtgagatagtatcattgcccagcatctacctccctcaccttttaatttttaagtaatttgggaagaatgtaggctcattaggttatctgttgcttggttgtaactagatgtggaaatcagccttcttgggggagggattctgcagattctgtgagcctctgaaagtgacttgggatcagctgaaagaatgactcctttggaaactcagtatcatgtttagccacatatatttcttagtctctttcctttcttcatcaaggtttttcacaagaaaattttgggagagtcattcaacatgcatagaaagtaattacctttggtaaacatggtatcaggaaataattatggatatggccccatctgcaatcatgactacattttctgacttattttattctgatatatttcccttgaggcttttctaacctgagctcagaccctacttctgggaactgaaattctgtgctatttctgagtcctctttcttctctccagtcagtgcttttttcctttcattcattctctacgattcaattttataattacagttgtgcctagattcttactgtagcgcttggtagactctgatgttttctgaaagatactgatgacctgcctagatgtctgttctctctacaatcacttctagtctttcttctagcacttccaggctttctgagtgtctttccgagattgaatctctattgctgaacctctgtccagaggccgagatcttgctacccctagacgtacaacctgctgcctgttccctgcctggatattggagtactgctcacctccaatttcccaggattctctccttccctcattccaatcctctgctattttatttttaaccctgacatggttgacttgattattttaggtcataacttcctcttgcctatgaatattgcttacccttttgggcatgaattttaactacctcccaatctcaactgctgctatcaatccttgtgcacacctgtgccaaatctcagccacccctgtattctttgtcatcaaattcctattgcttcttggaatgcaaatctaacatatagtggattggggaaaactacaagcagaaaactagtaaagttcacatagtcccctaagatcttagctttggttgagcacagcttgtcagctaaccccatggccaagatcctaggatcgagagacctgcatctgtaatgctgtacataattttatgggcaggggccagaaaagttgtcctgttaggaaaggagagcctctggagctcattggtagttatcaggcaacttctcttttgtgctccctcagatctgctgagctagctccttgctgtactgctataaaggctggcgagaatgagactccggggccatccagatatgcctcttatctactgctaagattatgatgacaactgtgataatagataataactattgaatgcttacactatacctgtcactgtgctaaagcctttgcattaattatcttgctatggctccaataacctcgtaagttaggtcctgcattattgagaaacctttctatctcatttatacaaatggtaaagtcattcttctggtgacacgagttcaaaactttgagaaaaatcaaattttgccttttatcttttcctgacacatgcgaagatttaacaatcaccacccttcttttaaagtgcctcattcatccattatctctttaccctaattcaaaaattcataccttgaaaaactaatcaagggcatcttattgcctaaaagaatgtttatcttcaattgctgacctatttgttagggtataggcgttatgagcatggactctggagccagattgcctactggctatcatggattgagttctttctctgtttcagtcactgttgaaacaaacataatgtacacaacggttttaagccatttaatgcttggaacaactccacaagatgaaggacattatcatctgcatttcatagattaaaaaaaaacacaggaatagacatgagtaactcaccagggcccctttcagctagtgaatagaagagctttaaaaattgcccagagcatttgagtctaaagtcactaaccttggccactacctctcatattcatgaaacactttggtgttacatgatcacacaggatcaggtactgtggaatatgacacatctgaaatatttgttgaaggcagaacctgacatcaatgatgtccttatcatgtccattggggttctcacaggagcattttaagtaatctcccttatgtttctaattctgtctcccatattatccaagtttctatttctacaatacaaggaagataattcaatagtttcccattactaaagaataagtcctgagactttgctgaagttgcctatcagcttaaggagattttgggctgagatgatggggttttctagatacacaatcatgtcatctgcgaacagtgacaatttgacttcctcttttcctaattgaataccctttatttccttctcctgcctgattgccctggccagaacttccaacactgtgttgaataggagtggtgagagagggtatccctgtcttgtgccagttttcaaagggaacgcttccagtttttgcccattcagtatgttattggctgtgggtttgtcatagacagctcttattattttgagatatgtcccatcaatacctaatttattgagagtttttagcatgaagtgttgttgaattttgtcaaaggccttttctgcatctattgagataatcatgtggtttttgtcattggttctgtttatatgctggattatgtttattgattttcttatattgaaccagccttgcatcccagggatgaagcccacttgatcatggtggataagcttcttgatgtgctgctggattcagtttgccagtattttattgaggatttttgcatcaaagttcatcagggatattggtctaaaattctctttttttgttgtgtctctgccaggctttggtatcaggatgatgctggcctcataaaatgagttagggaggattccctctttttctattgattcgaatagtttcagaaggaatggcaccagctcctcctaatgggtgcagcacaccaacatggcacatgtatacatatgtaactaacctgcatgttgtgcacatgtaccctaaaacttaaagtataattaaacaaaaaaagaataagtcctgatttcttagcatgccacacaagaacatgcacaaactatgctccactggagcatttggcctcatttctcctactttgcgtcatattgactactttccactccctgacaaggatttccttctctatattccatcctagcaaactgccatttatcatttattgcccaattttagtatactttccttccccaaaccccaggaaacaatctaccatcctctagtatagtgccttgtatcttgaataacaattattttttgttacatattaaatcacatactcctctactattatgtctccctcatatctgtactcctaacgccactcatgtgtcaggaaataggtaatcaatactttcatctttgcttttttggtttgattcacacctagactgttgcagtttccttgctcttctctctgcctcctgcctctctaaacaagtccattccacacatttcctcctgattacaatttcaaaatgactgcttccattgagtcatgttcccattcaacaatctttcatgaacccccaagttttaaagatggtctcacatgtcctctacaaaaagcctgaatactaattccatggcgatctcaaatcctttacaaattttaaattattgtttacatttgtttgacatgatttattatattgttaagatatttgatactctgttcaaaaatgcttcatcttctaaatttttttaagaacaacaatcccacttttcctttgtctgtccacctctgagtttagcacaatgtcttacttatggcatgtttctagatatccagttgattgatttttttaatgtactgataccaagatgttataaactataactttacaattctgttatcttcatcagtttatataaaccaaattcattataaaagaagagtagcaaatatctcaaaggaaataattgcttcactgtgggaggctaatgtgtgtgaaattgatcaggaattaaattttaatttgatacttttataataagagattttttttaaagatattaaagcctagagatgtactgggtaaactatttcaggagtaaaatgaaagcgtgtatacatttgccagaaaatgtattctcaggagcatgacgtgaagtaaagccttgaaattagtcatattccctttgtatttatttttttcacacagaatacaaaatataaatgtgcatgattaaaactaatttagttttattcttttcttcaggcttgggaatgcatttgacacgattaactccagggaaaaacaagagaataaattttttttgtaccttctacttgagatctcagatctctagtcagttctacacgattaaaacagagactgtccctttattgtgggagtctagtctgacttgctttgttaagtgaaatggcatctattgatgatcaaatcatgttgtctctgaagtattttatttgaaaactccaagcaataagattactgtttagaaaaccaaacagaaaaacataaactttagagtaactttatacgagacattacgtgtggacacggagaagtaaatttcacccccaccatacttccatcctgaccccagcacctttatcttgggttcacgtaagaccatacagcatacacatactacacttccagcacactttgttcagctatggttgacagaatagagctaacacattctccacttttaccacgtattctttataatgcaatattctatagggaaatgtgaaatctggatcacatgtagatctattggcaggtacgtttctaatctttttctctccaaaatctactgtatcctatttcatgcaggataatcagtgtcatcggcatacatagcaaatggtttgttcataaaaaagcttgatgagggaaataaacccttgatagtctctataggaattatttccattaggaaactgaaagaaaaagagggtgttctatatgtattgttttactgcccatagcagttttgtaatacacaataagtttattacatagaatagccaataggcatcaatattgaaaaatagagaatgtgagctgtattcctgtacatgcgtgcattctcagcaatgttgtgtggctgatcggtattgtgtgagtgcgtgggtgtgtgcaggagtacatgcatgctttttaaaaaatcctctaatctttgatgaagtaaaaaacgttaaaattcaataattctaattgagtgctataatgtctccatttgccacgtttgaatgatttagaatagaaaagattaaatcagtaagatgatatgacattagacaagtcagaattatagctcatctaaaacttgtattaagtgtttgatttctttcattcctcttctcaaacatttgcatattaactgttaagcaacaaaatacagcaattcctaccatttctaatttccttttgttctcttaataaaaccatgacaaataatgcaggcaagtaaggagaagaaatattcagtgaagaatcctcaaaatcggtggttctcagctaggagtgattttgacccccaggggatatttggcaatacctggagacattgttggttgtcacagctggagagtggggggtaggatgctactggcacacaatgaatagaggccaaaaatcctactgaatatcctgcaaagcacaggacaatacctacccacctgcacctcccaccaaacaaaggtttatttgtcaccaaatgtcaatagcatgcaggttgaccaccctgacctgaaggagctcctctgttgcactctggaagttgagtgccccagagggagaagcctagacctcccacccaccccactccacggacttccattttctcccatactgaataacaagttaacacgtttagacaagctgattcctgtagtcccttttaggtttgtttagagcttttctcctgttttatcattttgctctatgttgttatggtttcctgttttcctttcccaacatacatatttagaaaaattccagactcctttctttgatttcacttttgctttctttgtggaaattttgtatttcaaagcaatgaagagacgttgtcaattcctcttgggtatggtcagaataaagtataagataagagagttctcccggtacacactttatgtactattctaaggcatattttgttatttgttttctacagatgtcaagctctatttttctaaatatttgactctctagtacactgcatcactatgacttgttcctaccatttttatcattagtagatgcaaacataaattatgcaactttgtgtgagcttgacatgaggcagcagataattatcgcactggtcaacataacagattgccaatattaggttcaggtgttatgaaaatttaattatattacagcatgagaaaaaaattgagcggggaaaggagccttaactagcctgtgttagcctgcaaagtgtgttctaggggctcattctgcactttcttgttcttccgtctctctcctctgctcaccttctcagtctgccatgccctgctctgaagaggcacccatcatttgccccagcaagccacctagcctgtggagcagagtgacaaacagctccactttgcttagctctgggaggaggccatggtcctgacccaggggtccgtggggaccacaggctatgacctggacagtccctacaactataaaatgccaccaatggaggaagctcttgtgaaaacagacattcagatagctcttctgggtgttataaacgagtaactccttgttctggcttggatgcaaaacagattataaatgtatggctagtatcatacttgaagattatagaggaaatgttgctgttctactgtttaatttaggcaaggaaagtttgaagtaaaaaagaaaaagtgatccagttgcacagctcatttgtgaacagattttttatctaaatatagaagaagtttaaattttgaataacactgaagtgggttcaggaggtttggctttcatcggaaacaattaaaatgtatgccaagaatagaagatgagaaatcgtacctttttcttaaaaataaagagtttttgcttaaagtgctttagtgttttgcaattctgtcaacttattagctttactttctaaaaaataaattttcttatgatcaaggaaagagtacttctgctgggatcacatagaagcttaatttcttgttttcccacaattgatgattgtatgtgtattagtccattttcacactgctgtgaagaaatatcagagactgggtaattcataaagaaaagaggtttaattgactcacagttctacatgactggggaggcctcgggaaacttacaatcatggcagaagcgaaggggaagcaaacttggaacttttcacatggcagcagaagaaagagagtgagtagcgaaggggaaagacccccttataaaaccatcatatctcatgagaattcactcactatcaccagaacagcatgagggaaactgccccatgatccaataacctcccaccaggtctctccctagacacttgggaattatagggattacaattcaagatgagatttgggtggagatacaaccaaaccatatcagtatataaatctgctttgtggtgacctaatgcaaacagtttctttttaaaatcaaatgtacatcaactacttacacaaaaaacctctattatttaattcaataaatgattccttttcagcaaaaaaaacaaaaacaaagtgtgtcccttagagctctaagtgggagagagctgaaggcatgatagagcaaggagagtgagcactgaacacctttgtccttccacggctcagcatcctctgcgtggactgtggtcaggatgattttgcatcttctttcagtagtcagcttagaagttcctcctcctcatcatgtgttcctcctttctattaccagctcccaagtgggcctcttgttttgctactgataacacctgacatgctactgcctttctatagtagccgaacagaggagaacaatctttcttcctctacctttactaacttgctctttgatcgctacaaaaaaaagtacccagtatcctgtgagagtaataaatgagatgaaaaaattatataatgagagaaaaaaagtaacagtcctccatgactatcatctcatctctgtgattttattcatacgtgaatattgcaaacacacacacaccccacagagtctttcattttgggtacataatatattaagcactgagggtataaacagagtgccctcactgtatagataaatacataaaacattatagattagaaaaaagctataaagaaatcatgcaacattatatggtaaaaagtggtgggggccgggcgcggtggctcacgcctgtaatcccagcactttgggaggccgaggcgggcggatcatgaggtcaggagatcgagaccatcccggctaaaacggtgaaaccccgtctctactaaaaatacaaaaaaatagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaagtggtgggtattcaatttagactcagacagaaaagataagaaaaagtcacgcttggataggaaaaacctaaaatacagaagtcctatgacttgtaaatgtgtccagaattggttccttccagtgggtttttggtctcgctgacttcgagaatgaagctgcggaccctcacagtgattgttacagttcttaaagatggcgtgtccagagtttgttccttctgatgttcagatgtgtccgaagtttcttccttcctgtgggttcgtggtctcactgacttcaggagtgaagccacagaccttcacagtgagtgttacagctgttaaaggtggcacatctggagttgtttattcctcctggagggttcatggtctcactgacttcgggagtgaagccgcaaacctttgcagtgagtgttacagctcttaaagctggtgcatccagagttgtttgttcctccaggtgggttcatggtctcactgacttcaggaatgaagccgcagacccttgtggtgggtgttacagctcataaaggtagcacagacacaaagagtgagcagcagcaagatttattgtgaagagcgaaagaacacatcttccacagcatggaaggggacgagcaagttgccgctgctggctggggtggctgctggctggggtggctagctcttattccgttatttgaccccgcacacatcctgctgattagtccattttacagagagctgattggtccattttatagagtgctgattggcccattttatggagtgctgattggtgcatttacaagcctttagctagacacagagtgctgattggtgcatttttacagagttctgattgatgcatttacaatcctttagctagacacagagtgctgattggtgtgtttttacagagcgctgattggtgtgtttacaatcctctagctagacacagaatgctgactggtgcatttacaatcttctagctagacagaaaagttccccaagtccccactcgacccaggaagtccagctggcttcacctctcataaacatatcactattcaatgaatacaaaaaagggcaaaaagaaagaaattagtttggagaggtaggtagaggccagattatggaaggtataataaactatggtaagaaattagaatgcaagcccactggaggatttcttttaagggaattgaatgatatgatttttaaaagatagctctatctactatgtggatagtggatagatagatggatggatagataggtagatagatctctatctactgtgtggatagtggataggtacatggatggatggatagatagatacatagatagaacagaaggttatacagattatggagtgggaggtgagaacagggaaaatgagataaggtggaaagcattgcataatccaggagtaagtaatcgtagttttatctatgatgatagccatgtatatgaagagaagttggaggatgtgagaaatagttaaaagatataactatcacaacttggcaataggtctatgcagagtgtgaaagaaaggtaggaatcaagactgaattgtaggttcctcactttatttataggtaacagtccctttagctgatatggaaaagaatgcaaagagtttggagagaatccagtcctgttgtggacgtgtcacgttttagatgtctgctacctatttaggaggacaaggcaagttgtcagttagggatgtgagtctggagctcagagaagagtcaaggcttatgttatcagcatgaggatggcattggtattggaagccatagattatttactaagtaagaacagataaacagagaagaggaaagaattccaagccaagcctccaggagcttcatctttcaaaatttggtaagaggaggaaaagccagcaaaaagacagagaatgggcaatcagataagaagaactcaaagagtactgaaaggaacaggagcacgtcttaagaacagtattgtaattttgttaaaagaaaaaatgtagagtagagtatagttcagaagtacaaagaagataatagaaaaaaaagtaataaacctaagcaggcaactacataataggaaattcacaacttagatcttgactaagtgcaaggcagaattgtaagtagtctaagaattattttccaacatctactgcttactaattttatggaaggcttagacaggaaagatactaatttcactagatagagaaaacctaggctaatgctctttgaaaactgaaaaatattgttatatacgtatgaattatgaatgttgatttattgtctactccttgttcaaccccttcctccccactccttatgagaaatctgctcaaaatggtgaaagtacaaaaaacagaacaagacgacaacagagtaggtaagtaatcacactgtataataaagaaaataaactggaactacttggaatgactattgaggggagatggaaggatcagacaaaaccccaaaagaaacccaaaggactataaagaaatagaatatcagccaagggatgtttttaatgaaaaccaagaaacagaaagctcagaactaacatcggctaaggggcagtctgtggcaactaagaggtgcttgatgtattttaattcacaaaattgtcccaacacattgtgaaatgcatatgatcaaccttttgtaaagagaaggccaaagcttaaaaggtcacacaaattctcatagttttatctgtgatgatagccatggatatgtgagagtatccaagttttacagaggccgagttggtacttgaaatgaatttggctttatttttaaactcctatactttctagtaccctaggctagtgaaaaacaatgaagtggcaaatgttccaaagccagggaaaatgttaagtaaacccaacgctaagagggaactggtgtaacgggaatgataaacatgagtataattactcttttgtaatgttaggctgtgaaaaaagtgagaaataggccgacaaaatgatagtaaagtcacatatatctagcatgcaaactattgaataaaacaaatagccaaatataactaaatataaactataatttttttcagctaatccctagaaataacttaaagatgacaatgcaaatattcacatcttgtttgggcaattcaggcaaaagtctaatttaatggccttaagtttagtgtttccattcttcactttcacctgtgtaaacataattgttttgtttctttgccaataattttatggaaagctttttctaaagggtaaaaacaaaactaaaaaaaaaatcatgtacacataaaacataatttttatttaacatgtatttggcagtctgttttgtttgcaaatccaaaaaaggatagttccttttagggatttttttaatgtgttactccaacatgttttcactgctcctgagcagttacaaacacagcacagagctgggaagagcagctgggtctatctttggctttcatgcactaatgtggaaatggaactgtctttgggaagccttccttgttaattgctaagattggatgtacttttgcatccaaattcattttccctgatctagttatggaaaaaaatgtgctatcttgtactttaccaatggaaaatggtggaaagcatcatgtcttctgcccccaaatgtgtattttgaatttgataattacagcaatgctgacatagccaatacccagcctaagcagtttatagcaaagacaatgactcatgtacataggggattaaatctgcttctggaaactacataattatctagtcgtattcaaaaatgttatagtcagaaaagcacctaatgattcattggttctgttctctgccttctgcttgcttaaataactaaaatatattgagtaataaattaggagcagtaggttgtggtggttaattacatagactctagaacctgaatgcctgggttcaaatctaccacatacttaaatgcctatgaattatacttaatctgtgtgtgccacaggcttttcctttgtaaaatggtataatggggataaaaatagtatctgaattcctaggctagctataagaattaagtgtgaaatgattaggagggtaagtggctcttacaagtattagacttcttgttgttattatgttattggtactgatcttggtagtacgaaaacaaaaaggacaataatcaatacctcaagtaatgtgtttacagtatagttgaggagataactgcataaaggaacatttagcttatcatatgtgtttaaaaacattattagatttgatggtaaaataaccagtttagaatgccttcttattagacaaatatatactgtaaacattgtgtttaaattatgcttaaagtcataaaaaattagaattaaaagaaatcttacagatcagagtattcactgtattatttaaaatggggaaattgaggctcagatgttcagagaacagcccaggattacacggctatgcactgacatgacccaaagcatagtaagtctgatgttcattcctgagctttttccattggttcatgctggctttacaaactgagaacaaggaggtcagtgtggatcagagtagagctctggagtacttttacaattcagctgggtgagggaggaaaggcatttaggaagaaaatcataaagataggtatgctaccgtctcctctgttaaaaaaaaaattaggacatcatttgagggaagcagagacttttcatggagaatgagtggttacataagtttctacactcatgtaacaaatatttactaaacattttctctatagtaagcctactgtgttctgggcatataatataaattggggaacaaaaagctttctgaactatagagagcttaaactgttgtagaagtagcaaacatagcttataattgttatatataaataaagtatatagaaatgatatagaatgttagaagatgacaagtgaaaataccgtgaaaaagaaaggaggagaataagagggatttggagtgtaggtggagagggccctcaacagtgcaaaacacatcagcataaaccttataacaaaggtgataaacccatttcaaacagatgagggagttagttaagtagatatctgggggaaaaacattccaggcagagagaaaagccaaagctaaggcccaaggataggagcctgacttaagtgtttgaagtacagtaaagagtaaatgtttcctgaacaaaagtgaatgacgagagagtagtaacagaagaaacataatgcagtgaacagcgcatgtaaggctgagcacacaaaagtccaccttgaaaacgctgactttcactcttcatgaaactggaagcaactaaagttttgagcatagaagtgacataatctgtttcacattgtaaaaggtcattctgactctgtgctaaaaggtagattttcaaatccagtaatagaaacagagagttgctaaatccatttgagagctgattgtgtggtagtagaagaagagttgaagtgctgagaagtggttggatttggagtataagttgaaggcaatttcctgatggactggatatactgtctaggagctgtcaaggattgctctttcaagaaagtcaaggattgctcttccaagaaagtgcagtgtgaggaggtaaagaaattacatcaaggagaagatctgatactattaagatgcccgccctccccccacaaaaaaaaagaagaataattacccactagatgtaataacattcataatggcattgataagataaaacagtttctatgcattggtaaaggtgaaacctggataaagtggttttaattgaaaacgagaataagcaagatcagagtaattagagacagagtacaaccatctcatgtgagacgttgggcataaaagaaatgagtagcaggatgggaaatttaggatgattatttttcagttaaagagagtgtatgtttgacaatggaatgatccaataggttatacaaaattatggagtgcttttaatcttttctgaattgagtactgtttaaaggaagtatggatttttacctcaaatttaaaaacattttaaacttacttgtttatcataaacaattgtagacactgatagataatacttgctgacttttaaatcatcttccattttatatattaattttgtgcactctagtctctaaaaaatgacagtctgtcctatttctcaggaaaggcatggcagctgtcattaccacttctcacaaattgaaatgaaatgcacatagcacaccaaaatggagagttctgttttaaactgccaccccctaaaagatactgaactgaaatcagcaacttctaaaactatccttgtctccaagaaggtttcaaactactaatcattgaatgtttaaaatacttgaagtacaggtaaatatttctctgatatagtttctgatagaaaaaaaaaagaaacaaaaacatatagttagattatgtcttcgattcattatatattgttgtaattaataaggggcaagtcaggaaagtggaaatcacccagttatttcaacagagataatttaatagagagaaatggctaaaaagacatcggcagactgaaaaggctcaagaggaacactggagcaccacagctgtgaaggtctgaatgtttctccccaccactcccgctccctgccaaaagtcatgttgaaatcctaaccgcggaggtgagagtatttggagataagactttgcaaggtgattaggtatggaggacaaaaccctcatgagtgatgttagtgcccttataaaagagagctcagagagatcccttgagccttctgccatgtgaggacacagtgagaagacaggcatcaacgaggaagtggtccctcaccagacactgaacctgccagtgccttgatctggacttctcaaccttcctaactgtgagaaataagtatctgttgtttataagccacccactctatgctatcttgttatagtagcccaaacaaaccaagacagcaggtagcatagttactgaaggaacaaaggggaagagtttgaactattagaacatagacatttggaggaggccccctagagaaccggtacccagacttctgcatagctgatatgaatgttggcagggatgtaattaacagagtgcactatttacaattaaagatttaatgcccaatataaatggaagacgagccattggtaaagaatattcatagagacaatattgtacacaattaagcataatatatgacatgtattgtattttaccatgaataacatgttaatgcttctattggtgtattctacaatttgtatgggtgatagcacatagtatgtactatgtaaaactaagcctatgtagtagtagtatatatattagtggggaaaggtgcccctgagaagttgatgttgcccagcttgtgctaataccctaagaaattggaagagggaccctgaggagcttagatcagacctctgagtacaggtgcctgccatgtgtgctaatatatctcagagtgtgggaaaaatctggaaatggtaaccaaatgctactgataccatttagtaggtgcatggattaaaggaccatttttgtggcaacactggaaagaataggaaatgcaacaggaacaagtccctactttttcctcacgccttacagtcttcctccagtacttgtatcatagagtgtaatgcagagccagctggtaaaggagaaaggtagatttcggagcctcatacccagcatcacaaagcaaaatataagagaagtgatgaactgagagacaatggtttgttattcaactaaaattgtcatatatgtgtttggtccattgataggttaaaactctgttgaattgccacttttggtattacacaaattgatgacccaaaaaagattttaggatcatttgtgtgaattcagcacctaccgtatatgtgggaaatgtactgaataaacacagaaagatatgctttgttctcattctgacatttaaataaacctcacaaaggctttcctttgtttgccagagaaaaatcaatgcaaaattgtcaaatatattacaatggtctttgcccttctcttaggaattctcacctgacttctcttgcttttgctgcattgcataaaccctgcatatgcacactgtgccttaaaccattcaatgtgctgtcattgatgtcatctcatctgagtcttaaaagaattttgagaggcaatgagaaaaggtacagctcttctaagagggcaaacaaggatatgtcaaggactgtcaaggatatggtagagaagattttttatttgggacagatgacctttacagttcttccccaacattgagctttaataactggactgaccatgggtatgtcctcatcatattctgtaccaaaaatgaaagtaattatggcatcttcctagaggagattgttacttttaccttcacactagtatggttgcaagcatatgtcacctttgatatcacacaactctggtaccctatatagagaatcacaagaaaagaaaatacttgtgcttgtttacccccatatccacatttctgcttcattaaaaatccagaaaggtcagaaagcctaaactcacctggcttcactctccatttgtctccaggcatggctttttgatgccctgacagtagcccaagaaaacagaatattttcaagaaactcagcaggagtgaccttcagttgttgcctcattggcatatatttcttggtaaccagggaaagctctccatgacaccctccaggtccccaaaatatactgaatgcatgatgccagaaacattcacattagagcactatttctttctatggtgataatgggggttttgacctctgttgacatgcaaatatttctgaaagaagttccacatcttcttccctgagatccaattttgatgtgaatattgtataagaagtgatcaggaggaagaggctacttaaaagagaggcaaataagatagcctgaatggaaacaaatataactgtttttgcaaaggccagtgcctgcccataaatgtactttttcagaacaattgtcaagtttcttttcatccaccagggttgaggtgcttcctcaaagacactcttgtgtagtcaaggctcacctttatttcccttattgaactctgctcgtttcctttaacatctattttaatactgtgcaatggtattatatttttctgtgtttcctttttaactctagcactaatataaactttttgaaaattaggcttccacatccctcatttgtcattgttttgcaagatcctagcccagtgcctggcacagatatatgtgcttaatgcacttggctagatggatgaacaaatgaatgaataaatggtatgaataagtttcatatgctttttagtccacccagattccaatgtaccatatttatcagaaatgatataataaattattaaactttaattcaaaggtttatattcttattgatgtttttattatcagtaattcaattagtaggacatagtgggatattttattgatttttaagggatttaataatttcacattaaatcagcaataacaaaaacaatttatatgcttttcatgtccttaagaagtaataaaaacactcagctaaatgacaatttaataaggtgaagtttcatttgcaaatctctcgtttctttgagttcactctgacattgtcttctgtttccctgtttccccagtgacttcttatctttagtttaaaatggaaaagtgattaaacatgtcaaaacaaataactctacattttaggttttcaagtaaattaaaatttcatggacctcttaaaaacagacatatggaaatatctaataataactacatgaactgctaatggagtaagtttccaccaagcttaaaaaacacctttaatgtttttataaagccattttgaatgatagctgaaaaaaattaagttcaactcattcctaataatgctatttatgataatagttcttcagtgactttattctgcaccatggattacatgcacaaaaggaacacatatcgactgtatttgtgaaaaggaactacttttttcacactgctaagttaaatcccatcttattcagctgacctgcgattcagcacaattaacctgttcattagttgcaagtaaaatgggacatcaagtgatggtttaatgcaagcattaccacatctgaaaaataaatgtaggtgtttgtgtctcagagtgatttttcttcaatatcaaaaagcactggaaacgcctaaatctaaagcaaaacctgaatgatggagttttctgtctctatcattttcccttcctatatgtgccagaatgaattacgttcttgttgagcaactactagaggccatgcaccaagcaatacacttagaagataaggagaggaataaaacaggctccctgagcagaaagaatttattctctaaaggagaaaacagatctcaaacaaaaaattacaatacagtgtaataaaatccataaaactgatgtataaaagttgttttatgtataaaggaaagagtaacttgcttccctgaggattcagtggttatttgacagaggaagtaacatttgatctgagacataagggaaaggtcagggttcttgatttgggcaagaggatgagtcagtctaaacaggcaaagggaacagcattgacaaggtatgaaactgcacaacatcttcgggcaattttagaggtttctgaagcatgtgggccataaggaaaaagagcagaaagggcttacatgaattcaaattgggaagtcatgtgtatcttttaggggattcagattttattctatcgagatctattagaagtatataggtaagagaatcatatgatcgaatttgcatttcagaaatacgattattctggcattcttaacttttatgtttttaatttttaaaagataatatgcattattaacatatctacacctgagattagagttgaactaaaataaaattaggtgaatcatgtatttggaaagtcagatatacctatttatctttgatgttcagatattgtttgatttggatgcaatcttttaagaaataactttttaaaacatataaccaactctattcatttttaaacacagattaaatgcatcagtcttcatattaatattttaaatatgcggaacaaggtaaagtagtctcatctcgttttagtcaaccatatgttctgaaggccagaatcactgcatggtctacaaataatttttccatacttatgaattctcttatgtaatatgacttacccaggtgtacaaataaattccaattaatgatgtatctaatagactgtcatcattttgagtcatctaaccctatggtcacgcctaccaactcacaatatgtgaggagggcatatcactgcctccgaaactgataaatcttcaaataaagtgcagaaaccttaattaagaaattggtatatctattacttctctatgaatcatacttttttatatgatatgaatcaaagtttttttttggtacaaaagttgcaaaacagaagtgacataaattatccaatggttttggttacctggttgagaaaatataattggtaagaacctagaaacataaaaggtttgcttggataagtttaatattatttttaactatgcagccactgaaccactgtgactgacaaattggtttgtcaatatcacaagcaattgcaaagcgagatagctgttttcttaaatgctatcataaaactaggaagtgtttccaggataatttcagttgatgtaaaaataaatattcaatatacagaaccatacgtgatgttagtggatgcttatcaattattatatccaggccatttatttcatttatgttcatattctcaggaaccaaatttgtttatcaaattatggaaatatggaataaaatgccccagttaacctctggctcagaggataataatgttgctgggagtttataattgcagaagttttatccagattacaaaccagattgctaggtgcctctgtcactgtcaagattttattttttattattataggtttattttaattacaaccccctccttttattaattaagcatatgtttattaaacactagcagctttattgcatacaatatgcccattataggaaatttagatatttcaaaccctaatagagttcagcatttaataaacaagatataaaattgtaatatgatgtgttaagtactgtctgcatatgtatgcatttagaggcaactaaatcttaaaggggagattgtttacttatttttattgttgttgaggatgtaatatttaagctaaaatatgcagaggcataaaggaattaaagatgaaaagtaatgccatcaatagacacagaatgctcaaatgcacagagataatttcatactcagaagcctaagagaagaaagaagcaatgaatctgctgagtaactagagaggctgatcctaaagactttttcttgcttactaaataaatttggattatttcctaaaagtactgggaaactattgaaatattttggaaataacttagatttttagctgcgacattagacatggccagaaagggacattcaagagacagtgaacaggtaagtgtgaaagaacgtagtgaccagttgcaaggggtgggtaagcaagtaaagaggagataatgaggtctccctagtttaagacttgggtaacttggtaagtgatgttgatgataatattagagatacaaagtatagaaaaagaaatctctatggggatgatgaattctgcttaagacatgcaatatatgaagtaccagttgcatagcgcaactcagatttgctataaccataatttggagaatgtgggataaggataagtgagcctcctcctgtgaggctgttttatatcctgggtactgttgttcagctggcctatcttttgagcacatatgtgtatattaacatatagatatgtttatgtgtaattaaggaatatgtatctgtttataactatatacttggagccaagtatactggctggcactcagcaggaactcaataccaatatgctgaatgtatgtggggatccacccagtggttttccctaagaaggattttgctgactgtcttggtacaagttctcttgctttgattccaacttaaaagaaaagagctgactcatcattcagtattctctctctcatagggtacgctggcatcttcactgaagtatctgctaatctctttactagaacctctgttcacagtttgaagaggttaattttgcttcactcaaaattgaaatattttcctgtgaatctatccattctagcatgtcctttcttacctgtgatggtatagattttatcccaggagaaccttacaagtttatgtgatgagcattcattccaggaactctaatgctgtttccatttttatgaccaatatgctttgacctcctttctgttccagaacaaaaggagagcacagaaagggtggatattttatcataatacttcttcaaggccttgaaattgcatattgcctcctatatgctaccaaggcctatgctatgaatggaatctttactcttaaacagatcaacaacaaaaaccatacccagtgtcttgtacccttaaggcaaaaggcatcctgggcaatccctcaactcactttttgcacactcacaaatattctatctctcagtactaaagatttatcaatattcaactctgggacatgtgggaacacccatttatagatggtctactaaatggtccaccagtattcttatttagcttagtgtttatgtgactccatatatcactgcttaaaatttaatctttaggttatctgcagagcacatttagtaaaagaaaaatagcaatttgtcttttaactattattatgaataatgttgtacagtacaaaattaaaaaaagactgttttcataagctaatagttgttcttccctctgatctgttaataattagtcaatccatcattaatggcaaaggcaattcagcattcctccatgtgttgcacatgggtgtagacaggtattaacttagaaattgaaaatgtcttctgtggatctaattatgctgaaaatatttgtttataatagtccttttacacagtatttactgcccactttattttctttgttcccacccagaaatcaaaccacagaatttaggttggatagcatgttaggtttgggagctgttgtagtagttaaccagcaccctcaaagcattactcagtttcagcacatctagaagcataagcatcggtaattttggctaatgtatgtcagctgaactaagtaagcataaaaacatgtctgacatttaggaaaagaagagccacccactctcttacttaagtatatatattaataatgtttctcagcaatcatgttacacatgcacagtgacttctagcaatggagctttgcttctcgctcttgggttttcacgtcggctggggttgtgttcatgtctgctccatgtgcacttcatcctggaccagcagcttctccaggagtgctcttctcgtggcgatgataaacatgcagtgccctaggccaaatctcacaagtgtgagcctctgtcatgaaaactaggaaagggtgaaggaaagccagggaaatgaaattcaggctgtagaagcatcacatcccaggctgttatatctgcaagaacacagaaagttaaggagagtctcagtgtagttgatggtggcaagaaccagaagacagaggacaatgagtctcatgtcagaaaactcagaaaggaatggatggctaggctgtgcataaaagaagaacaacaacaatatcttaactgttatctccttaaaaggtctgaaaaattggaaaccagtctattaaacagaaataaataataacacagcaccaattactagtaacttaaaagatgtggcatatctttttagtatgctatttttaattgtttcagtgaatttaaaatatttataactactttaatgagttttattattcttttcttcaagttacttacccaatttctccttctaaatggttccttaatctcctatctcctatggtttgggaacaactacaaccttaggaaatcctctttattattctgacataaaattctttaggtcttattttgccatgcaatttttatatggctatcttattattccaattaaaatttaactttaagtcaggcaatgtgtgacatcctctatggtatctagaagagagctcacaagttaggtgtgaagaaatttctataaataagtatgtaccatatcaatgaaattcatgagttctgggatttgtaaattggacatctcaaatggaagaacagagtagatggctcacacccccttttcccattttctacattttctgtttttgaacaaaatcatcttagtttttcccagcatcagacattcacttgtataagattgaatttacaaaaaaatgagattcattcgaaaactcaggataaagcaaaattcaaggagaaaatgaaaatctgttctaccataaatccctccacaactagagagatacatattgacttttttggtagcagagacttacgtgacaggtgtttatgcctgaactgttccacagataaatggaagactttattctcaagtgatcctggcatactcatgtggaaaaagcaaaaacataattgaaagaacgttatttcattctcctattttggtaagttaagaaacaaagggaactgtttgtaactatttcttatattttgaaagccaggtgtgacagttgacattatttactaggactgagtttataaagcagacccaatagaggctgcttattcattgtgagacatcatgcctgcagctgcctccaggtaaatggtgacttgtcttacaatgcataaaccaagtagttaggctctgcgccaagcaggacttgaaaagacttatagaaagcacatggttcccattcagatgtgcttttattttttaaaaagtactaaaataattattgcatttattctttttatgttttatttttaattgacacataacaattgtacatatttatggagtacactgtgaaccataagagatagttaacataaggaggaatacatttaaataaatgcaatatttaggtctcatggatttttagaattgtaagcgaaatttaaggttgcttaggtaacactcttcattttaaatattagactgtggaagtcaagagggattaagaggttagtttttctcagtttaaactttattcccttccccttgttgcagattctaaatatgcgcttttcaaattgaggggcgaccacatcaactggctacaattgtcccctctgtgatttttgttgtgttttaatgctccaggctggatctcttctgctactttaaagatttcaaatgagacccaatgcttgagaagaaaatttgatgttttagaaatcattttcatttcttttgatgggaaaataatttctttatacacttaatttcattacctgaaacacttgtcaaagaatgactgaatcttataagacaattacttgacttagttgtttcaaggaaatctattgagttggaatatcaatctacatattatttgaaagcttgaacaagagatcctgatatagatccctatttaaaaagtactggttaagtccaacatccttttatcaaaacagtgggatttaaaatccaaagtattttttgatttttttttctttatggccattcttgcaggagtaagggggtattgcattgtggttttgatttgtacttccctgatcattagtgacattgagcattttttcacatatttgttggccatttgtatattttcttttgagaattgtctcttcatgtccttattctactttttgatgggattgttggtttttttttctggctaatttgtttgacttccttgtaaagtctggatattagtcctttgtcagatgtatagattgtgaagattttctcccagtctgtgggttgtctgtttactctgctgactgttccctttgctgtgcagataagtcccatctatttatctttgtttctgttgcatttgcttttgggttcttggccatgaaatctgtgcctaagccaatgtctggaagggtttttctgatgttatcttatagaatttttatagttgcaggttttagatttaagtccttgatccatcttggatcgatttttgtataaggttcagtttcattcttctgtatgtggcttgccagttatccagcaccatttgttgaatagggtgtcctttcccaacttgatgtttttgtttgctttgttgaagatcagttggctttaagcatttgggtttatttctgagttctctgttttgttccactggtctgcatgcctattttataccagtaccatgctgtttaaaaaaatccaaaaataatagatgttgacatggatgtggtgaaaagggaacgcttctacactgctggtgggaatgtaaactagtacaaccactatggaaaacagtgtggagattctttaaagaactaaaagtagaactaccctttgatccagcagtcctactactgggtatctacccagaggaaaagaagtcattacatgaaaaagatacttggacacaaaagtttatagcaacaaaattcacagttgcaaaaatatggaaccagcccaaatgaccatcaatcaatgagtgtgtaaagaaattatgagatagatagatagatagataggtatggaatatacactcaaccatgaaaaggaattaattaatggcactcacagctatctgaatggaactggagactattattctaagtgaagtatacaaggaatggaaaaccaaacatcatatgttctcactcataagttggagctaagctatgaggatacaaaggcataagaatgatacaatggactttggggactccggaggaaggatgggaggcgggtgagggatcaaagactacaaattgagttcagtgtataccgctcgggtgatgggtgcaccaaaatctcacaaatcaccacgaaagaacttactcatgtaccaaataccagctgttccccaaaaacctgtggaaataaaaaatgttaagtttcttgtgcgtccgtgtgaagagaccaccaaacaggctttgtgtgagcaataaagctgtttatttcacctgggtgcaggcgggctgagtctgaaaagagagttagtgaagggagataggggtggggccattttataggatttgggtaggtaaaggaaaattacagtcaaaggggggtttctctggtgggcagagtgggggtcacaaggtactcagtaggggagcttttgagccaggatgagccagaagtaggaatttcacaagacaatgtcatcaattaagacaggaacggccatctggatgtgtacatgcaggtcacaggggatatgatggcttagcttgggctcagaggcctgacattaagataataaaataaaacaaaatctgaaagtaaaattgtttgcccagtttttaaacaaacccagtagtagttttgttatatctagaattaccccatcactgtaaggctgctttgtttttttaatctcttttcctctgaacaaccctgacaaaaatcggatggaaactgacattttcctttctcaaccatgctcatccatgcagctttgacatctacatgaatggttaatatcattgattcttgttattcctgtatctattatgctctcacatgcaaggatcttcatgttctttgccaggattcccagaaagatgctccctttaatattaactggtcaattttgataatggagttgatttttctttaacgtttataatcactgtaaacttcttgacaagatggtgctattataacactgactgtttctgccgaaagaagaatgttcagtactaagacatttctgccaaacgttactacaactttgaaaagcccttcctctggcttgctaggaagctcattggagaccctaacttggagtttgttgccatgcctgcccctgccccactggaggttgccatggacccagctttgacagagcattataagcatgacttagaggttcttcagacaactgctctcccagatgacgatgatgacctgtgagaatgaagctggagcccagcatcagaagtctagttttatatgcagctgtcctgtgatatcagcggagcagggtatgggccaccttattattatctagctaggtggggcatgtggttcatctgtgggatgctgaaggagatgagtgggcttcggagtgaatgtggcagtttgaaaaataccttcattgtttggacctgcatattgagctgttttggaatgcagttgattccttcttgagtttcaaatgtaagactgctgcaatcacattagtgaattcaggggtgagatcttgttactgccatttctactccttttcatttagaatcagaataaagttgtatttcaaatatctttttaaaaatatatttacattatatgtgtatatatacatatatgtatatagtatatgtataaatttacatgcatatatatacatatatgtatatgtgtgtttacatatgtatatataaaatgtatataaacatatatatatttatacatatatatgacacatatatgtataaatatatctatgacattagacataatgtatttctatatctaatgtcatgcatatatttatacatataatagatatataaatacatatatattaatgtctacatttgacattacatatgcatgtcacttgaaaatttgtgtatataaaatatatgtataaaactcaattcaaagatatgtttccagtgatgggtcttgtcaatgtagacatttaaaatgatatttgggaattactgatgttattttaagagcttggtatgtcagagattttcaaatggaagcagttgctatagtaaatatggattttctcctaattaattcagacattaaaaagttactaattgcctacttttttcctaaattgcttctggaatataaatatttataatcttcataatattcccatctgataaaggttaggtttgatttcactttctttctaaaacatctgagcattttcaggctctaactccaaaagaacaaaactcgtgaagatttaaaatattttaatagattatattggaattccatttccattatattgaagttactttttccattgctatcatattaggaaaattaaatttatacatgttctatacttaaagttaagttttagaagtatcttttccctaattgttattgagaaattaattttaatacacttttcatctttccaacagactactgcaaacaaataataagctagaagtttagtttattccctttcctaaagctcttctataaatattgactccagcaatggaaaaagcaaaagtatagtcagcattctgtatcatatatgacatatagaatatagaataggctataccatcaataagataaatcagtgcctttataagaccaaatgagtatatcaatctcagattaaacaatgcaaagcacttcgttcaagtggcattttcaccctttcaaataactccactaaatatataatactcatgaacactaataaaataaaaatatatgtgttactcttctgtatatatctgtaaattgggctccaaacactacattttccatttatctatacgactctaatgaaagcatcttggcttaagaaaactaatagatctgaggtggtaaagtctttattattgaatcacagaactttgcctaaatgcgaagttctagcttcaagttaaaaaaatttataaatatttcaacatttaatttagatacagcaggtacaagcacaggtttgttaaatggaaatattgcatgatgctgaggattgcagtatggatcctgtcacctaggtagtgagcattgtacccaataggtagtttttcaatcaacgccctccctctttcccctctctagtactctgcagtgtctactgttcccatgtttatatgttcatgtgtgtccaatgtttagctcttacttataagtgagaacacgcggtatttggttttcttttcctgtgttaattttcttaggataatggcctccagctccatccatatttctgtaaaggacacaatttcattaaggaaggagggaaggaaggaaggaaggaaagaaggaagggagggagggagggagggaaatctagaggaatggataaattcttggaagcccacaatctgccaagactgaaccaggaagaaattcaaaccctggatagaccaatatcaacttctaaaactgaatcagtaataaagtttgggtctttcttaaaatttctattttgcctttcagctcttaaatgatattactggattgcttggtttccttgaattgaatttcaacgtttccctggatcttgatgtgctttcttgctctccagattctgaatttcatctgtctgtcattttattaatagttatttaagattgcttaagaaccattgctgaggaggtagtgggctcgtttgggggtaaggaggcactctggcttcttgaatttccagagttcctgtgctgattctttctcatcttggtgggtctctggtcctttaactgtggcagaaattgagtatagtcagttgacttcatttctggacattttcagaaggccacacaagactctgtgcaggggtttttgtttgctgttgaattcttgtccttggcttccaaggcgggtgaatggttttgtggtggtgtagtttggggtgcaatccgtagatggtgctttagagctatgggtggtagatggatactcagcgctggggactgtgtatcctcgcgtgtgcagctgtgctctgaagtgtgagggggagaggggtaaccccctcaccagttccactaataggccttcggaagccactgctgatcaccggcactgtgccgtggctttgtttgtttgtttgtttgtttgatgtttctggctgtgggcttccctggggcaggtgttgggcagggggatagaccacgcccttactgggccagctctgtggaaggaggcattccaggtgccacaccagcctgtgaacctgtgcatctcacccttctgagtgtgggctcctctcctactcaagttccgagcacaggtaccagctcagcactcctgagccataggatccaaccctgcagtgccagaacctgctcacggctccctcctctggactgggttgggttgggttctgggtgtgctggggatctaaggggccgcaggctgccagaacacactccagtggaacacagcacccaggctgggcagcagacgcttcactgtgcatgtgctgctgcggggcagccaggcaggagccctgggaggggctgacaggcaggcggggctgcgggacagatgtgcctcagtgccgtggggaagctcgccctgctttctcccagtccaggagttttctggggccagggcctctcagagggagatggagagccctgagagacgggtgcctatagctgggctctgtcagatctgttccacacacaaatgtccccagctccatgtctgctgaatccccgcctctatcaaatctcccaggagatgcccctgccagctcaaacatccattggggttttggggttccctgcagctaggatcccagaagtctgcatgagcgtgggctgtcccccaggctcttcactcaccccttcctcaggagccatttgaggcccggaatcagctttagcattcaggcacctcccacagggcttccagcctcctcttgcttcagccttagcatctgcgtgttttcttcatccacattcggtattttctctctgaagatctttttaaattacagtggtttagaggtggtagcggcccttcctggctgcctctagttggccatcttaaaactcctctcctgaaaagaaaatgttatggaaacatgaggagaacaaatgcctgcaaggaaatcaaaacagtgctgtgacaccattcagtgtcagctacacaaaagaccaaaaagtgaagctacctgtaatagactagaatctgttggttaaccaaatggtacagaggtcagtttacttactcctaactggtaaattcagtttataggtacagtgtttcagtgggacttaaatcatgtagttggttcagctttgttatgaggatcgtgaaatacctctgtaataatttcatttctgccttctccaaatatacatgtggtatatgtcatgtaaattaccttatatatttaagaaaccaaataagaagtttcgagcttggaataattcatgtgagctaactagtttctgattaaaatagcatcaggaaactgagtcaggcattttttttttcatttgccattccctgtaaattgggtattacatcgtgatcatgaaacttaccagtgaaatatgttctatgaaaaaaacgagaatacctgcaattaaataactcaaaatgccattcatttaaaacacatttattatatgcccagaattttcaagatactatgcaagacactgtcgggaatacagagatgattaacatgatgtttctgccctctctggatatgatcttcactaatactggttcattgtaatttccacttttattacctttcttaatgatgatattctcagtcggtgattttgaagataagcagatttctcgatgactatttaatgcataccaataatagctttatttttgttatgtctgggtaaagaaacaaaggtttatttcttttccttgacatttatagcatcctatgtatctgtgttccatgaaaggttacctaaatcacatttattccaaatgggcaatatttaactttaaaaatgtcaaaggaagggtacaattctctgtagggcaatattgaattggttgactgaatgataattatggaataatgcattatgcattctcttttcatttcaaatattgattaatattattgattctaaaactcatttaatctgttattcagtagaatcattgccatatactcacttaccttttaattttgatgttgataattaattgaatcaaatattttttcagagtcatttgtaacttcatggttataatttctcaattcatgttaatgtaagctttgtaagatatgccattgttcaggtaattatgtataattaggcacaaagagaaaatagttacctacctttaaaaaaaagccatcaagatttttcagttgaaaaattgagctaaaaacagaattagaaagatttcttggagctaaactcaaggatctaaaatgaaggatgagctcaggacattttgtaatttaatattggactcatatgcacgagttccttgcaggagctactcccactcctagtcttgactacaagggcaggtgagataatatctgcattgtttggtatatttaaaccctgcttctttaagtgttatcatttaccacaaaatatcgtaatataactgtcacagaaagacaaatcaagaagaaaggaaagaagaaagaatacatattgattgtcagcattaacacacaggctataatttgatgtaatattcaactctatactttatggcaaccaagatacacaagaaaacacaacatttacatagatcttctcaaaaagaaagaaccatacctgaagaaataaatgtgtcttgatggtattaaagtctgcactttctcacttgagtcctaaaacagggaaatgagcattattcccaacaactataataacatatttaaaaatggatttcttaaatctgatgacaaatgtttagaactaccatttacataagccaagtcctactttttttttttaacaaatcctttctcctgtctcctccagatgccattgccattttaaatttcctgactgacaatctcccaacttcccaaaaagtgtttatgaagtacctaagaaacaatttgaaacttataatgagatccagaactagtactgactttgaatccattgtatggagggaatgttattacctataaagcagatgagattagatttataaaaacaaatggggatcatcaggatgttgctaccagaaagagacccagctggcatagacacctgttagtaaaaggaaaaacattttgtgtatttcgtctactgacccccacttcagaaatgctcgatctgtataaaccgtacaactagacaggcattcacctggtggatgctgatattctgaagtagccagagtgatttctccaccctaaataaaactttcttccgaatttcattcagagatgacaaaaatgaggaagtgaagtgggatggggacatcacaagtgggacattgcatcccgggaagcaaggggactctgcacacgttgctgctaactgcagcggcacctgaggtggttctgaccgctgtaaactctgtcacagaattggggagtgagtatacatggagaaaatttgttttgagtacaatttcataaccagaaaatgatacagaatcatgtaaaacaccctataattcaagggcatcaatagcaagcatagggaactgattatgcctaaaacagaggcaggtcctctatattcctccctctgaatcatgtatgtcctcaaaaatgtcccatcagcacaaaaaaaccagcaaaccacagtccatcctgatagcctcctttttcatattaatagcagcattatactgtagtttttctgtctcaaaaactgaattttttaaaactttcattttcttccctatatctgattacttgtcacctccctcccaaactcccttacatatgtaattgtcttttcccatggtcaccatatccaagttctgattaccttttaataaaatgaatgaattagcttcaacaatgcaatttcttatccaggtatccattctttcaatccttcctaattttgacatacctgtagtagtttcaaagcacagatcacatcgtgacactcctgcttatcattttcaatactactccattgcaaatattaagaaagcaaaactgagagccagacaacacccaacagatattgtctctcaatccttacattcccatgaagaaaggatatatgtaataagagagaaaggaaccgtgacttagaaactctataaaatataatccacatagattatacatatgcttatggtgatattactatactgactttacggtgctttctagaatttagactctgggccattttggcaaaataaggagcctgcagactgcttatgcctttgaagagaaaaaagaatgtgaaagatgttatttttgtgatacatcaagagagaatatgataattaatattgtatttttattcatgatggaaataaaaataggcaaacactatatatgctgtaaacctttggagtactcctttgtcgcactgggaacatggtaaaatatataattttttcatagatagatcgcactataagagacaataataatggaaactgtcatagttccctgaaattcaagttgaaatactatttacatcaaccataccgccgactccatcataatgaggaaacatctcagggattattaatggggtaaatttcactatatagagaaaaaagacagataaaaacatgtatatgcccaaacttcatttgaaaggagggcatgtagggaaaggtagattaacagctgaacttcattagccatttacagaaaagttaaatattatatctaggatacatttgtcttaaatcacccaggattaaatcttccaagattaaggatttcatctaatcaatttcacctaattgaaatatgcagcccttctgctctttttttgtaactcctatattccctcctatcctttaaattatttttcatttaaaccattcagcagtttaaaccattctagactactctggcctgaagtacttcatcagaaatctttacactttagcttaaatattcatttaataatgaacaattcatcttctattaaatgctactactcaatttttgtttcaaactatatgtacatttcttgttaggcataattttatatatttattaattggtttcccttccaagacacagaacctgcccttccctcccagtgaaaccactatgaggtgaaaaatagtgttgaagaaggaagagggacacagagaaagaaataacttcacacatctatttaaagatggccctgaggtccacccacagcatcgcagggatgagttcatgagggagtatgcagccacaatacctcttaactccccatgacttccttgagcttccttgtgtgggagtagaaggttgatggaatggttagcctttcctggtatctgtgttcatcatggttctcagcagatccagctgcataaaatgtctctatctgttaggatcaataaaacaagctctctaactgctctataatcagcatcaatttgcgaacctttatcaaacttcccccctcttttcaccaagtattcaggatgacatgatgaacaactggaccaatgattggtcaaacatatcctaatatcaaatactggcagttacctggagtaaagaaggacattttgtgtgtccctactttaaacgagatccttaaagctttttgtatggctggtctgagtatttaacagaagtcccgtactcataaggatggctagacctgaaaggagcctctcacctgcagggtaatgattcggtttaatgaggaccttttggaagttacttggctctaaggccagaaagcctaactgagatcaagacataattgaataggaattgaagatccatttacctcatcagttggaaaataagcatttttcaaaatagagagataattaaatgtggtcccttcagtgctacggattaagttagtattatagttttaatatacatttcaaacagtttccctcttattctgtcataggacattgcaattaatttaatcaacctttaaacagacatttaccaagaatttatgataatttagatattgtgcagatggatgttcaatgactttttcttcttaagtcaaaatatttaaattcttcaaaatagaaaatgtgtaatatgtgctgcatattatatgcctttttcctctttcccagaatgccttttactagttttgtgaaataaacaagatagattatatcttatatacatatgtataatatacttacatacacacgtataatataatatttataatataatagaattatattctgtattttatataatatataatagaattatatattatatataatagaattatatattatatataatagaattataattataatatataattataattatatagaattatatataattataattatatattataatatataatagatatagaataattataatatataattatatattataatatataatagatattatagaataattataatatataattatatattataataattataatatataattttaataatataatatataatagaattataattctaaatataattataattctatatataaaattatagatataattctatatctataattatatataattctatatagaattatataatatataatagaattatattctgtataatacatacacacgtataatataatagaatcatattctgtcatcttttcacttcagtctatctctttctgtgtcattttactcctttacaaagaccatatcttctttaatcctgctgagggaagcaacttaaaaataactttgatatggtttggctctgtgtcttcacccaaatctcaccttgaattgtaataatctccacatgttaaaggtggaaccaggtggagttaattaaatgatgggagcggtttcccccatgctggtttcctgatagtaagttctcacgagagctgatggttttgtaaggggcttcccctctttgattggcactcatttctctctcttgctgccctgtgaagaggtgccttccgccgtgattctaagttttctgaggcctccccagccatgcagaactgtgagtccattaaacctcttttctttataaattacccgttctcaggtattgcttcatagcagcatgagaacatactaatatgtacttctagcttctgtagtcaatgatttctggatacatactcttcttctaacactttaagataatattcctttctcttcatttaaaaatatgtaggcaacttcatattcttctcttcaaaccaaaatataggggaaactgcatagacttggtgtttgttggtaggatggattgctttctgcttgcagtatgtgaagcccattcagggttgagggagatccagtttcagcacatgggtaggctaattcacgtaactcttacttcaatttctaatatccaaaagcaattatgtagcacaaccctaaatgggtaactgaggtgggatttttttgcttctgctcatatccaccatacttataaaaattgaaaataccttacgtctaggctgtatgatcctgatcacccacctgactataatacttacatgcagagaatccactaatttctagcttacccctcaactctatctgtggaaggcagaataatgccccatccgcccccccaccacgaagatatccatgtcctaactccaagaacctgtgaatgtgttgccttacatggcaaaagggactttgcagatatgcttaagattacagaccttgagatggagagattattgggtttatccaggtgggctgagtgtcatcacatgagtccttcaaaacggagactgtttattatctgtggtcagaaaatgataggtcaaaggaaggaggcagaagaaatctgaagtgtgagaaggactcagtctgttactgctggtttgaagacagaaaatggtggccaagagctaaggaacgtggaccccatttagaaggtggaaaaggcaaggaaacagtttcttacctagagcctccagaaaggaatgtagtcctgccaacactgggttttagtccagtctgacttttgctggacctctgacctacaaatgtgcaagataatgaatgtgtgttgttttaagccactaattttgtagtagtataacattctggagtttaagagtctgaatggatacttaaagatagaaagaaatgatacaacatcactctgcccctcttacccaaatactgtctatgccctaggaatggctaccctgattttctcattagtgcagtgtccgggtctctgaaacatggaggagaaaataatgcaagaataaagtgcctttgaccatatttaagctaagagaactgctctgttttatgacaaagtagaggaatttttaatttcttgatgtaggttatgttcgacctttagtttgaaaaaacaaaaaccgttgattaaggcagtagttattatttttaaattttttagtcactgtttgttagcatattccatctgttttggcaagttcattgtggaaagatgactctgttaggattaaggactccagataaagcaggggtctttcattttcatcagaagactgatcagggtgctggagttcaggggctagctgagcactcatcccaactgcagtgctgtggccttgtgattgtcatctaacctttctgagactccatatccttactttttaactaagcatactctgttaagtgccgtcttaagagtcttctagatttctatgcctgtaattccaataaattcattaattctttcaacaattatatagtgaacaattatatatcaaacttggaataacagcaaaaggttcttcaattttaagaaacaaaatattaagactagaagcttagttggatattgtggtatatgcgataaagaaaagtaaagaggatgttatgttcaagattattgaaagtggttagggaagtcctctctgaggagacaatattataatgaaacaagcctacagaattagaagctcccagtcttgcaaatattggaggaagaaaactccagacaaagaggaggctaaacacaaaggttttgaaataagattatctaccagattctaggaacaaatggttgacctgtacacccaggcttggcatgtgagtgagaataatattattataaacttagagtgaaaccagttgacccattttgttatcttttacagataaaattcaccaaaagggtaggtaattagtcttatcaaaatcggttttatttacaaatatgaaggatggaagagtgggcacaggagatgagagcctatattaagtagttggtaactcagtaaacaatggagtctaggccagacaaggagggagagaaatataggaaaactccagtggttttgggaaagaggatagattcaaaacaaaaactttaaagggttacaatgatagttatatgggtactagagtaagtgatcttgaggacaagaggcatttttgagaagaaaatgtttgaaatgaagatgcaagatgtgcccctgccccaggttgtgacaaaagtgaattgagtccataggaacaggtgtcagggatagaggatgcggttgtttgagggagggtatcaggacctgagaagccaaacttgatgagtcattttacgaagggtgacctgttaaagaatacccaggaacaggcctggagtagtcctgaaagagggaggcaggtgccatggactaagggaccaggaaggtgcacacaatctcacaagactccagctgccatcacccatgttcatttccttgaagaaatcatcttattccttaatttttccccaatatatagtttgagactttctgattctctttctataaatacaaagccctagagatttttattatctggtgatccaaccctttttggagtgactaatcaaaaaagcacatgacagtatgcatattttataattttggaaattactcttcctatttacatatactttggagtatatcacaactccaatttagtacattttgttattagataccagaaaatcatgagttcatactacagtccctctgctgccccatttccaacttaaaatagaattaccaacttaaaataggagaaacaagcttaaaatagaagaaacaagccatcacttaagtagatatagaaatatagttgataaaatttaacacctgtaccagataaaaatttagtaaactagaaatagagctttaccttagtaagagcagccattaaaaaaatgcatagtaaatgccattgtatatattaataatttcatttaaaattaaatatgtgacaggaatgcctactgaagttaccttcattcaatttttaactagagatccaagccagcatacttgtacgctgtactgattgaaatgacaatcaaattagtggaataaaaatgggaaaaaagaaaatgaactgtcattatttgctgatcataaaattatttacataggaagctactaaagaatacagagaaaacattataaaatagcaatggatcagcaaaatggttaatataaaattaatatatagtagccaattgcatttctataacaaacacctagaacacaaaattaaaaataaattatagcttaaaatatgtcagtaactattttcaaaatattttgaaaaggaaatggcagggaatatttcacaggtgggaatagtatatgcatgggacaatgagggcacaatttgaagtaagtcactataagccaagaagcttcatgataaagctgactttaggaaggttaacctggaagcaaagtaaaatagtttgagctggggggacagcaggtggcccagagagaccagaagccggagatccgggaaaacacatctccaaagggcacagaggcagagtgaatggactgaacaggagagaattagacctcacacctttcttgaggaaggtggatctcagtgcatattttaaagattagaattcacatagatatattattttactagaaaacattttctcatgtctaaaactttttaaagcaaaattacttaaaatctttggtaagttttaaaagtttagataatgtaaatgtttatatacttttgaaaagtaaactaagtattacctttaatatttgtaaactttcataacctatcactgatatttactaaagaagagagtttaacaacactgagaaatattccaacagaaaggtgaactgttttgtttttaagcaggtgaagtacaagaagtttgatggaggccattttacttaattaaaaacttcatcaaaatgctgttttcactatctgagttgtcagaatttctacaaggctttttcatattcagtcctttcaaaaatataaaatacttgaaggcagttctttatagaagaatttaaagttacatgtcaaatgtagctcttctttttttaattactgaagccatatatggtcaagagtaacttcaggctggccgcagtggctcacgcctgtagttccagcactttgggaggccgaggtgggtggatcactaggtcagtagttcgagaccagcctgaccaacatggtgaaaccccgtccatactaaaaatacaaaaattagctgggcatggtggcatgcacctgtaatcccagctactcaggaggctgaggcaggagaattgcttgaatccaggaggcagatgatctcagtggcctgagatcgtgccactgcaccccagcctgggcaagagagtgagactccatctcaaaaaaaaaaaaaaaaaaaaagaaagtaacttccacattaaacaagagaaataaaaacaaaagcaaagttctttgtctaagcaaagcctgttaactctaattaaccagctttgcacagctgtgatagtacagcccattaattattaataagaaaataatcaatattaacctcctcttttttattggtaaatgttttttggggtctttgtgttaatttgttattttttaaattactgttttaataaatttcattatagatgctggagtaattacattacctaaaaataagatatagtcatgtagcacattactttgaagagaaaaataatatttgtaactttattaaccctatactaagcacattagtttcatttttgaaccttgaaccttggtatttgatttgcagtcctttccaaatatttaaatttccatatttactctctattctttactaaactctactcattgccttagattgaaacctaagtatctttttaaaaaaaaacccttttatgtggctatagaacagaattaggaagtttgctaatcttgaaccttgctttcttaaatggtatttttgttcattctcttcctaaactttatttttttattatttctctgctttacaatttaataagccattttactggagcttcatactctactttctatatcatataatgggaatagttttaatgcttgtgaagacagcatgtattcagtacacaaagatgaaaataatttaatcatcttcatacttattagaaatacttatattattcagtcagtaactgtgactattgaacttatctcccaaggatattataaaaataaatgtgataagagctaaagaaatttttaaagtcatcaatgattcattttaatctaatttcatcactggaatttcttgaatgttgtaagagtttatgttagtgtgtcatctaatcatagttactctaactggctagcagcttagaacaagcttgaataaggttcaaactaacagtggatgactgccaatggttagaaaaaaaaaaaggaaacattaagctacttctaatctaaattaaaatacaaaaaaatcattaaaatctacttttattttatgtcaaaattgtatctcagatactctgatttttaagtcatcaatactgttttgaaaactggacagaaatagtcactggctaacagctaaataaagagattaatcataaataagcactatctttaagcagctcacagtctactaaagcctaattaagatttataattagaaagttaaattatacagcaaatctcagacttggaggagtcctttacaccatctcgtccaaccactccatgacacagatggccaatctgtacttcattctcgttagttgccttttcagcatgccagagctattcattgacatattcagccactttgttaaataagtgtgtgtgtgtgtgtgtttttccttacaagttgagtgaaaaattaaaatgtaacaaaatagtgtgaaagcactaatcccctattccctattttcttagtctgaagcttggtgcaaaggcatcaatatcacgggcttgggattggtcacagttgagttctgtgacccttctctgtcacagactgactctggggatagtctccatggtctcagaatggagattactacctgagctgcaggaggggaatgctacctctgcctgctaaaattgttgccacctcctattgtggctgaaacatggtacttgcccagtaaagtggtgcctactatagtttttatttctgtatcaagctaaacacaaagtaaataatctggcagtagtgatcagtgatgcattgtatttactatacattaagaagaatttgtaggtctttaaaaacatcacagggatgtcatctattgcaataaatgaaaatgggatatttaattacccattaaaaattattagaagaaagagtgactatacttcccaaatgagtattgataagcctgagttcctgtaaaatggcctcgggaagctttgccttcatagcttctacattcttcacctgaaatacaaatgtgggctgttcaaagatacataggaaatactttactttgaaactgaaataggagctggggagaagtgtttctctggagggactggatcgctcctaaggctgcccaacttgtgggttttccaatgcctgaggtctttaccatttaagtcgttggatttggattttctcttgctttaaatcagaattattttatctgaggcagacagaaaaattctcaaaattgagatgaagtttcatctgatgcattaagagagtatatagaactcttgtatacttatatactcttacagactcttgtataaactatggcaaaggattctttaagacagaggccaggtaaagaacaaaatgactgaaccagactgaaaacacagcccacaccagggacagggactagtagcatcaggtgcagaattccaatcatctcctggcttgtagaaattcaaattaagatagcaacaagtacactaaacagtaattgtgagtcagcacattaattggagaggaaatgagggaaggaaaagggaaaaagagagaagttggaaggagaagaaagaaggggatgggaggaaagaaaagaagggatcgcaatgtacttaaatgtccaaaacgaaccaaaaatgttaaagaaagaacatgttgggaaaattcaacacttctaaatgctgaaaacaattaacaatggaaatgtaaaatgcttggaaccaagtgatccatatctactacaaatcaaagctaaaacattggtactattgggaaaacgttggtaatgccagccatgtaaatactgtctatataaaataacaataatatctaacacataggggaggaaaaagccacttaaatgggcaaaaataccctgtaaaccaggaggacatctaaaatggtttatgtggggaatgttatcagctaaaacacttacattacaaaaggaaggctaaaaattaattatacaaatattaatcttaaaaagtaaaaaagagcaacaaaatcccaggaaaatagaaagaagtaatataaataagaacattagataaatgttaataaaaagaccaaaagcaaattatttcataaagaccaattggtataaatatattcattaataatcataacatctttagataattatttagcattatcaaataaagttgagcttgcacgtaatctacaaatcagcaactctacttcttttaggtatatatactagagaaattcttggatggaggcacagaaaatttgtatgaatatgttcatattaacattctccataataataaaacctggaaacaaccaaactgtttatatcattatactatcagcagtagaatgctaaataaattatggaataatcaaattatagaatatgacccagtgttaagactgaattaaccacaactacatacagaaatagagatgaatcttagaaatctaatgttaagcaacaactttaaaaaaccaaaattcagaatactaggaacactaggacactatttttataaaactcaaatgagtataaaacaaaacactatgcaatgatgtggtttaggtgtgtccccacccaaatctcatcttgaattgtggctcccataattcccatgtgtcgagggaggtacctggtgggaggtaattgaatcatggggacaggtttttcctgtgctgttctcgtgacagtgagtaaatctcatgatatctgatggctttataagggagagtttccctgcacaaactctttgtttttgtctgctgccatgtaagacatgactttgcttcttttctgccttccaccatgattgtgaactcgctaaccacgtggaactgtgagtccatcaaactctttcctttataaatcacccagtctctggtacgtctttattagcagtatgagaacagactaacatgtgcatatgttaaaacgacattttgaaagggaagagaaggaaaatattacatttcagaatagttattctgggtgaaagtgaagaagatgggaatggaaggagacactgggagcatcaatcttaatgcttacactaaattctcttgttgggtcatagactcaagaggatttgtttaattggtatgccatataatctaattattaataatatatgggttcttctgtatcaagtattacataataaaatatttttaaaggcatagaagatcttttctgttctgtgcctcatataaattatctcatttactttgaagcaaacttttgaggcatttattattgccctcattttaaagatgaggaagctgaggtttagagaagccaagaaacacagttcttgagagacatagctagagttcaggtctgtaccgtagccccttcctttaaccattacactgtctttctccatttggaccctttatagagggaagatcacagcactgacccctgttctcattggagtaggaggtgctgagagagctatgtaaaaagtacacactggagagtggaaaattttcacagaaatattgacacataaacttaggcaaacagaaggtagaaaagatgtttcaccaccaaaaactgtccacgtagagatgtggagagaaccaagaacctggaggatgtgagcacagtgggccttctggcatggcagaagcagagggaagtgaaggagggaacagcagtgctaaggatagaaatgcaggtttggtccagttgaagaaggcacttgatcttttcgggctgaccagtaggtcttaaactgtagtgcatattgttatcacctggcagacttgttaaactgaaggttgctgagccccattctcaaaatttcagactcaataagaatgagtggagcctaaacatttccattctaacaaatgctcaggtggaaatcactttgaaaagcaaagctttagggctggcatataaggaggattgcttttagaatgtcagtgatggtgaagctgtggagaatgggctggggagaaagaatgaacatggagagtatagttaagccactgcaggagctcaggtaggtctgaaacagtggtggtggagatggagagagagtgctgcagttgaggcatgtctgaagtctatgaacataaagtagtaaggcatgagttgggggcataaagatagagaggctcccaagctcctgccagaggtactgagtgaagagtagactcattaatcaatgcagggacaacagagaatcaactcaggtgcccatcaacggtagactggttaaagaaaatatggtcacaaataccatggaatactaggtagccataaaaaagaacagaattatgtcctatgaagcaacatggatgtagctggaggccattatgctaagtgaactaacctagaaacagaaaaccaaatactacatgttcccacttgtaagtgggaactaaacattggggacataaatatgggagcaatagaccctggggactgctacagcagagagagacggattggggcaagggctgaaaaactgcctattggatactctgctcactaccagtcacaccccataccttagcatcacactatatatctttgtaaaaacctgcatctgtacccctgaagctaaaataaaatttggaaaagaaaaataatcgatacataaaataaagagttatgctggctcacacctctaatcccagcattttgggaggccaaggcagatggatcacttgagctcaggagttcgagatcagcctgggccacatggtgaaaccctgtctctaccaaaaatataaaatattagccaggtatggtggtgcacacctgtggtcccagctacttgggaggctgaagtgggaggaccatttaagcccgggaggtgtaggttgcagtgagctgagattgtgccactgcactccagccagggtgaccaagtgagacttcatctcaaataaataaataaataaaatgagagaaaaaagaacaaacaaatactcttttcctccaagagggcactagaaagaggatacataatagtaacttttagaagagatttataaaaaatagagtgtgaattaattgtctctccccttggaaacaagagtttaacataaacaacatgggtttgcagatgtgtgtgggcaggatagggcaagaccaaggacagcatggtatcagtgaaggaaatgtgtaggagagtccagaaaacagcagccagttgagaagttcgaagcctgtcaaggaggatattttgatactatttacaaggtacttcacatacacgcatgatattttgtggcaggtaatagtaaggatgtaatattgatagaagagggagagctatgaaattgactatccccaagtagcaaacaagaattatagggtgaattatcctctcctatccctgagagaaagcaccagattgggcttctgtaaatgcaaaatacaggatgaaataaaggctcagtctgacagcggaagcttttggtttgttttctttggttgtccctcaaagtagaaagtaaagagaaggaggaagtagttcaaggtgcaaagatattctgaagtggagaaggaagaagtccacaggagtcatatgcagttaggtaatctggataagagcaaaagtaaactgaaatatgcagtagggtttgcatcatgggaacaaagaagattaatttgatgtgagtgatatgagctagggaaataatttaaaaattgaaaaaaatgtgaataataattgtagagattattccttttataaattgtgttaatacacacttcttttttaggggctagcatcacaaaattaccagaagcattgtgttgttttgccaattaaaggaatccaaataactccaaaatgattaattaccactttctgtaaatcctcaggtgaactcatttgcacagaattccctgcagttgtaaagaaaacagaacacttgacaacttgtcaggcacctacattcttttttccttttatttattaaattcttttactattacatgttattttccacagatgttatgtgaaatttctctcctaagcaaaataaataacttttttaagaattagaaaatctaaaggacaaaattttatattataaaactatacatagtattttattttgctggcataaatgcaaataatcatcttacagaaaaacattaatattacgttttgacttctttccacatgacatctacaaggcaaataacattacaaatcctcagtactttctaactgatatatggaaatagtgtggaaaatcacatgtagaattacatgtagtatgcttgtaatactgatttcctacaatgtacagatagggtaatactctgtccttggaactttgctgagaaagtatcaggaaacataacaggaaacatatcagaaacaactaaatggtgatttgtactaacattaatatattgtttatatataaataactctatacacatctctaagtataaatgcacacatctgtatgcatacatttattaacatccattgatataccacaaaaagtttgattaatcattttgagaaatacattaaaaaagaaacaaaatttttaatcttctccttactctatgacttccaatcttgggctcacattaacaccacttttttttgttgttgttgttgagacggagtctcactctgtcgcccaggctggagtgcagtggcgcgatctcggctcactgtaagctccgccccccaagttcacaccattctcctgcctcagcctcccgagtagctgggactacaggtgcccgccaccacgcccggctaattttttgtatttttagtagagatggggtttcaccgtgttagccaggatgatctccatctcttgacctcgtgatccacccgcctcggcctcccaaagagctaggattacaggtgtgagccaccgtgcccacccttaacaccactttttgaagatatctttaccttcaaggggtatttgtatcccaaatatattcagtccattgtctggcacatcatctgtcacatatagagctgcaagaagctcttccagtatcctagcatcaaaagaacattctcttcatgaccatttcactgcacctcagaaaaacaagaggccgaattcatcttcctagtcatgttgtggtgtaattaaatttaaaggaatcactacttatgtaatgtattttttccctttaagttgtctggagtaagttttggagaaacttgcatgataatatcaaaacttgttttcttattgtgttcagaaagcaaaagagaaatattaacattatttttagccttcttgtgttactggaaccatgtcacagaatgagagtttctctgggaataagatgtattgcaatattctgactaacagaatgtcagagtaagaaatttttatcagttgttctttgggtcattgtcacacatcatctgcatataatttccatagcagtgaacagtgaatgtgacattagcttcgcaatggtgttggcttgagggctggatataccgatgtgcattccagtcatggcaattcctggagaaaaaaaaattaattataatcattttgcataaatcaccatgaacaatgaggtactcatcaccttgtcagttagtttgcagcattcagttggctggcaaactggtgactttatgaagcattaaactatgtcaccgttagccagattaaactcactgtaacattatacttacataaagtgctttgtgaaggaaatatgaaaaatgttaactgaaccgatctcagaagacaggaaaatgattgtgatataatgcttgggttgaatattgtcactttcctggtgtaagcccattatggtttccaaaggactatattcaaataataagaaaaaagtcaggactctaacttggaagatgtaaagacatatatatattagatgaaatactctaaatgagaaagaaagaaaagaagaaaagggggctgtaaaatgactcaccatgtacagtctagaatcatagagacagggtgggagaggcccagagagagttgaagggtccagtatatttcacccctcagattctgtggattagaaaccaaagtctggagaaggttaagtgtctagcccaagacatagctagaaggtggtgggtccctaacctcgaatatagtatattttcacaggagcctaaatgaaatggaattcagggagtaagataaagaccagttttcattaacatttgcgttaaagttaaatatcatttttatgagaagacaaaagtaagatcaaatcctgaagtcaaagtaaataaccctgtgtaaaaacgcaaagttcatgggctttacaggctgtgctcacaagtctatgaccactgcttggaaggaacaggagtggaggctgtggcttattttcctggtggcatgtggtatgagccacaattttagtgaaagggtacagtcatgtcttaggtctctggaaactgcctaatgatttgatatcctggagattttttctggtctgctttatggaagacatttatatataggacagtgaaaaacactatttctggaggggaaagaacaatacggttaagtctaggttttctatttcttcttgagtttgttttcttttttgcttttagatttctaatcagctcaaaagatctccaagtctccaaacccttcacgaattaaaaaaaatgtaaaccctacaaatttcttaactccatctgcataacactgccacagatagaaaagtgtaaacaagataacaagagcatgggcaactctgtttttaaaaaagcaaaactgaattttattccagaagattctgtcctgtcctgtttgtaagctacgctgccaaaaatgagtgccaacactttgggagtggggagtgtatattgtttgaggtataaacatgattataatgtacaaaaataataatttacaaatgaaccacaatttctaaggttgcttcatatatgtcaattagtaaataaataaatgcataattaaaagaaaattgaagtaaaatagtcatttggtctcagcaagactctcaacaccagccaaagcatgaaggaagtaatgtccttttctctattcaagctgttacagctttctccagtggtcggaaacattttactcttcaccttctgataaaatcccagtcagctgcctttccctggtccgttcctccagcctcccatgaagaagtgatccttctcttttttaataccacttcttctcctctttatgtcttttgtcacatatcactgaaattttacccaaggactataccctctttctcctaaaagttccacctccctacttctatattctgatccattagttctcagtgtggtcctgggaacttgttaaacatgcaaattatctggccccactgcaaacctactgcatcacaaactctggggtacagtccagtattctgtgttttccccaccctctccaagtgactcagaaacaggctaacatttgggaaccacagctctaatatattctatcttaaagagaaaaaaaaaatggtactgcagccctgggtttcccttctactttccttcttccctgaactgtcaaattcctcagagtacttgttccctttcctttctcttattacatttgttttccaactcactggtcatactcagtgtcgtttggcattttgaggaattacatgttcggattgatttttgtgctgccaaataactacaatgctttctaaagttggaaatacagttgtgactagtggatgattagattcttctttgtagctctatttgactgtaatgggcgcaacttactggttttaccccagactagtccagaaaattatttagtgaacagaattgtatttttgcagtctaccaattatatcactagatatcttggaaaaaaacgccttgcaaagtagtgatagctggacaacctgggttgtgatcttggcttcttcattgtgtgacaataatataatacttaattattcttcacaataatattagtagttaattactcgttgctattagtaattattttgcttgctcacaaaattcaaggttattcatgtatttttctatctaaagcctcataaagcacagtgaagtatatttaatatcaattttcagataaataaatggaagtttagtgctattagggaacttgtccaagttaatgtagctaaaagtaggcaatgagctggatttccaaccaaggtctgtctaagcctgtcgaacaggctgctaatgaaaccttctgggaagttgttgtgtagattattctatttatgtattttattagttcattcaaaagcagtgttaagcctctgctttctggggtgcactaggctaagccctggaaacacagagaagaaagatacagcccacaaggaatcacattctggtgaaacaacagataactaaactatttaagtagatttttgtaagagtcatgatttagaggcacacagagcattgagggaacatggagactatatgaggtacataacctgggatggggagctcatggaagccctgctagggtcagtgaccttagtgttttgttagagaaacaagagccaggaaataaattgaatgaaaggaatgtaggaaaggaacctcagacataaagaataccagttgcaaagcaggagagagtaaataaataggcagaggtaagattacaaaaacttccatgcccttcaaaggaatcagaatgtctagaaggcaagaggaggagagtagggatacttttaagacaaaatgagagttagaaatctcataatgacaatactgtggaaagtggatttaagcattagaaggaatgaatgccaataattatcttagattgttttttttttcttctaaaaaaaagtggggggagatacatgtgcagaaggtgcaggtttgttacatagttatacatgtgccacggtggtttgctgtacctattgacccctcctctaagttccatcccctgaccccccaccccccaacaggccctggtgtgtgatgttcccctccgtgtgtccatgtgctctcattgttcaactcccacttatgagtgagaacatgcagtatttggtttttggttcctgtgttagtttgctgagaatgatggcttccagcttcatccatgtccctgcaaaggacatgatctcattcctttttatggccgcctagtattccatggtgtatatgtaccacattttctttatccagtctatcattgatgggcatttgggttggttccatgtcttttctgttgtaaatagtgctgcaataaatatacgtgggcatgtgtctttatagtagaatggtctctattcttttgggtatatacaaagtaatgggattgctggatcaaatggtatttctggttctagatccttgaggactactgtcttccaaatggttgaactaatttacactcccaccaacagtgtaaaagtgttcctatttctccacatcctctccagcatctattgtttcctgactttttaatattcgcccttctcactggaatgagatggtatctaattgtggttttgacttgcatttctctgatgatcagtgacgttgagctttttttcatatgtttgttggctgcataaatgtgtttgagaagtgtctgttcatatcctttgcccactttttgatggggttgtttgttttttctggtaaatttgtttaagttatttgtaaattctggatattagaactttgtcagatgggtagattgcaaaaattttctcccgttctgtaggttgcctgttcactttgatgatagtttcttttgctatgtggaagctctttagtttaatcagatcccatttgtcaattttggcttttgttgtaattgcttttggcatttttgtcatgaagtctttgcccatgcttatgtcctaaatggtattgcctaggttttcttcaagggtttttatggtttggggttttacatttaagtctttaatccatcttgagttaatttttgtataaggtgtaaggaagcagtccagtttcggttttctgcatacagctagccggttttcccattaccatttactgaataggagatcatttccccattgcttgtttttggcaggtttgtcaaagatcagatgattgtacatgtgtggtgtgatttctaaggtctctattctgctccattagtctatatgtctgttttggtaccagtaccatgctgttttggttactgtggtcttataggatagtttgaagttaggtagcgtgatgcctccagctttgttctttttgcttaggattgtcttggctctatggcgtcttctttgattccatatgaaatttaaaatagtttttttttctaattctgtgaagaatgtcactagtagtttcatgggagtatcattgaatctataaattactttgggcagtatggctaatttcacaatatttcctatccatgagcatggaatgtttttccatttgtttgtgtcctctcttattttcttgaaaagtggtttttagttctccttgaagaggtccttcatgtcccttgttaactatattcctaggtattttattctctttgtagtgattatgaatggagttcatgatttggctttctgcttgtctattgttggtgttaaggaatgcttgtggtttttgcacattgattttgtatcctgagacttggctgaagttgcttatcaatttaaggagtttttggtatgagatgatggggttttaagaggagccagctatctggattctagattttatgggctaaatggtgtctctcccaccacaacatttatattaaagggagcttggtactctaagccccagtaactcagaatttgactgtagtgagagatagattctttaaagaggtaattacgttaaaatgaggtcatatgaatatactgtaatacagtaaaactagagtccttataagaaggggaaattaggacacagacccatacagatgaaagaccatgtgaagacagggagaaggttaccatctaaaaggcaaggagagacagtagaagaaaccaaccctgctcacaccttggtcgcagacttctagcctcaaaaatcataagaaaataaatgtctatggtttaaatcacctgctgtggtgctttgttatggcagcccacaccaactaacacacaaaactgaaatttcatattttcattgatggctaccattttagatcagaatgacaactatatgctggacagattcttctgtagataacatcagacccacctagcaaatgtgtgctgaatttgctaaaagtaaaatattagctaggaatggaccatgttttcctttaatacttttgttaagacacaaacaccaaagactttccatttttgccactgtcttttctaaaggatgaattagtatgatataaagcatttgaagccttaagatgaaggaacactgcattaagttcaatgtaatcttcactttaaatctcttcttgagtgaagagtgcaaacatgcatccctgcctgaacacaaaggaataaaacctcgcctaagcactcctgacagtctttcatgcccacttgagaactggtcatctggaaccagccatccctacagctaccagaaaatacaacttcctctgtcactttcctgcagtatcacaaattacagaatggcacaagcgtgaaagagcaactactgaatgacgcgaaaaatatacagctaagagtgtgcaggcgagtgcaatggtgaggctcaaaagacttggtggagggtaaaacacagtgtgatcctcaagatttgccaccacagctgacttcctaattactactatactgctgttgaggcaggagaatagggtctggaggcagggaacctaaggctgatttacgcggacttctagaactaaatcaaaaggaaaaccccaactttccacacctaagtaacaaaaggactggaggatacgccctttgcaatcccccctccttttctgtgtggcagatagaaaattgaaagtatctctgattggttgctttctgcaaccaatcagatgattgcataggagtataactttgtaacttcacttcagcctctgattggttgctttccacaaccaatcagactagttgcacaggccactacttcatttacgtagggtatacaccaagtaaccaatggaaaaacctctagggggtatttaaaccccagtaaattctgtaaactggcccttgagtccctatgctcgggcctgcccccccgccccccgtggagtgtactttcgttttcgataaataatctgcttttgtcacttgattcttttcttgctctgtgtgtttcgtccagctctttgttcaaaacgccaagaacctgtacatcctccactggtaacactatctctgaataagataaggagtaatattagagctatcgttaataatataaataataggagatctctcttgccggaaaaaaggggaagcaataggcaagaaattagacaattcacccacatctacgctgctattaacaaaccaatgaacaggtttttctcagaagatggagaatatccagtaatactctgcgtgaattagaacatttggtgtgattaactgatttttgaagtgcacatattttgcctgactcttctaacttataaacaatgtctaaggatattaaaacattttcttcaatagctttatattggtttctaagatatctttatgaaaatatttgttttctaagatgttgaggtaattcagtattctttcagtaacttttgttttttctttaaaattgtccaaaaattttgagctctaaagtttaaaatatttgaagacttttgcagaaagtttttactaagacttaagcaaaagcgacttcagaaacttggtaatatggtattgcatgcctaaatacttgaaaaattcctatgattctttaaaaatactttttgaaagttcatgcctaaagacaaatgaaaaacttgattatttcaaaaacttattgataaatctattttactttaaaaatatctatttaaaacgtttatttataaaatggaatatataaaatgtgttaacactgcctaaagaaaagctttaagtaaaacttggctaaccaaaatgccagcatagttggtttccaatatcctttttttttttttttttttttgagacgaagtctcgtaggcccgggctagagtgcaatggtgtgatctcggctcaccacaacctctgccacccaggttccagcaattttcctgcctcagtctccagggtagctgagattacaggcacctgtcaccaggccaggctaatttttgtatttttagtagagacagggtttcaccgttttggtcaggctggtcttgaattcctgacctcaggcgatccacccacctcagcctcccagagtgctgggattacaggtgtgagccaccgcgccaggctggtttccaatattctttgttgaaattgtctgttgttgttatttggaaacaaagacaaattgcaatttgcggattttaccatcactgctgttttgttgtttaccaaacgaactttaaatttactttctggaagcttactcagatgcctcctaatcctgtacattttatacatttatagtaattttcagtgatagtttgtcatatgaataatgaacctaaaaccctgaatcatttgtatttatcaaggaaagactactataaattcattgaaatgtctttattacaacaagaaactgcaacaacaaacttttgaaagatttataggaagaaggaatgggtgattgtggataccagagctgagccagaatttaacaagaaagagcaatggcctggaatattgccctctaactagctaatcaaaggacttttttttttttttttttttttttgagacagaatgatgctctgtcacccaggctggagtgcaatggcgtggtctcagctcactgcaaccttcgcctcctgggttcaagcaattctcctgtctcagcctcccgtgtagctgggactacaggcgcacaccgtcatggctggctaattttttgtattttattagagatggagtttcactgcattgcccaggctggtcttgaaccactgagctcaggtaatgcacccgccttggcctcccaaagtgctgggattacaggcgtgagccaccgcgcccggccctaatcaagatcttagcatcatagcatgagttaagggcaaatacaggttctcctcacagtctaagggctattaattgaataattaatagtattaaaatttcacagcaagatgccctatgaaaataaattcaacttaagtgatagatattaagaaatgcaaaactttcattttcagataatatactatgaaagctaaaacagtatactacgtttcaaactcatttagtaattattcaaacatataacaatctcctgctggtttttaaatggatgttttacattatgtgccttctcttcaaatgtggccttttctaagttttgattgaatagaatgggtttttttttttcaagatcaagtctttttgtagggcttgttgttgttttttattgctagctaagtggttccttggagattgtggatgaatattgagattctttagagaaatgaagttcgtctgttacaattacactggcatgcttccttgagaaaagcagaggatatacagaaacatctaggaaagcctgtacatttttgagaagttagaaaattagttcccgattttcttttcttttgaaaaaaaaaaattttgtttcattatctcaagaaatgtggaattagctagagagggttgtcttatttttaatttgaaggagtggattcaagtgagaattaatataaacacatgctaatagggctgctttatgcttatgaggggcaagttcttcaccttcagccacactcaggcacaaccatgaagtgggttgagttggctctcagatcctcagccagtttccccctccccctccccctcctcctttctcaccacttgctgtaccctgttttcttccctctggcacctggtgttctctttacccactgctgcttctcccctgttgctccagagacaaccagtgctcaagaaaaaaaaatagtaaatgacttccatgaaagcatcttgaaactccggtttagacagagtaatgccaagacttgtgagagggctgagatttcactctgcttacaaaccaacaagcttgctaactcctgcaacagctccacggatgctggcagaagacatggcttctgggtctgggatgaaggacagcttattgctcgtagcaatagtggacagaatatcaacattttcatggattccctgagccctaattcagagggtctgcatacagcagggtggatttcaggagagaggtctcaagcttaggaaaccacaatcctttaaaaaggactgcaaccaaagctgcccaacatacaccccagagggacattatctttgttctagtggacagcaaatacaccttcattctgcacaggcagacgccaccatttctaccttccaaagtggttcactataaaaagttttttagaaaatgtccagaacaaaagatgattagtgtctctgctcacaagggcagaaaagcaacagactcatggagaagtctctcccaacatgcatatgttctgtgtatgcaggagggaggaattcatgggtgtaaagttaaaatagggcattctataaagcctacccaataaaataatgtaatcttacatttgtatggagaagagaaagtcttcgttgtttttgtctgcttgtttttgtaagatgaactataaaacataaagctcaaaaaatgcatggttgagatgtgtatgtaattgaagtattttcaactgagggtcatgttagtgttttaatattggcatattttagaagagtgaagatggatttaaaaggtagagaaacactggcttaatcaccgattatccacagggatgtttacattcagtggaggctaaagcctaattctaacatgatttcagtcatcggccaggatgtggggcagtgttttgagggtcagagagaggccttttcacagaaattactccaaaagaatggaggcctactctatatctaaaacattgtctgaataatgaacacaataattaatttgcttacattccttttaggaaatactgaacaatttctttgaattccttcagggatcttcgatatttattatacacatttcagtaaagaatgttaaaataagtatccctgtcccaaacacccagtctgtttctggtattttgaaggcgtgaatgtctcattaaccgagacaatgggaatgatgctaagaaaagctcttttttatttaactctcatgctcagtttatttttattctcatagttattatattctttagaaatattatatcctggtttctgcagttacactacttaagcaatgtcagtaacacagtcttctgcatagctccttgttagaaaaaagcttccctaatgcacagacataggagagggagaatcaaacagtaacacctcttgacatcctcaccagcactgtcactgggaactaattggaagataaactcggagaagcttattaaccctcctaatgtggataggaattggataggggcagggtgatagaaatcagtgcagggcaaaatgtgggtgtccctttcactttcacagttcagtaagatataaatactgtgtcatttttgttttcttgtttgctttttatttttagagatagagggagaaataatctagcattgtacattaaagtaatacattagaaaaggaggaaaactaatacaatatttttcctgtagcaaaaccccagaaatgcaaaaagacaagcaaaaagcaaggacttgagcttacacaatagaacgaatgtcctttacataaaatgttagcatatctgtaccaataaactaatttctaaccataaatatttgcattacgagaataaagatgaaaataaaccaatactttattaaatgggggtaagaaaattctcaagatagaatgaaagaaaaaatagtaaagataaaagtaggaattaatgaaaaagaataaaaattaattctcataaaagacagttgccaaaataataaaatagtctaacatccaaaatcgggctagcctgatttaaaaaaaaaaaagaaatctaaatgctccaaaatagtgatggaactacaacatgcaatctgaaacagtagagaaaatgaagacacaatttaaagcatgagaaaatgaaaataaatggtaaaaagtatcatgcacaatgagattatgcatgattcttttacaaatctgaaaatgtgtgaaacaagttattctgaagggaatataggttgccaaaataaaataaaaaaacatttatagatgaagaaaggtacagtatcaaactgtccattaaccattgatcaaaaattaatgtcctctaagagatattaggagaggccccaagaatgatagactggagtaggaaaatgtggcacatatacaccatggaatacagccataaaaaaacggatgagttcacatcctttgcagggacatggatgaagctggaaaccatcattctaagcaaactgtcccaaggacagaaaaccaaacaccgcatgttctcactcataggtgggagttgaacaatgagaacacatggacacagggcagggaacataacacaccagggcctgtaggggggtagggggctggggtagtgatagcattaggagaaatacctaaagtataattaaaaaaaaatatatatatatatagtcaatctttcaaggaatagatcaatattgttatggacacatttccagactgtagagaaatatgaacaactcttatgttcaaatattccataagtctgattcttacacatgataaaatctgtctaccacaggaaaaaaaaaagcttcaagccaaactcatttttgattatagatgctaagattgaaataaagaaaaagtaagttacattgagctgtatagacatataaaatagcactttaatacattaataggtaaacttagtttgcaaaattatttacattgacacaaaaagttatttgataaattcaatactcatttctgattaaaattttttgtaactgaggggggaacacttatttcatttaatttaatattttaatttattttgggatggagtctcactctgttgccctggctggagtgcaatggtgtgatcttggctcactgcaaactcggcctcccaggttcaagcaattctccccagtagctgggattacaggtacccaccaccatgcccagctaattttcgtatttttagtagagatagtgtttcatcatgttggccaggctggtctcgaactcctgacctcaggtgatccgcccgcctcggccttccaaagtgctgggattacaggcatgagccaccacgcccaggctcttaattttaattttaattgtctaatgacagaaaccatgagaatagtccagaaatacttcttagaataacactttaatacacatagattcttgatataatttaaaactatattattaaagtaaataccttccaatgtttgcttttgcattaatattaccatgggtatcaagatagtactattgaaacaaaaacagaaaaaaatataaaacagaattcaaatttgcaaatgatatggaagctgaactatgtatacctgacactgatagttgcaatgctgtatcaagagtttccctgataagctctactactaattgtaccagctagaataaaaagcaacaatagattataatagcaaaatgtaagaaattagatctgataattaacgtagtagggaggggatgtgaagatatgttgtttagaataacttagtttttctgaaggacgtaagatagcttagaaaattaaaaagaaaggttgtgtcataagagtgtgtaatgtaaagctcttaactttccacaaagtaattattatgtttaattatattataataaaaatttcaaaaagactttttgaagacaaattgattctatagttaatctagaagaataataggatgatatagattattctgaaagaaaataagagagcagcttatgccaatatatatgaaaaaatatatgcatatagaataaatgtaatagtaaggaattgaaacaaaaatagaatagcatcaatcaataaaatagagtccaaaagtatgtataaaaatgttgcatttaaattgaagatgaaattaattatttaatacataatcctggaagatgtgtttcacaatgaaggggaaggtaaatttagattatttgctcaattttccaaagtacttagcaaatagattaaatgtgtgtctataaataaactggaaaataaacttatcttaataagcatttgttgggtctcaagatgaggaacaccatgctatatgaaacagtgaaatccatagtaaactccatgaaaggagcaattaaacacaaaatcaatttttaaaaaaatatttaaaaaccacaaatcagtgtttctcaatttgggtttctaggtacctagtgttgatgatttatatttatgattttataggtaatgtaatgtatcaatattgcttcattaattttaacaaatgtaccacgctaatgtaatgaataaatattaggggaaactgggtgcagagtatatgtaaatctaaaactctcttaaaataactcattttaaaaaatggaaaatgttaatactaagcaattcagaaaatctattacaagtaatagaaattgctaaggtaagaaaatatcattaatctcttcagcatgaaacaaatgtaccaataagttgccttgtttaacatattaaagtaataaatgggtggatttatatctgggtgctctattctgttccattggtctctgtgtctgtttttgtgccagtaccatgctgttttagttactatagctttgtagtacactatgaagttcaatatgaattcaggtaatgtgatgcctccagctttgctatatatatttcaggaccttttgtggtacaaaagtttttgggttacatgaatgaattggatagtgatagtctgatattttagttctcccatcaccagagtagtgtacatcgtattcaatatgtagttttctatctctcattccccccgccaccctccctccttctaagtctccagtgtgcattataccactctatgtctttgagtgcccatcaactttgttctttttgctcagggttgctttggctattctgggtattttgtggttccatatacactttaagattattttttctatttctgtgaagaatgttattggtactttgaaacggattgcattagatctgtagattgctttgagtatggatattttaacaatttgattctttcaatctaaaaacatggaatatctttacatttttgtgtcctcttcaatttctaatataatattattcaactatgaaaaagaataaaatcctgtcatttttaacaaagtggatgggaagtggtgaacattatgttaagtaaaataaggcagacagaaaaagataaagtagcatgttctcactcttatgtgggagctaaaaaaaataaaattttaaaaaaaaaaaggaactcagggtgatagtaagatgatacttaccagcagctgggaagggaaagaggagaaggtgattaagaagagttgcttaatgagtcaaacatacagttagaaggaataaaaactagtgtttggtagcacaataggttgactatagtccacaattaatttattgcatatttcaaagtacctaaaagagtggaactggaaagttcctaaaacaaagaaataataaatgcttgacatgatggatatccctattaccctgatttaatcattacacattatatacttacatcaaaatttcacatttaccccataaatatgtacaactattatgtatcagtaattaaatatttgaaaatgttcaaggaagcatgcttataattatcctttaaatctgtatatgtaaactcttcataataaagactaatgtagaaaaaaaagaaacgtaaaaacttcttctcaactcatgcttacaagcttctttgttaaacacttccattcactgaaagaaacaacacataaagcaactttaaagaagtatgcttagatttactttttaaacctgtataaaaaaaaaaaaaaagtaggaccaggcacagtggctcacacctgtaatcccagcactttgggaggctgaggcaggcggatcacttgaggtcaggagttcaagaccagcctgggcaacattgtgaaacccaatctactaaaaatacaaaatttagccaggcatggtggtgtatgcctgtaatcccagctactcaggtggctgaggcacgagaatcacttgaacctgggcagcggaggttgcagtgagtcgagatcgtgacactgcactccagcctgggttctctatctccaatgaataaataaaataaaataaaataaattagcagaggcttttaaacacctacattacacagtggcattaatgtagggaaggttacttttatatattatagtgttaataaagtatcacacattttctgaaagcctctttggcaatatatatcagaaaccttaaaaagattcctattttttgactcactcatttttgtaatctacctcattaaaacaatcataaaaacaaaacaggacttaacttagatggttttatttatgactatttattttgcttcggattttctcagaagaccacaaacccctctagatattttaaatagaatgagatacaatacagagaatcagaagcttacaaaatcatcagaactactggtggagcaaaggtgacggaaattactgctcatttcagtaaatcagaaactggggaagttacagaaaactgttactgatctcatatttgcaccaaggaagtgagttaatacacctgcccactgcagtccctagagcaatagtgacttccttcactccaccttcaaaattctgctgaaatgcctctcgttggcagaatttaatgtgaaaaactgttgtcaggaactctggaaaacatagttctctggctcccagccttttaataaagaggaaaatataaatgtgtatggggaagtggtggtagtggcactgtactgttaacaaaaaatgcaagaatggaaaaaataagtcagcaatttaaatgccaatactcttcagtggggaatagtttactacattggagtattcatttgatgagattgtatgcagtcattaaatatcctattctgcaatacatgataaatcatgtatcattatgttttaataaaatgagaacatttttactattaattggatgaaaatgtagttcataaagcagtagagtacaaacctactttattatataatatagcatcattctattcaagttcaactttatagtaaaactaaagattttctaaatccaaaattcaattttctagacatagttctaaaattccatttttaaaagtctatggaaagaaaatgaagttctgttaaggtatatgtagaatacctggaaaacaaagttctataagtttttttagcttaatgtaacattaagagcccataatctaaaatattacattgtccagtgatattgtcatgtattctagttgtagttacttttaaaataaatgctaagttggaaaagaaagcacattttttatggctaggttttgtaataaccaggtgactattctaaagatctcattcacttataaaccataaaattaaaaaatgttttctcaatggccataatagtggagaaataggttgcttttctccagacatagtgctttgagtctgtacttcatgaaatatcatctgtaatcatctttgtacttacgaaattatcaagatgtaattatcaagatggacactatgggctattgttggatgaacacgccttgacaaacagtcaatactttaaaacaaaacaagcagtacatgaacatattcctttcctttgcagagagtttataccctatttctaattgttgtttgagaaggtattttaatagaatggagttatttactctagaggcacactctggggggtctgcataggaatgtgagtcccaggtgttttccaggtctctctctccttactaatattactcagccactctgtcttctattagttctgttttgcctcaggtttcctaaattgtcaatattttgttttgatttaatgtctagaaagaattccaggatatatttttatactaacttttgttcaaaatgcaattatctctctttatcctcacttcagcttccataagagcatttaaaggtcagggaagagtttttaagcagatcagtttggagaagcagaaaatctctatggaaaagtgcagggtctagtaggaaagaccatgtagaaatcactatatattgttttatttactgtcccctatgactatctgaaagacctagcttaatgaagattgaataaaagcattaaaaagtaatgaagccatataaattctgggcttgggtttaaaaattataattctaaccattttataatagttgttaagatacactcacctatgcacacatatattcagaaatgtttctaatatatgcaagtagtactgtgtgtatgattatgaagggcataatcaatgtaattcaaaaaacaataatgtaatttgattataagaatattaggatttgaaaaataatagtcatattcttgctaaatgaacaattcaaattagtcacattaaagaaaataataaactttaatctgtgaaacccattattaagaaacttcatttaatggattaatctcattgcaaattgcatagtgctatacaaaaaatgattactaaattgaaaagtttccccttatgtacaagttagatatataatctgtttgtttttatgtatattgtgtttaaaatcctcatattgctcaggattaccttggttatccggggtcctttatggttccctattaattttagaattgttttctaattctgtgaaaaatgatattgctagattgataagaatagcattgaatttgcagattgctttgggcaatatgagtatttggccacttaaacaatattaattcttctaattcatgagcaaggaatgtttttctatttgcttgtgtcatctgtgatttctgtcagcagtgttttgtccttctcctggtagagatctttcacttccttggttacatgtattcctaggtatcttgtgtgggtgtggatattgtaaatgaggccatttccttgatttggctctgagcttgaacacttttgctatatagaaatgctactgattttttaaattgattttataccctgaaactttatcgaattagttatctgttctaggagactttaggcagagtcctcaaggcttttatagaatcagatcatcagtgaagagagatcatttgatttcttttctgattttcaatgccttttatttcattctcttgcttgattgctctggctagtacttccagtactatattatataggaatggtgaaagtgggcatcctctgcttgtttcagttctcaagaggaatgctttcaactttttcccatgcagtatgatgttggctgtgggttgtcatagatggatcttactattttgaggtatgttcctttgatgcctagtatgttgagggtttctatcatgaagggatgttgaattttattataaactttttctgcatctgttgagatgatcacacactttttgcttttaattctgtttatgtggtgaatcacatttatcgacttgtgtatgttgaaccagccttgcatttcaggaataaagcctgcttgattgtggtgcattaactttttgatgtgctgctggagtcacaaaatactaatttgctagtattttcttaaggatttttgcatctttgttcatcagggatactgacttgaagttttctttttcattgtgtcttttccaggtttgggtattaggatgatgctagctttgtacagtgagttagggtggaacccctcctccttggttttttggaatcgtttgaggagaattgctaccaggtctttttttggatgtctggtagaattcagctgttaatccatctgattcagggcttttattggttagtaggctttttattaatgattcagtttcagaatttgatattggtttgttaagggtttcagttccttcctaattcaatcttgggagattgtatgttttcaggaatttatccatttcctttagacattctgttttgtgtgcatggagtgtttacaacagtctgtgaggatcttttgtgtttctgagggattggttgtaatgtcacctttgtcattttttaatatgcttatttaaatcttctctcagattttcatttgttaatctagttattggtctattgatcttatttatactttaatatagccaacttaatttcattgattctttgtaatggtttttggcttcaattttgttcagttctcagattttagttctttcttttcttctgctggctttaggcttagtttgctcttgtttttctcctttctctaagtgtgatgttagatcattaatttgagatatttctaattttttgaggtaagttttagcactataaagtttcctcttcacactgctcttgctggatgttgtatctctgttttcatttattttttaaaaatgtattaatttctgccttaattttcctgttcattcaaaagtcattcagaaacaagtcatttaatttccatgtaatcatgtagttttgagggattttctttgtattgatttctatttatattccactgtgatctgagagagtatgcttcgtatgatttagatttttttgtatttattgagacttgctttatggctgaacatgtggtcagtcttggagtaggtttttttttttatttattgagacttgctttatggctgaacatgtggtcagtcttggagtaggttttatgtgcagatgataatgtattgtatagttgataggtgatgtattctgtatgtgtctactaggtccaattagtcaaatgtcaaatttaagtctagaatttcttagttttattccctgatgatctgtctaatgctgtcagtggggtgtttaagtgccttattattattgtgtggctgtctagttcttttcataggtctagaagtacttgttttatgaatctgggtactccaaggttgggttcatatatgtttatgacagttacgtcttctcattgaattgaactctttatcattatgtaatgctcttctttgccatagctcaacatcaaactatactataaagctaaagtaaccaaaacagcatagcactggcacaaaaacaggcacatagaccaatagaagagaacagataacccagaaataaagccacacacctccaataatatggtctttgacaagtcaccaaaaaattaggaatggagaaacaactccctattcaacacacggtgctgggatagactaaccgtatgagaaactagacctctgcctttcaccatatacaaaagttaactaaagatagattaaaggtttaaatgtaagacctcaaactataagaatcctagaagaagacctaagaaacaacattctggactccagccttgggaaaaaaattataactaagtcctcaaacacaattgcaacaaaaacaaaaattgacaggtgggatccaattaaactaaagaaaatgtgtacagcaaaagaaactgttaacaaagtaaacacaacctacaaaatgggagacaatatttgcaaactatgcatcctaaaaacaaccccattaaaaagtggacaaaagacatgaacagatgctgatcaaaataagatacacaagcagctaacaaatgtgtgcaaaaattctcgacatcactaatcatcagagaaatgcaaatcaaaactgcaatgagatatcatctcacacaagtcagaatggctaatattaaaaagtcataaaacaacacatactggtgaggctgcagagaaaagggaatgcttacatgctgttggtaggaatataaattagcccatccaccatggaaagcagtttggagatttctcaaagaacttagaattgttatccagcacaacaatcccattactggatatatatccaaaagaaaacatatcattttaccaaaagatacatgcactcatatgttcagcatagcattgttcaaaatagcaatggcatggaatcaacctaggtacccatcaatggtgcattggataaagtatggtacatgtacaccatgtaatactgtgcagccattaaataaatgaagtcatgtactttgctacaacatggatgcagctgaaggcctctattctaactagattaacacagaacagaaaaccaaataccctatgttcacaattataagtgagagctaaacattggtactcattgacaaaaagatggcaacagtagacactggggacaatcagagtgaagaggtagggatgtggagaagtgttgaaaagctgcctattcagtattatgcccacaacccaggtgatgggatcagttgtatcccaaacctcagcatcacaaatatacccatacaacacacttgaacatgttcccctgaatctaaaattaaagttgaaattattaaaaacaaaattgtattcttgcattaaaaatgagtacaacaaatttaaatggattgtgtgtagtttaaatattaacagttcttaaatagaaaaatgaaatgtgaacactaagagttaacttacactaaaatatattctcaaattcctggtgtgtttttaagtgaagtttccctaacatcaggatgttaaattaataatctctgagacatttaaattttgttatccagtatattagtcagtattctccagagaaacataaccaacagaatgggatatatatacacacacactcacacacatgcatggtgatttattgtaggaatttgttcatgcaataatggatactgataagtcccacaatccgctctctacaaattgaaaaatgagaaaagctattgctgtaattcagtgtgaatctgaagacctaagaatcagggaaggcaatttctgagggcggaagaggagggatgtcccaactcaaacagaagcaaattcaccctctcttcgtctctttgttctatccaaaccctcaatggattaaataatgtctatccacattggtgagggccatcttctttactcagtttgctgattcaaataataatctcttccagaaacattgtcacaggcacacccaaaaataatattttaacctcactttaggcatctcttagcccagttgagttgacacatcaaactaaccataacaccaaggaaatcatgttagtattattgcaaagatatccacaatgcatttttctcacaaatgccctttttcctgtaaattgtatcacttcatctcttaaatgccctcatcgcaaaaaaaaaaataacattgtattggtcagtgttcttcagagagatagaatcaaaaagatatatgtgaatacagatattttaaagagatttattagggatactagctcacatggttatggaggcaaagtcccgtgataggttgtctgcaggctggaaaccctgagatgctggcagcatgactcagtttaagtccaaagccccaggaactagggaaacctatgacataactctcagtctgagtctgaaggcctgagaactcagggggccactggtgtaaatcctggagtgtctgtgtagaagatcctagatttctgatgtcccaggacaggagaagagtatatcccagctccaagagaaagagggcatcacctttttgtgcttatcctcgtcctcagatgattgaatggtgcccagacacactgagggcagatcttccccacttagtccaccaactcacctgccaatctcctctggaagcaccttcacagaaaaacccagaaataatcccttaccggttctcttggtaattcttaatccagtcaagtcaacacctaaaattaaccatcagaaacatataactttgaacaatttgcgtttacctttacccactcacataaaaacaccatacgtaggagttcaaaggaatttaaattgtttgcaatttttttcttttataactaggaatgttagcaaaacaccatacggtgagacagcaaagcacagtggcttaggagcacagactccaggttcacactgcataagtttgatcctagctctgttatttaataatataggacactggctaagttatttaacctctctgccttggtttgctcctttgtaaaatggagataataaatattttctaccttatatgattggtatgatgattaaatttacttatgtatgttaataagtatattgaacaatggcctgtaagtacttaatgattaattgaaattattatatctcttattaaagatggtttgcttatatctcatatagccataagagatattttgtgattgggatcaggaaaacaggttatatcaaaggcaggtagtcacctgtttctctttgcaatatttttaaagatttgatacttttagaacagttttagttcaaagcaaatttgaaaggaaggtacagagatatcctgtatatttcctgcccccacacatgcatagcctcctccattatcaacatccttgtattagtccattttcacactgctatgaagaactacttgagactgggtaatttataaaggaaagaggtttagttgactcacagttccacatggccggggaggcctcagcatacttacggtcatgatagaaggtgagggggaatcaagcaccttcctcacaaggcagcaggagacagagagagcgagcaaagaaggaaaccaccagacacttttaaacaatcagatcttgtgagaattccctcactatcatgaggacagcatgggggaaactacccccatgatccaatcacctcccaccaagtccctgcctcaacatgtgaggattataatttgagataagatttgggtggggacccagagcaaattatatcaatgaagtgtggtaaattggttacaattgatgagcctatactgaaacatgattatcacccaaagtccatagttcacattaagatttattttgtattgaacatcctatgggttttgacaaatatataatgaaatatagccaacactatagtagcatacagagtgttttcactaccccaaaaatctgccatgctgtatctattcatccctcactccccacaacctctggcaacaattgaactctgtttttctccatagtttagccttgtccatagtgtcacatggttggactcatacagtatgtagccttttcatattggcatctttcacttagtaatatgtgtttaaccttatgtcttttcatggcatttttttcagtgctgaataatattctattttctggtctgtttgtagcacagttcatttatccattcacctactgcaagaaatcttcattgcttccaagttttgacaattatgaataaagctgcttataaacattcttgttcaggtttatgtgtgaacatatgttttcaactcttttgggtaaataccaagaagtgagattgctggatcataccataagagtatgtttaattttaggagaaactgccaaactgtctttcaaagtggccggaccattttgtattttcactggtaataaatgagagttcctgttgttttgcatcctggccaatatttggtttttaaagtgttctggattttggccattttaggtatgtaatgatatctcattgttgttttaatttgtagttccctgatgacatatgatgtagaacatctttttatatgcttatttgccatctgtaaatattttttgagatgtctgttaagggttttggtccattttagttaagtaatttgttttcttattgatgagtgttaaaagtttcttttatgttttgaaaaacagtagtttatctggtatgtgttttgcaagtattagttcccagtctgtgttttttttttcatcttctttatagtcttttggcaaagcagaaatttttagttttaatgcagtctagttcaccaactgtttctttcatgaatagtgccttgggtgtcatatctaaaaattattgccaaacctaaggtcatgcagattttctcatgtgttaatttctaggagctttctagctttgtatattacctttaggtctgtgatccactttgagttaatttttgtgaaggatataaggtctatgtagaggttcactattttctgtgtggatgtccagtagtaaagcatcatttgttaagactttctttgctccatcgtatagcctttgcttctttgtcaaagatgattgtgggtctatttctagactctctgttatgttccatttatctatttgcctattccttcaccaacactaaacactaaacttatttacagtcttatttactgtagcttcacagtaaatctgaaagtcagataatatcaaagcttcaactttgttcttctccttcaacattttgttaaatgttctgggtcttttgcatccccatataaactctagaatcagtttgtcaatttctacaacataatttgctggggttttgtttgggatggtattgaatctatagattaagttggaaaaagctgacatcttaacaatattgagtcatcctttccttgaacatacattatctatccatctatttagtttgtccttgatttctttcatcagaattttgtagtttacctcatattaattttgtaattctgatggatttttcataagcatttcatttttggagatgctaatgtaaatggaagtatgttcttaatttcaaattctacttgttcattgctggtatatagaaaagcatttgactttttcttattaacctcatattctgcaactatgctataattattaattccaggaggatttttgttgttgttgattttaaaaaaattctacatagactatcatgtcatcagaaaaaacatgatttcttccttttttctttttctttcttgctgcattagataggactctcagtacaatggcgaaaataagtggtaagaggagacatccttgcctgttcttgatcttagagggaaagcttctagtttcttaccattaagtatgatgttggctgtagattttttgtagatattctttttcatgttgaggaagtttccccttattcctaggttactgattgtttttatcataaatgggtgatagattttttttcagataatttctctgcatttattaatatacttatgtgattttttaaatttagtttgttgatgtgatggattacattaattgatttttaaatattgaaccagtcttgtatacctgagataaatctaagtaggtcatgttgtataattctttttgtatatatttggattcaatttgctaatattttgttgaggatatttgtatctatatttataggaggtattggtcatagttttcttctactgtctctgtctaggtttgttgctaagatgaggctagcctcatagaatgaggtagaaagtttttcctcagcttctatcttttgaaagtaattgtagagaattggtataatttattctttaaaagtttggtggaattaccagcgaacacttacggacctgatgctttctgttttggaaagattattaataattgctttaatttattaaatacatatagacctattcaaattctctatttttgcttttattagatagattttattttctttcaaggaattggttaatttcatctaggttatcaaagttttggacatagacttgttcataatattcgttatcttttaaatgtccatgagatctatagtaatggcccacctttaatttctaatattagtaatttacatcctctcttctttttagttagcctagctagaggcttattgattcaatttatcttttcaaagaaacagcctttggtttccttgacttttccctattgatttcttattttcaattgcattggtttcttctccatgttttattatttattttcttcttcttactttgagtttaattggctcttctttttctcatttcctaatttagaagcttagataaatgactttagatatttcttttctaacagatgctttcaatactgtaaatgtccctcaaagcattgtttttactacatccaacaaatgttaataaattatatttttatttttatttacttaaaaatatgaatatttctcttgaaatttttcattttacccatgtgttatttagaagtgtgttcattgtttaatctccatgtattttaatctccaaaatatttaaaaatatttttaaatttctcttgaaatttcccactttatccatgtgttatttagaatggttttcattgcttaatctccatgtattttaggatcttccagctatttttttctgttttttttttcttgtttaatttcattccggactataaagtaatttcaaatttgtcaaggtgtgttttattgcctagaatatgatgtgtcttattgaatatttcctgtgagcttgagaagaatgtgtattctgttgttggataaagtagtctgtagatattcattatatccagttgattcatgatattgctaagttcaactatgtttttactgattttctgcctgccatggtcatctatttctgatagaggggtgttaaagtctccaactataatggtggatttatctatttctcttgcaattctatcagtttttgcctcacatactttgctgctctcttgttaggcacatacatgttaagaattcttattatcatagttcattttgagctgctataacaataccacagactaatttataataaacagaaatgtattggctcatagttctagaggttgggaagtccaagatggagaggctggcttcctgcaaaagctttcttgctgcattatccaatggcagaaaggcaaagagagggtgagagagcaagaaggggctgaacccattcttttataatgaacccattttcacagtaatgaactcactccctgtattagtcagggttctttaaagggacagaactaataggctatatgtatatatgaaggggagtttattaggataattgactcacaggatcacaaggtgaggtcccacaataggccatctgcaagctgaggagcaaggaagctagttggagtcccaaaacctcaaaagcagggaagccgacagtgcagccttcaatctatagcagaagacccaagagcccctggtaaatcactggtctaagtccaagagtccaaaagctgaagaacttggagtctgatgttccgagggcaagaagcatccagcatgggacaaagatgaaggccagaagactaagcacacctcttcattccactttcttttgcctgctttattctagccacactggtagctgattaaatggtgcctacccagattgaaggtgggtctgcctctctcagtctagattcaaatgttaatctcctttggcaaaaccctcacagacatacctatgtacaacattttgcatcctttaatccaatgaagttgacattcaatattaaccatcacatttacataataatggcattaatccactcatgagagcaaagccctcctggcttcatcactttttttgttgttgttgagacggactctctgtcgcccaggctggagtgcagtggcgccatctcggctcactgcaagctccgcctcccgggttcacgccatgcttctgcctcagcctcccaagtagctgggactacaggcacccaccaccacgcccagctaattttttttttttttttttttgtatttttagtggagacgggttttcaccgtgttagccaggatggtctctatctcctgagctcgtgatctgcctgcctctgcctcccaaagtgctgggattacaggcgtgaaccaccacacccggcaggctgcatcacttcttaaaggtcctgcctctcaacactattgcactggggattaagttttcaacacatacttttggagggacaaattcaaaccacagcagttatggccaataattttctcctttatcaatatgagattttcctctttattcccaatatattttattgctttgaaacctactctgtctgaaattagtatagctactcttgctttcttttgattagtgttaacaaggtacttctttctccatccgtttacttttaatctacacgtgtctttatatttaaactgagtttctcatagacaacacagagttgagtcttatttcttgattcattctgacaatctctatcttttaattagtgcatttagacaattgatgttcaaaactgattattgatatagttgtaataatatctaccagcataccaactataccaattgatatagttgaagaattaatagtgatataattggattaatatttagtactgctttgtatttgttgcctttctttgttcctatttttgtcttccagtcttttttctgccttttgtagtttcaattgagcattttgtatgattacgtgttctctcctcacttagcatacaaattacacttctttttttttatttttattttttgagatggagtctcactctcttgcccaggctggagtgtagtggcatgatctcggctctctcaacctccacctcccaagttccagtgattctcctgcctcagcctcccgagtagctgggattataggcattcatcaccatgtctgactaatttttgtgttttttagttgagatggggttttgccatgttggccaggatggtctcaaactcctgatctgtgatctgcctgcctcctcctcccaaagtgctgggattacaggcgtgatccaccacacctggccacacttctttttaatactttttttttaaattgttgtcctggagttgcaatatgcatttatatataatccaagcccactttcaagtaacaatataccacttcatgggtagtgtgagtaacttataataaaaaaaaactcttaatttcttcctcccatcccttgtatcattaatgtcattcattttacttatatgtaagtatacacacacatacacaatatatacattaagtatacataattaaatacatttttcatggtatttttttgaacaaatatttacttgttaaatcaattaagaataagtaaactagagcatgggaaagctcagaaaccaacacaagatcccagaaaatggggccaggcatgcagggaaactgagcagccagcaatacctgtcaatgtcatgttccttgatatgcagcagtgatgctgggctgcagctgagagtgccgtcccattgcaaggaatatcaggtccatgcttctgctgtctcaggtgcccaagcttagcatgggttctctcagctcaagccaccagccctccctaggacccgagaaggtgaagcccttgtgtgaagtcctggctcttgtcaaggcagggtgctaaagaagaaacagaaaagaagttaagaaaaaattttaattttatctttacttacttcttctttgatgctcttccattctttgcatacatttgagattttgacctatatcattttccttgtctccaaatgacttaggatgttttgcaaagcaggtctactgacaagtccccttaatttttttctttggccagacaaagtctccatgtctccttaaccattgaaagatagtttcacaaggtacaggattctaggtttgtgggctttttctctctcaacactaaataattcactctactcttttcttgcttgcatggtttctgagaagaagtcagatgtaatttttgttgttgctgttcctctgtaggtaaggtgtcacccaccccctctctggcttctttcaggattttttctttacctttaattttatataatttgaaaattgtgtgcctacatacagttttttgacacttatccttctttatgttctctgaggtttctggatacatggtttcatgtcagacattaatttgagaaagttctcagtcattcttgtttgaaatatttatttggttcatctgtctcttctctttcttgtattcctattacactttcgtagtttccccacagttgttgtatattctgttatagttttttttttcagtttttattctttatgcttttcaattttggaggtttctattgagataccatccagctcagagaatttttcctggaccatattcagtatactgttaaccacatcaaagttacttttatttctgttacagtgttttttagctctagcatttctctttagctcttaagatttccatctctctgcttactttacctatctgttcatgcatgctgtcacctttatccatttagagcccttagcatattatcataattgttttaaattccgtgtctgataatccaatatccctgccatgtctatctgtgaggcttgctttggcccttcaaactgttttttgtctttttgtatgctttgtaattttttttctttatagccagacacaatgtactgggcaaaagggagcactttaaacaggcctttagtaatgtggtggtaaggtatatggggagggaatatgttctacagtactctgattaggtctcagtctcttagtacccctatgcctttggactgtgaacatcacaagtgtttctcagggttttttttttttttttttttttctgcctcgttaggtgggacaggatggttacattgggctggagttggttatttcctttcttccaggaaagttgggttatgatagaaccccaacaggttgaattctggttaaccagtttctcctgaaggcagaccttgttaagaacacagcgttctggcatattgcaaaatgattcattttcatcttttcctgctagaaggacaaaaagatttttctccaatatttgctgtgaaaacctggttgagtcccttggagcaaaactcacaaagtgtgggacccgtcctttgactgggtcctcctggagttttaactctcagactccttcatacttagcctctagcaatttgtcaattacagttcaagtttctatacccaacctgtgaagaaggttcatggcattctagttactatttcaaagggaggactctaaacatttccacccactgcactttgggtgcacaaatctatagtgagacagaatactttcacacaacacattccatgaagcagatttattacagataggcagcaagggacaacagaagcctaggactcatgacaaagctgtcccccaaggttcaggaaagcttcatgagatggatggaatctcatctgcatgcaacttatgtcacactgcagctaagggaccccaaaaagcagcctgtcctcggctttataccctgaggcattgtgatgcactggggaaaagcattgtaggatattctgctctaggaggaacaggaacgcagtgtgggatattctagccagttattccttatctcaagatgttgcattcccagcacatttacagctattaagaactacaagggccaggagcggtggctcacgcctctaatcccagcactttgggaggccgaggcaggcggatcatgaggtcaggagatcgagaccatcctgacaaacatggtggaaccccatctctactaaaaatataaaaattagctgggtgtggtggcacacacctgtagtcctagctacttgggaggccaaggcagaagaatcgcttgaacccagaaggcaaagcttgcagtgagccaagatccagccactgcactccagcctggcaatagagcaagactcaatctcaaaaaaaaaaaaaaaaagaaagaaagaaaaaagaaaagaaaaaagaaaaataactacaagcaagaaatcaaagagagttgggttggcccaaggccacctggagaactgtcagccagcgcttgttcccatagaggtttttgcttcagcatgttgtgattctctgtatccctcatctgtctctttaatctggggggcagcagtttgccctgtgaccttacttctgttttggatctaagaagagttgttggtttttcaatttgctctgctttttatgtgttgttagaatagaatggcaacttccaagctccttacatgaagaaccagaaactacaagtctccataccatttttcaagtatggctttacatttttaaatgattgaaaaatcaaaacaatgatatattctgacatatgaaagctacacaatatcaaaatgttagggtccataaataaagttttattggaacacacacagcagagttaaatatggcccaaagcctaaaatatttactataaccctttagagaaaaatgtagctgacctgtgggctatgtgtgctaccgtaacagtgtgacactttctacccttcttgactagaatactaaaataatccaataattattttatgttttccaggaaatcaagtaaagcagaatattattaagaaacctttagttagaatttttaaattagaaataatttctttcatagtcccagaaagtatataatgggtgaagtatgaatgggtgaagtatgaatgggtgaagtatgaatgggtgaagtatgaatgagtttgaatttgcataactgttaacattatccatgtttcccccctctctatatatacacatatacacacacataaacacacatatacaccagtgatatcctctacaatgaaacatattaattattcctgtactttatttaacaccaaagtttcttgattttgtttttttattagtagatagggctattttctgaaccctcttaccaagtcctctaatgactttagagacaactgtatcttatacactttttaaaagcaaatctcccttccttgtccagtatgttgtgagcacagcgtagaacatttgataaagacttagtgacttgaattaaattacttgcagttaagtaaaacatcccaaatcatgaaccctcaattatcttgtctgtgtttaccatgtcctaaggcctttcaaatagaagtgacaatttaaaagttctaaaataattacagcaccatattgctcactataaagtacaactgtcaattacaaattcaattatcagtggccacttgtgaatctagagaacttcacaaatgttctgtcttgtagctgaactggaaatgtttttagggttgccgtttgttttatagttttaaatatttataacctgattaattattttcctaaaatattttcgttctagctaaaaaatgtgctaggaacaaacacaatacctgctgaaagtgacttttgtccctttcggtgtagggataaatgttatcccacctaaataatatgactcttgtttttaattaggtttaaagtaccctttgcagtttgacctttccctggaatgatccattttctatgctacattttatcatgctgccagtaatgtcatcaaaaacttttaaagaacatattaaattggctttaaatttatattgagctttaaaatgaaacagcattaggacattgtgcttctttgttttacacctgcatactcttaacattccggtgttggagactggaattcttttcactccaagtactttaagttaggaaggaaagaaggaaggaaggaaggaaggaaggaaggaaggaaggaaggaaggaaggaaggaaggaaagaaagaaagaaggaaagaaggaaagaaggaaggaaggagggaaagaaggaaggagggaaagaaggaaggagggaaagaaggaaggaaggaaggaaggaaggaaagaaggaaggaaggaaagaaggaaggaaagaaggaaggaaaggaagaaagagagaaaggaagaaagagagaaagaaagagagaaagaaagaaagaaagaatgaaagaaagaaagaaaactaagaagttatttatgctttgtacaacagaatgggcacacaaggattctaacaaggatttcaattctaatatcagcacttagcccctcaatgtctttgagcatgttaagttgcaaagcccaaacggccttatctgataaggtgtcattatcccttctttgcaatgttcttgttagagttagaaataatagatgtagtgcaattgtcaccataggccctcaataaaagatggttgttgttgcagctgttgcaatatgatcgaggtctttactgacccagtgaaaaccttctactgcttgctctaagaaaccatttccttcttcctaattagtcctcagtaaagtgaataagttattagagaacatggtctaaaaacaatcatttatattaggacttcatcgtgtagttgaaacgtcatgccatggcttggaaatatcatggaaatgtggcatgaactcttcccggggtggtaggagatcaatgaggagcattgggagccaagaaaagaagccaaaaaaaaaaatcattagaggaaactttccttctctcacccatgtgcattttgaattcaacatatcgttggcaggttttctttaggtcaaggacagctttaaagaaaactgttttagatcctccaactctccttcataaacctatcccactacatagctttacaaattgcctcttttggagattttcccagaactatcctcttcactctgcacacagcaagaaattagccttccgctcttttactattccgttcctttacaattcatgctacttcagtatacttaacccagaatttattcaagttttatgtgttaatttaacaaatatttatttagtgactacctttattgtaccagttaaacatataacaggaaacaaaactcaaaaacagttctgtcctcactgagcttatattttggtggaaagatacagacaattaattgaaccaaataaattatagtgtatattagaaaaggataagggctgtgaaaacaaataaagtaaggaaggggagtgaaatatactgggaagtagagtttcaattttttagaaacagcttccctgagaagatggcaatttagtaacataaccaaggttgcaagtcaggaggttattcatggtgaaagcaatgtaggaaggaagaactgcaagtgcaaaggccaggaggcaggaagatgccctgcatggtccaagaagataaaggaagcccttctggttagatcagagaagatgaagttgaatagggctggtgtggagggacctggagaatatctagactcttgtaagctactgaaaaaaaaaaatgttggcctttagtctgagtaggatgggaaacatttgaatatttgaatgaagaagtgaaatgatctgacttgtgtttttttaaaagctcattctaactgccacgttgaaaatggatgataggaaagcaagttgaaaaaggctgaccagttagaaaatattacaaatatccaggtcgttttattggtagggctagaaggaagtggttggactctgaatacgacgtgttaacagatggacgaaagggaacagtgacagtgagggtcatggaggacatagaggtttttggtttttgccctggagtattagaaagttcaaagttgtcataaattgagatggcaaaggttacatacagcctgcttttgggttcagtatcaggactgcaaatttaggcatgttgactttgggctctctactcatgattccagggaagatgtggaataggcacttgaatatagaaatctggaattcaggggagacatgatctgggggtgtacaacttgaagaattcccaatatagagatgatatttgaagttgtgagactgaaggagaatgctaagggagtgagtgtagaaagaaaaggtggaaagtctgaggctgatcttcatttgcactctaatattaatcggttggtgagagaggaagaagcagagagtagaagcagatgatggaggaatggctaaggattggtgtaaaggcctgcaaataaaatcgtgtcaaggaacagtagatgaacaagtaggtcaaatgctgctgaatagtcattaagatgaggactgaaaataatgatgagcctaagaaatgagttggtgtgcctgtatggagtagtttcaagaaagaatgaaagtaaaaagctattgaaaccagagaatacagattcttacttttgaaagtgagttttgctacaaaggggatcagaaaaattgggtaataggtacagaggaaaacatggttatgattatttttaatgaaagaaacgtgtttgtatgataatggaaatgaatcagtggaggctaaaacagtcagtaatgtaggagaaagggggaattgctggagaaatttccctgagcaggaaggggaaaggggctataagatctggtgcacaagagaaggatccagctttaggagcaaggacaattaatcttgttaaaagagggaagactgagcagatgactcactggttagatgtaaacagcctctcagcctttcttggagcattctcatttagatataagatactatttaagtaacgaaatatctaatcatatcatttcagtaaatttaaatgaagaatttccattaggatatggaactcacttttttatttttttattatactttaagttctgggatacatgtgcagaacatgcaggtttgttacgtaggtatacacgtgccatggtggtttgctgcacccatcaacccgtcatctacattaggtatttctcctaatgttatccctcccctagtcccccaccccccaacaggccctggagtgtgatggtcccctccctgtgtccatgtgttctcattgttcaactcccacttatgagtgaaaacatgcagtgtttgggtttctgttcttgtgttattttgctgagaatgatggtttccagcttcattcatgtccctgtaagagacatgaactcatccttttgtatggctgcatagtattccatggtgtatatgtgccacattttctttatatatatatatatagagagagagactagatagaaactcttaaatcctaatatgcaaatctaacctgggaaaaccattacactggttaaaagtagcccatttgggatgcacaaaattcatttttttccttatgcctgacaggacatccagcaactccagtttgtaaatgagcttattcatttgaactgggatccatagctttactcaagaatgaacagcttggttcatctctccttgaaaattgctgttagaattaaactccttagtcaatcttttaactcaactgtttcaaaactcctttggttttgaatcaataaaagcattgaggatgtggcagttgagcagatgggtggtccacttggtaaagctttgttatctccatgtaagccacaataaaactctgacctgacaaaaagaaagtgtttacacaaatcaaaacagaaacctctatactataagttacacagtgtttccagttggtatctacaagtattaatgcagacacagtgacaggtttcaaataaacttgatagaaaaggccattcatattttatcatgttgggttgatggacttacaattgagaacaatgttttactcaagcttagtgaaaactcctaggtagtaatcaatattctcagtcaccattgcattgaaaatatgttcttgtctatgtcgacaaaggcatcaaattaaacttgcaaaggtagattattttttatcttttctcctgatgtaacaaatacatattataactgaaattgcaatataataaattaaaaaataaatgctattcagatttgaaagaaaataacgggacatctaatccatggctctattaatgctttatattttgtggcttaaaaccatctttctaaatattaaatataaattctgctaaaatagtgagggggacatagttgaaacttactatacatcaaactacgagtttccaatctttaagcaaaaatatagttactaaaatgttgtttacaaattatttttaaaattttaatactgacatgcaattaaatgatccaaaggcttcatacatttaccacatgttaaatgaagaacacgcttttgaagaaatctgaggtttcataaactgttatttactgagtttgttttgcatccaagatctcaggaggatttaatctttcatctgtttttcaaagcctcagttacattttattttttattttttgaatttatttatttatttatttattttttgagacagagtctctctctgtcaccaggctggagtagagtggtgcgatctcagctcactgcaacctccgcctcctgggttcaagcaattctcctgcctcagcctcctgagtagctggaactacaggcatgcaccaccatgctgggctaatttgtgtatttttagtagagacggggttttgccatgttggccaggatggatttgatctcttgacctcgtccatgtcagcctctgaaagagctgggattgcaggcatgaaccatggtggatggcctgaaatatttaattgacataacgattatacatatttaaggggtaaaagaagatttgatatacatatataattatcacaatcaaagtaattaatgcatctatcctgcattaattaatccaggctgtacattagacctctagaacttgttcatcttataactgaaagtttgtacccttgaaccaacatctcctcatttactccacaccctatcccctgacaaccactattctcctctttgtttttgtgactgaacttttagattccacatatatgtgagattatacactatttgtccttctgtgtctggctcattttacttagcctaatgtattagtctattctcacactgctataaagatactacctgagactgggtaatttataaagggaagagctttaattggctcacagatctgtgtggctggggagacctcaggaaacttacaatcatggtagaaggcagaagacaaaaaggaatcaaagcacgtattacatggcagcagacaaaagagaagagtgaagcaagcgggaactgccaaacacttttaaaacatcagctctcctgagaacgcactcactacaatgagaaaagcatgggggataccgtcttcacgatccaactacaattcaagatgaaatttgggtggggacacagagccaaaccatatcacctaatgtcctccagtttcatccatgttgtcacatatggcagtgtttccttcttttttaaggctgaataatattctattcaatacagcacattttctttgtccattcatctgtgactgacacttaggttgtttctattacatatcttggctcttgtgaataatgtggcaatagacatgggagagtagatatctctttgacatactattttatttccttttgatatatacccagaagtgggattgccagatcacgtgatagttctattttaaggtttttgaggaagctccatgatattttccatagtggctgtacaaatttacattcccactaacagtgtacaagagttcacttttctttacacccttgccaacatttattatcacgtgtctttttgataaccatcccagcaagtatgaggtgatacctcattatggttttaatttgtatttttctgatgattagtgatgctgagcatctcttcatatacctgttggccatttatatgtctttgctggaaaatgtctcttcaggtccttggcccatttttgaatcaggttatttttaaacattgagttgtgtgagatctttatatgatttggacattaactcctcatcagatataaggtttgcaaatattttcttccatatcatagattgcctttttattttgttaattgatttttgtttttgtttgtgatttttgctgtgtggatactttttagttttatatagtcctgcttgtttatttgcgcttttgttgcaagacacaaaatcaacatacaaatcagttgcatttttatacactgaaaacaaaccaactgaaacagaaaataagaaaatgatcccatttataatagatagcattaaaagaacaagagacttaggaatacatttatccaagaaggtgaagatctgtacactgaaaactatcagacatttatgaaagaaattgaagaaggcacagataaatgaaaagatagcccatatacatggattggaagaatcaatattatttaaatgtacatataaaccacagcgatctacaaattcaaactagtcatcaaaattccaatggcgtttttcacggaaatgccgtttcacagaaatgccacagaaaagacaatcctaaagttttaatgaaaccacaagactgcaaacagccaaaacgctcctgggaaataacaaagctggaggcatcacagtccttgctttcaaattatgttacaagactatggtagtaaaacagtatggtctggcataagcacagacacagaaatacaacaaaagagagagcctagaaataaatttacacacacattatcaactaatctttgacatggcaccaaaaatacacaatggggaaaggatagtttcatcaataaatgatgtttgggaaaactggatattcatatgtaaaagaataaaattagactcctgtattatccaatgtaaaaaattaactgaaatggattcaagacttaaatgaaatatctgaaaccataatattcctagaaaaaaacgtagggggaaactttctgacattgatcttggtaatgacttttttaaaagcgtttatcttttctttttctgaagaacaattattgaaaccaccatttcagggtgatctgtaactggtaagcaaaataaaccatgtaaaagaggagaagccttgagtgtagatgaatgtggtttctctagttcaatcataacattaaaatttcataattaaagaaaattagttctattatttctgtatttatgaacaaattggacaaactattatcttccaatctgtaactgtacatgggcttttcagattgattctacctaaagaaaatcaaaacgaaggtttatatattccttcagtaaaatcactcatagtttcccttatttagttagcatggtgtctttataaacagatgacttaaaagtgaacagaaaatggagaacaaaataactcaggatcccaccttagagataaagctctcatgactgttttagcagggttaacaaacgttccctatttcttccataagttaggctgcctgggtccatgacacggcttgatggacagggtgatccctagtcacctgtgcgcagctgctgcttctgccagctgaactgttgactcacagagtctgcaatatttcttttcttacattaaatttaagccatctttacttgctattttaattccacaatttaacaaattataacataaccctaataaaatgtgatatgtagagaaaacaaactttgtcatgaacacctactttaatgatttgtaaagactccaaagtgttatttaagtattatattaaagtattgtggtgtgagaaccataaaattttgaccaaaaaagcaaaaaaaaaaaaatgcaacaaaaattaatagagacagttgactactggtcacactctaaagaaattgttaatattatacacacacatacacatacacatgtaatttattttttaaatactatgctgcagtgatccaattataccttatttgaaaaaaggaaaaaagtcttatataaaaacattgatgaattaatgaaaatgtatatgtctaaaacaaagatatataatttaaaataattttcatcttttatcaaatattttgatttactatcagtcttgatcatattatttccatgacagtaattatttgctatattcactctaaattcactgtctttattacatctctttgtaattattaatgaaaatattccacttttaaatacctatgtttcccaggggttgctttgtgtaaaaaatattagcatgctacaaactatgagctatccacagtaaaaaaaaaaaaaaaaaactcaaaagaaaatctaattgctattttattcatttgattttataacctcaaactcacagaatactgaagaataaacttttctcctgattcatttgcaagtaagtgggcaagtttccatccatcatctccaaatacttttgtgtctgttttctacaagcaagaacattattctacatatccagattacatccatcaaaatcaggaaattaacattatttcactagttctttctaatcctcagattccatttgagtttcaccagttgtcccaagagtattctttttttttttttttttttttgagaagaagtcttgctctgtcactcaggctggagtgcagtggcgcgatctcggctcactgcaagctccgcctcccaggttcacaccattctcctgcctcagcctccagagtagctgggactacaggcgcctgacaccatgcccagctaattgtttttgtatgtttagtagagacagggtttcaccgtgttagccaggatggtctcgatctcctgacctcttgatgtgcccgcctcagcctcccaaagtgctgggattacaggcatgagccaccgcgcccggcccagagtattctttatagcaaaacgatgcagttcagagtcacatgttgcagcgagtttcattgatccttaatttccctcagcctgggagattgctgtctttccttgacactcaagactgaaattttatcgatgaggccgtttgttttgcagacttggtcttcatttgggtttctctcatggttagtttcaagttttgcatctttggcaggaatatcacaggagtgatcctgtttcatactcatcatgccaagggctgcacagtttcaagccatcccattattgtgattatttgatgcagacgctttgatggttaatgttatgtgaactgagctaggacacagggtgcccagacatttagccagacattatattctgggtgcttttgtgagggtgtttcctgatgaattggcagactgagtaaagcagaaggggctccccattgtggaagagcctcatccaatcagttgaaggcctgattagaacaaaaagactgactcttccccgagtgagagagaattcttgcttgctggccttgacttagacattgtttttttttcctgtctttggactcaaactagtattaaactataggctttcctgggtctccagctttccagctcacctggaagatccttagacttgcgaggttctgtgattacctgagacaattccttacaatgaacctttttatagagatggagtttttggtgtgtgtgtgtgtgtgtgtgtgtgtgtgtgtgtgtatttacatatacacatacacgtgtatcctatttgttctatttctctgaagaaccctgactaatacaggtgttgtgtaccagacttccccactatgagaatgccttttcccttggcaattagtatttttgtggaggtactttgaaatataaatgccttctcctaatcagatctcacatttatttctttatgtacttatatcggtatggattaaaagtgtcctattttatttaaggtgtaataatccattctcgcttctattttttcacactgaagcccacattgttccagatttaacccatgggagccccttccagcaggtgtctgtgtcctttcattatggtgctatcatttcgtgagtgtcttcctgctttctggcagtaaatgttgttccaaaatcatcttgtattttcccaacttggaatataataagcccattcttcaaggtcctcccagtagatgcccgagggactacatgcacatctgtgtgtagatgaataacatacttattcacaacaatacttaatttgctacttttaaatatgaaagaccgtgaattcacacaagtacttccaatgccaacccaatgtcatagggttcattccagtcttcctctttgacataatttgactctcttttccaactggaaaaatcctggctcccattgtctttgatatacttatttatatacttaacccccagttataagcaatttcttgtcactactgctgccatctctccatgtctggataccctccaaacctaactcaggcactgacctccccactgcaggaaactccccctactgcagggacgctgtcttcactaacacttcatatcaagccattctcacttgagaaagcctcttcacctgctcagactctgatacgctgtgtgggctgcccccattccttggttgccctaaaccccactggctctctgattttccatgcctggctaattctctatataactgtgcctattctgctgtgtgtcacctactgagttttcatttcaacaattacattttattttaagcttgtttttttttttttaacagtctatcctcctttaaacatttcatgtacttaatagtctgtatctgatcattccaatttcactggagtctgtaaattttgtttattgtttgtactcactctcacttgtcgtattccttcaatttttttttctttttggttggttttttttttcttttttaaatcttaacctgtaaaaatcccaattgtctaaattgagagtgctttctctagaaagaaatttctattttattctgctcggagctgggggcactgccaacaatctagtcaactcctgtatgacttattttgatttgatagcagaaacctgggactcaccttagagttctcctatccccttatctcccacatccaattactcaattcatccaactccacttcctaaaatcctcccatccagtaacctaaagcaaccctctattgctcaccttccacaatgctaaagactgatgtaaaaataaaccttaccctgtgattgccatgcccaaaattcttaaaaggctttaggtaaaatttataccctttggattgtcaaaaacatgatgacttaatcttttcttgtctgcgtatctagccacctatcatgccacttcctttagccttcacctcctcttttttttttttttttttttttttttttttttttttgacagtgtcttgctctgttgcccaggctggagcacagtggtgcaatctcagctcaccgcaacctcagactcccaggttcaagcaattctcgtgcctcagcctcccaagtagctgggactacaggcacatgccaccacaccaggctatttattatttattttattttaagtagagatgaggttttgccatgttaggcagtctggtctggaactcctgacctcaggtaattcacctgccttggcctcccaaagtgttgggattacaggtgtgagccactgtgcctagcctagccttcacctcttgaattgtactctggcaataacagactctgttgttttccaaatgtgccaccatatttctgcacatgcccagggtaacctgtcttctctaactagttcaagtgctggctccactttgaagagtgtatcttatctacaactccatgcagctcatttcactttgcgttatgaatgcttatttgaatgcctgtgtttataatgaagtgcaatttctttaaggtcaggggtcatgtctattcacttgtgcatttccagtttctattaaagattaacatggaataaattctcaagaataatggctgaatccacttccagcatgcaataagcaattactgctggcatttgtacaagtacacagtggtggaaattcagtcatatgtacatttctatcaactattactaaagcagaagtattatgaaacagttaaaaaatatacatgggttatgattatccctgttcattgaaacagtcctggaaaaacattttttatcaggttgtaaacactcactttaaaaattaataaaaagttaatataaagtctagaaatttaaattccatgggatagtgctaatgacaaaatagtagtagaccctaaattgtgaatttcaattttgaatttcaaattttgttttgtgttttatttttttgagacggagtctcgctctgtcgcccaggctggagtgcagtggcgcgatctcggctcactacaagctccgcctcccgggttcacgccattctcctgcctcggcctcccgagtagctgggactacaggcgcccgccaccacgcccggctaattttttgtagtttttagtagggatggggtttcaccgtgttggccaggatggtctccatctcctgacctcgtgatccgcccacctcggcctcccaaagtgctgagattacaggcgtgagccaccgtgcccggcctcaaattttgaatttcaaaatttagggtctactactatgattgtcacgagatatagtccaaatttcattcctacaaatatgtgtgcagacacacacacacacacacacacacagattttatctggatatcctctagttgctttaattctttctaaatagtcatctaaatcctgatgaagcaggagataggtttagtgatggtttcaatggaatgctatcgaaaattttcattttgtttttttttcacatcagaatcaataaatgttagccaactctcctgcttaatcgtcccattgagaatatattttatttcttagtgtctgtgcctaatatagcctgtttatatgaccacactagaagcttgagatctagtcctacttattatttcttcatttagatgtatttccagtaaacgtaattaaattcaagctctcagatatttctttcattaaccatttattctccctttctgttatcagatacagattcagcaattaatttcctgattaataacaattgctatgaaagcatcattcagtccactaagttgctgtgtttctagaagatttgattcaaaggtttgttcttatttctggcttcaatatccattgttaagtcttgccctagggtagaccacaagagatttagagcaactaaactatactaaattggttataattcaatgtagtttaatatacaaggaaatggataatctatttaccatccaactcaaaagaagaaagaaaaagagagtgagagtgcaggtcattttataggaaaggaatgtttttaagaacctatcaaagattctctcagtcagtagatagatggtatgcaaaactctgcttgataaaaacattgcaaaagtgtttttgtactttttttgagtttacatctcaaaacctgctcactttcgggtgtggtggcttacgcctataatctcagcactttgggaggctgaggtgggtggatcacaaggtcaggagttcgagaccagcctgaccaacatggtgaaatcccgtctctactaaaaaaaaaatacaaaattagctgggtgtgttgccggtcacctgcaataccagctactcaggaggctgaggcaggagaatcacttgaacccaggagacgggggttgcagtgagctgagattgcgccactgcactccagcctgggcaatagagcgagactccgtttccaaaaaaaaaaaaaaaaaggacactttattggtacgcattcatgactgtgcatacatacttaaagttaataaccactctaatgggcatagaaactttctgaaaataatgactatattatgaaggacaaatacagtacagtttaaggaatcttgcttaataaatatttaagggtttcattgccatttctagaagttaaacagaacaaaacacattgtaaattctaaactattcctgcaacatgattttccatgaatctacaacataccgtattcattttatagatatcatcatcctcttttcagtaattgaaagtattttccacaatactgagtcaagtggcgatatgaatatgacaggtgtgagctccaagtcgtaatgcatctttttcatatataatattttttatttcaaagtttttggggtacaagtggcttttggtaacatggatgaattatacagcagtgaattatgagattttggtgtatccatcctgcaagtagtgtacattatttcatctttgccacttcctagccaagtgattttggaaaagctgataaactttttatgcctcatttttttaatccatagaacgaggacaaccatagtatttagcctggcaacatagcaagatgccgtctctacaaaaaaaacatgaaaaacaaatcagctgagtgtcatggcatgcgcctctcgttcctgctactcaggggcctgaggcaggaggatagcttgaaccctggagagttcaaggctgcagtgagctatgattgtgccaccgcactccagcttgggtgatagatggagaccctgtctctaataaaaagaaaatgcatagtatttattttataatgtcgtggcaatgagcaaatacaggtaaaccagtcacagtaaaatctcaataaacaaggtgattagctcactacacatctacataaaacataataaaacaaaacaactttatttcctattttccttcccaagctccaggcgtttcacttccaattttggagtgaacaattaagttaattacttactgtgatttcacattacctacgtttgactcagctgtctatctccatagcctctgtggtgttcgagttccctcagtgtgtcacctttctcattgtcttaggagttttcactgcaggagactctgcagttacggagcccacagcactgagtaggtctcagccaatgtttggtttggccagcagcagagtactgacatcatgtttattatcccaacctcactttgtttaattacatatttgtaaaagaaaacaaatactgaagatatatataaaaattctgtgtcgaagggcattatttctacattatgactcctttcatttaaacatacagacatttggtaccaaaaagaaaatatatttgagccttttggattcatttatttgggggtgaggtgggacacttttatttcagtgtcatctgttttctcgattttgtaaaactaaatggttccatgtttatttgtatggttgaataaacatcataatgcaggtgcaatgcccagtttcaggcagtagagcatctgtacttaaaagaccatcagatttgtattaagctgttgaaatttgactgcatagttaggatcagacgttgcttcaaggtacaagaatgaagcaagtcaatctttaacaacgtttctctctgtcatggaggcagctactgtctttaagagcaaggacaaacacaattttcactttgttagaattctgggtcattctccctgagctctttatatcaaagcaatggcatctctggtcctagatacaagctctaattgtttctccttttagaaaatcatttttctctgccgggcgcggtgcctcttgcctgtaatgccagcactttgggaggctgaggcaggtggatcagttgaggtcaggagttccagaccagcctggccaagatggtgaaacctcatctctactaaaaatacaaaaattacctgggcgtggttgcatgcgcctgtaatcccagctactcaggaggctaaggcaggagaatctcttgaacccaggaggtggagcttgaagtgagccgagatcgtgccattgcactccagcctgggtgacagagcaagactccgtctcaaaaaaaggaaaaaaaaaaaaaaaaaaaagaaattgttttgctcttttcttccctattcttaggcttctgaactttttttgttgttgttgctctctatccttgcaactcctcatttcaatgttgaaacaactgagaggtgaagtcttcgtaaatataatctagaattgctagataaaataagaggcccagttaaatttgagtttcagataacaaatgatgttttagtgtaagtatggcccatgcaattcaaatttgacttggtgtactgtgtttttatttgctaaatctggcaagcctaatctcatatctagttattgaaacacgtttataaagcagaatgatgtataaaaaaatctgagttcaaatatgttcacttttatttcttcgcaccatgcaaaactgccgactgtcctcttggatttgaatttccttcttttcctgattttttcatcgctttgtaaatgtttttctttgactttctctcctccttacaatgcaatcgactttatcattgtttcttcagtgtcctgattcttttattctacctcaacatctttatttccccattcattcttctttgtgaaaaaagaattccaaaatgcttattacctcagtattttctctgacacaagtttgttaagaaatactcaaatttttaatacaggtctttgttctactgaaaaacatttcctttgccaagtttagactacattaaggacaaatatcattgctgtagtccatgcacccagaactctgtaataaatagtagtacccgcttcttctttacatgtgtccagttctgtaacttctatttgggaatttttgtttaattataatccatgtgtatattccttgaaatctgtggtagtatgacagaaaacgagtcttcatttggctggtagattctctagcctttcccttttcagattattttgcatcttattgccagctttttaaaaactggtaccccgatcgttttgctgcctgtacctcaaagttttccttatcgctcttttgatcaaatataaactttaaattcttccatttattatttcttctttgactcgcaatataccccattctaatttggaactatttaaaaataaggctgctaactagaagtctctgcacatttctctacccatcccaaaagtttggtccactctaccttcctcctaagtaaaaagttaacaattctcctttccttaccattaactttttaaaatcacttatgagacactgactttgatcaacccattgatcttttttcaggctaccattcttatgtactttaacatgttttgatgaatttgtggtcattataagtattgaatgttgtattccacactatgctttgcatttttttttttttttttttttttttttttgagagggagtcttgttctgtcgccaggctggagtgcagtggtgcgatcctagctcactgcaacctccgtctcctggtttcaagtgattcccgtgcctcagcctcccaagagctgggactacaggggcccaccaccacgcccggctaatttttttgtattttggtagagatggggtttcaccatgttggccaggctggtctcgatctcctgacctcatgatccacctgccctggactcccaaagtgttgggattacaggtgtgagccaccgcacccggcctgctttgcttttttaaatgttgcaaattagaattcttttggttatcttatctaattttctatttttatgttatgtgtcagatagtctggacttacaggaagacctgtcctcttccagcacgcacccttcctcctcccccatcattcccaattcacatgactttctaactttctaattgggtgctttttaatattcatgagcacaggttttaggtcacacagctttttataattatgggaaaagtaaaggtaaatagtgggtgggtactcaaggagctcacctacaaatcaacttgattcaatctatttaatctattgcttatgttctgatttttcatcagtgtcctggtcattgcttaacaatgcaaaatttgtggataaaaatattcatgttaggtgaagctcactgactagcctacaaatcagtgtcaccaattttgatacattttatccacatctccattatctggttaacatatcattttgcaaaatattaaaagatcttcaggtcacaaagggctgtcatgaacaaagtttcttctttttttaaataaactgaacagtgttactatctagttggcaccaaggacacactaaaattgtaatttataattatggggtttttcctcacagaaataaaaataaataggtcttattgaagacatagacagttttgcttctgtgaagatttctcctttacacataatcagtctgacttttctcactcgtttctgcctgaggtggaggtggggactccattcttgacttaataaatctaaattcttcaactgtcattctctcccaagacacttcaccctttggggactatgctgcattttcccattcttgctctttgtacatttcatcctgggtctggcaagacctatttcaaatatacaaagttatctgatacacacaggaacccaacctactctccacagagtgtggaagggttaaagaaaagccacttctgaacatctccgctttatcagctcccgttgggagatcaggggccagcagccttcattagccaataaaaagaaaatgacgtttctttgcaaggagtagactttactaagcaccctatatgttaaaaaaatatatattaaatgttagtttttgtctccaaaatagatatataattctcagatttccttgtaattttctcttaatggctgattaaatcttgacaatataaagcagtccagtcatccacccattcactggacaaatatttcttccatgtaaatgccaggcaccagtttaggtcctgatgatacaccaatgaacaagaaagatgaagtgatgatccaccaggaacttacattttagtgggagagatacacataacaaataggtagatgatatgataagcagggtaagtagatggagagcagatttttaagacttctgtgagctaagacctgattgaagagaggttgtaattttgtggtgtcagcatgatcaggccaagtaatcacttcctattgcccatatattttttaatcatttgtttaaaaatataatgcaaagagatagttctcagactgttttctcatatagaagatacttatttcttagattcttagtactactcattttaataagctatatgagtccacaacattaaaaaatttactctagaaagtaaagctgggtaaagtgacctcagtgtagaaaacttttattatatggccacaaaaggcactgaaaacgaaatttctagagggccttaggggattaaaagggaaatgtttagaagacattaaacctctggaggtttaattttgcaacttccccaaatacttagacgacttcaaaaataattttgcttttgtctaaactcagaaattatattgttcttttttgcccttgctggccctcagaagagtattaattctcattttgggaaggaattattttaatcatgccattaaatgagaggaaaatatcccttttctaaaaaaataaaaaattaaaaataaaaacctcggtgtaaagtggaattctctagagaatgcattgtgcacaaaatgaccttcctcagtgtattactgggatggagggagtcgtctctctgtggggtagcaaataagccctgtggccccctcaatccacctcagcctccacagagcatcagttgctgtttcatcccgggttggtccagacagccactgccagtccactagagggagcacttgagaggaaacccatttgctttcattgatctagatctcaaataaaatttcatcttagaggctgggcgcggtggctcatgcctgtaatcttagcacgtcgggaggccaaggtgggtggagcacgaggtcaggagttcaagaccagcctggccaacctggttgaaacccccatctctactaaaaatacaaaagttagcgtggcatgttggcagtaagctgagatcatgccactgcactccagcctaggcaaaagagtaagactctgtctcaaaaaaaaaaaaaaaaaaaaaaaatttcattgtagaataaaatccaattcctttcagcttttatcttcaaattttggtcattgtttgcattagtcattgttcttcaggaaaacagaaccaataggatatatgtatctgtgtgtgtgtatacacatatatatgcacacatgtatatatttatatatacaaatatatgcatgcatatatatttacatatacacatatttacaattctgtaaaatcttatatataaataagactcacacatacacatataacgtgcatatatatatacacatatatatggcatatatatatatacatatatatggcatatatatatatacacacatatatatggcatatatatgagatttattttaaagaagtgactcatgtaattatggcagatagcatatccaaaatttgcaggtgggccagcacgttggaggcccagggaagaaagactactgcaaatcaaatctgaaggcttgtctgctcactaaatatcctcttgcctggggaggtcaacctttggttctgttcaggccttcagctgattggatgaactctcctccctctaccctcacctcaataagaaggatgtcttagtttctccaggcttctataacaaaatagcatgcaacagaaatgtatttctcacagttctagaggctgggcagtccaagctgctggcagattcagtgtctggtgaggtcccatttcttggttagtagagagttgtctttttgctgtgtcctcatacgatggaagaggcaagccaattctctgggcctctaagggcattaattacactcatgagggttctgttctcataatctaatcgcctcccaagagtcctgcctcctaatatcacattagtgactaggcttccacatatgaattttagaggtacgcaaacattcagatcatagcagaaggtgatttgctttactaaaaatcagcaacttaaatgtaaatctcatcctaaaataacctcacagaaatatccagagtgatgtctgaccaccatggcctaaccaagttacaagataaaatcaaacatcatgctgtttctgtatagtgacactaaaaatagttgctaaaaacttgtatgacaaaatagaaaaatgaaagaaaggcaaattattttggaaagttacagtaaagaacataatctaaacccaacaaaaaagtttctgagactcaatcactgaacagagttggaagaagcttttattcacttcattccactgtatttaacaagtctctacttcagtccctgtggggtttctaatattataaaaagtaatatcataggttataaagatttagaaagagtgcttctatttttgaaatcaataatccagctaggacatattttctagatattattataacatttttacattaaagataatttcttgttatttgaattttatttcccctctcctcggggttcttagtaatacaaatgagtaaaattgctttcagtaggatgctagacacattgtactgtttgcaggtctgctaaacaacagaatcaagtcacctccttggcaggtgaccagcattaactataatgcccatcaaaacagtcaataagaatcacagatctgtggcaccatagaataatggcctaattaatctctgttcaatttccatttttatacctgctcccagattcccattatttcttatctatgagttcttttctcatttgaaaacatcttctatggattttccttcattcaatcagttgtttttacattcattcatgtttgcattcaaagatatttactaagaacttagtataggttatacatttatgaatattattcaaacactgaagataaagattgactgattaccacagtggacagagatacattgctgttaaaaaaatctgagtcctttaaaagttttttgtttatcatttgcaagagtatatggaatactgaagtttcttctaataatatcaaaggaatagttaaaatgccatagggactaaatgttacatatgtaaagtaacatagccatctggtctgtttcattcttatttccttaggagaagagtgttaagcatgctctaaaacatttattgagggcacgttttatgcttacgtttaggttcagttttaggtatatagaaattttaaaaggaaaaggaaaaaaatttttaaaaaaaggtataaggggatgataaagaggaggccagaaagaaaagaaaatacagtttctctcctttcaattccttaccattactttaccattcttgtgtggaagtgggagggcgtatccacagaggggtagaaataggcaaataccacataaaagggataattgcaggttggataaccgcacacattggaaccaaaactgcttccgaaaaggttataggatttagatagtgccaaagactaagtctgaaacacatttaaaatagttgtttatttacaaaatttggcacaggtccccgtctattgctacttttctgtcaacagaggtttaaagtttttagcagtgaaagttttatatagttaaaagagactgagacaatctctggaaagcattttattaccatgggattcccttttttgtgtgtggaagtgggagacctcctaattggtgttcaggtacacttcgcagtcttggttgagtgcaaggaggcaagtgagcagcatggagacattcaaagacaggaggattgtcctgggttagggtcagtggtattttctccatccagctattttctgtaacaaaagggtttgatgagttacttttcttgtgaccaaactctcttaatagtcccttatggggccggtggctgtcatggcagtttgtcattagtaaagaagttgagactactctagtttggcaaacaatatgaataaagtgacaaggtgatgatgagcatgcccatagtcttgctatttaaacaatgattattaggccactccagtgaaagataatgagaaatagaacttctgcttacagaagatgaattttgaatgcctaaggtttaaatttagatttgatgggatagaactttgcatattatttacatggttttgaaaacaggcatgaagagagaacaaggttgtaaggagcttaggacagaagagaccaagctgtcttataattgagtcaggacgaagcacaggaatgttactttgaatcaatgctggccttaatggtccactgatctatgggagaagaaaaaaaacttgatatttaagcattggtggaaaacacacacacacatacaaaatttctgaataccagagactgagggaaatttgtacccaacctaattagttgaaaatacaaagcaagtttcatcaatatagcttgtatagggttaagaaaaatacttaagcattacatgattgctgtaggagcccattttttggaaaatttccagggactctttgagtcaacttgttaaaaacagaagaaaggctaggaaagaaatagcttgttttatgcctgtgattataggatttcatcattatgtgggccactgagtgttattttctcaagttcatgcatatgcagagatttaaactaaatttgtgttctactcaccacgttaagaggcacaagttatcaaagttactaccaatacattctattcccccgaaagacattcaaaccataattctctcaagttaaaaaaattaatattttgtaaagtaaccattgtccctcttctcaatataatccaagtgctaacacctttgaacacaccaacaatggtctcttgattaaaaagaaaccacattaggaaagtcctttgaataacataaattgtctcctataataaaggaagacattggaggtaaaaaaaaaaaaaaaaaaaaaggtttcagcaccaatcttcaatctctctctcacaccacagaagattcagagctggagttgggaaatgcagtggacttgggtaaactgaggttttcagtcttcatactagtcagaggtcataattgattgagtccagttgtgatataactttgggcagtaattttagtcaattgcttcctaccaaagttccgtgctctttgctggaggctccgtttctgaaaagctctccctctgcccttctttctttttctctgcacacacaaccctcacgcagctttcatgctgcctaaatcagcctgtggattaggtattttctcattatccagattaaaagacagctcagtctcacagagatgtaactgactatttgattgaaactgacttttttccccattggaggcacatcagaatcacctggaaactttaaaaattctaataccagaccatagccttccaattctgattgcgtggatctgaatggggtagttccctggtcttactcttcacaagctccccatgtgatgttaacatcagccagcagaggctgcgaacacccataaaaacaaatccagatatgttaatagatgttagggaaagtgggagaagagggggtggtggatttgcaaatgttaaacttgttacccaaataacctctccaagtaaaacttttggaaggatagttttgatcaagagaacctgcccctttttggatctctttcacctgcaaggagaaaaaaagtgagaaaaggaatcagctttttataataaaaaaaatgcagatggagattccgaagtggctcttcagcgtgaggatcgaatttttacagggaaattccctctgaaatccttctagaaattcctgctatatcatctcccacttacataatcattgccccttatccactaagcaccccccacccccccatctgacagtcttgtcaacctcatgtgtctggattctcagtcttagtacagtccctctttcgggggagggagagctttggagtttggaggagaaggaggaaaagtgtgtgtctggcctgaaggtgatgatctaaaagaagtttccactgaagaaacacatctgggtgtttcacaatgtggctccttgtatcatctacatcacttggaaacttgttagtaatgcagattctcagacctcaccctggacttacaaaatcagcaatgaggggctccggctgagcagtctgtccgagcaagtcctccaggtgattctggtgaattccagtgcaggctaaagtttgagaactactggctatctcatgttttctcttgagcttctcttaccaaccttgggttgctttgttcctgtttgttttatagagcttttctttatagagcacccttggcataagtagctccatcttagaaaaagactccatcttacattttaaaagccatcatgccaacagggaccaggtgttcggctaaccaatagagactgcacccaaccagataaggacataatcattcacaccctttcactattagtcctcgctagaggactctgtggccataaaaaagagcaggatttcaccaattggaaactgctgtcttagcagacaccatctttctgtcccttgtgataagtacccagcatcccctgccgaagactctgcccacattaaaatctcttccttgcaagaccctgatggaccacctggatcaggacgaggcattgtttggtccacattgctctctctgaactggtttgttaacccttttttcctatctcctttatcttgatgttaaatgttactttgttgtggaatgtttagtcaaaacagataggtaggtaggtaggtaggtaggtaggttatgtgtggtttgcaatattgtctgacctgtggagtgacttgagcttgtgtgcctatggctctgccaagtgaatgggtagcactaaagagaattacctcctctggagcttcaggtagctcatggctttgatgattgaaatagcattggtgaaagtctgacattatggaaagacacaaatatttgtggacttggtcatgtctgactgtgcactgctcatgataccttcctattacttcgcctagagcctgaatgggaaagggagaggcaagcaactgaccaactagcaaacaaataaaatgaacctactgtgaacagaaaaactatttctgcccatagtagtggcttattgcagatacttatcttcagtttaaagttatctttgagtctctatgtttgtagctggaaagatgcagatgttttaaatcaagaaagttggacaagtttgttcctaatattccttccaagtttaattcaatggatatatgagtttggggattaataaaaaaaaacagcaaggagtaagaatctttgggaatataggaaaaagtgctgtattcaactgggaaatatctacatatttaaagacaacttctcagagaagatgattataagcccacattatgttttatttcaaacgtgctgttggatgaaaagttgctgaataagctgaattcaagattctcccctaggtagaaacatttgggtgaggggtggtggggagaggtcatacaatgaagaattgtctggttaaagattaggctacttgtaagatggattaaagatgtaggcaagtttcaaaactgatagtcagctgagtggatcttcccagaaaggatctttaagtatcatgagagtttatcagaaaattgctcaagtgttttattaggaattctaattattttcaggaagggctgtgaattacatcttgcaaaaaagctctgtctcccaacaggtttggtgacatttattttttctcagtttctagtctcatctcttctcacattttatcttttgttcacttttagtaagtaattttaacttcctggatttcaattgcttcctctataaagcagggataataatttcataccataatgaaataataaggctagaaaaataatttttcttttagactgttccaagttttgtaactgactaatctaaattatgcattggggggaaggtgatatgagatgtgcttttcagtccttggattcgatactaattataataccaaactcatggtagattgatttattctgtcacatatctatcaaacatttgcagtttctgctgttatgtatgctttatgcattttacaaaaaatcatcccaattacacaattactctatgatgtaggtacaagaattatccccattttatagatgataaacctgagacactgaaagtttaaatagctagcttacactcaacagtgtggtatgtggtttgtggcagaggctggatctgaactcaggaagcctgcctcttgtgttcaacaaacaattcactagttgatatcctgtcattccacttgattctccaaaaataaggttgggccttgtcaaggatcaaatgaagactggtaatcctaaagaagttgaacttcagagagcctcagtgggagagaataacatgcctagtccaggtcgttaaaacttagattattttcttacatagtattggctactgcccgttctgatgcttgtacatttctgttacggtcctcggtctctggattgaaccttatccactagattggagcataggcactgtgattcaccatgttattctggaatctaatatagaaaatgacccagaagcaccatttttaacaaacctgggttccctagccacgtagaagcatcagccagatccagctggagccaatcctgctgattagcttaacaggttctctgttttttttttttttttttttagaaaaagataaaatgttacaagatagaacatcgtcttattgcttcttttgttttattgcccctgccattttcttagagcattaaaaagaaatcactttctcagatggtatgaggatgaaaggatccacattgggaacaggaaaccaaagatctctgaagattttgaaagcagagaaagaataaccaggtgtacataatgataactaggaaatacaaaaccgctgtgagcaaaactgtttcttccagtttgggaggctccaaagtgaatcccgtgatcttagacacagagatcaggttaaaagagcctttcttccaggcagcctgctgctgcatgatgctcatcattccacatcctgaacaatcctcaggcttcaggctggacgagtggtctctaggtaccactgtgtacttaagagtgccattttctgagtgcatcttctgtgccaagcactgtgctgacatagtatcttattggcaactcttaatcttctatggcatcagtcttattcctattttagtgacaagggccctcttttgtaagtaacttcctccagccccacagtaagtgcgaaaaatgggattcattcctctgactctttgaatccaacccagtgcttgggtgtcttcaagtatctctgaattcctgacctctgggattcagtgatttttatggcattcatgtgatttctgtggtgagttccctccacccccaactccacagggcctgtctgtgaaaatgaaagataccagtcagggtgcaagacacagtctgttctcatggagtcagtgaaaacttcattgtatttgaaagaccctctgatcaccagaaggtcattcttgctcgccttttccttgactataaggttctataagttttttcgtaatgccacttacaataatacagtatttacaattacatcagaatgacaaaaacacagtttacaggagttagcacctccaaagcatgacaataataggaaaaatgtatcaccaagtactagtataaaaataaaattctctataaccaataatgttgaatcagagagccattttgaactaaagaagtttttgattcccttgtgttaactttaaacaaacttttttggttgattttttttttctattcattccttctgtataagaaataatggagaaatgtgttaaacttttagttaaatgtgtgtcaaagtttaatataaccatatggtttttcctagttttggttatatatgggaaataacatttgattcactcgaataactttacagttgaccgggcttgcttatgttggtgaatgtatttaagctcattcaaaacatacagcttgacatcttagaatctgaggaatgactttaggcaacagttaagccaatttttaaaattctcattgggggcactgaattgaaacgctgtaatcttctctagaactatcttctatttcgtgtttcagcaaagacttaattgttctttgaagaatttcttactctaaaaatcgtagcaatttatattccaaagaaatacaattatcttgctcagaaaagagaagaaatgtagaattgcctttatttctaagttataattgcaatcatgtattggcagcacatgtgaacaacttagatataaaattatgatggggaaaaaacctgcagcaagaagcaaagtgtgcatagataatgatcctctgccaagtaaaatgagttctatttatgtatttgtttaggcatattaagtgtctagagcagcagtaatgtgaactttacctttttggttgtttacctttttcaacacctatcaatgctgtattggtaaatattacatacacacacacacacaaacacacacagtcttgctctatccccaaggctgaagtgcagtagtggaatctcaactcactgcaacctccacctccagggttcaagcaaacttcccacctcagcctcccaattagatgggactacaggtgcatgccactacggctgactaatttctgtatttttggtagagacagggtttcaccatgttgaccaggctggtctcgaactcctgacctcgagtgatctgcccgccttggcctcccaaagtgctgggattacaggtgtgagccaccatgcccggccaaatattatatgttgtacgcattgggtactatgtattttaaagtcaattatgtttaactttgctcttattctataattttgcacctctggaggtaaagttaccatgccatataaaaaaaatggagataaaagtaatacattttacgataaaaccactcttccttttgtttttatataaataataggtagaggtctctgtacatattttatttctatgtttgtttgtttatttgtttatttattgagccttcgtcacccaggctggagtacagtagtgcaatctccagctcactgcaacctctgctttctgggttcaagggattctcattcctcagccaccagaatagctaagattacaggtgcacaccaccctgcccagctaactttttttgtatttttagtagagacaggatttcactacattggccaggctggtctcgaactcctcacctcaaggaatccccctgccttggcctcctgaagtgctgggattacaggtgtaagccaccacagctagcccatattttagtaaggaaaatgatgggtggcatgggactttgaaaactaagacgatatacttagtgttttaaaataagattttgttactgatataaaccacattgaagtgaggaagactgggtcatagtccagcaaagattgcaccttattttcttaacacgctaaagtgacaggccctatggttggtggggaagaaaggccttgtgacctagagggagaaaatgagatctttcgattcccagagtgagagagaaagatggacactgtctttagattataaaattcaaaaagcctaccgaaggggtgttgagagctacacttgaagggggctctgtattcatttagggacatttaacattacagctttctgtcatgttagcataggtcactaggtgtaaaaatggcatgataagcaatatgcgggtgttaaatgtaggagcagtatgcaagagtatacaggatagaaaaagccccttgagtccagaaagcaggcttgagtcaagagtgatagcctggactaagtggtattaaagagaataaagaggtagaacaatagaaaatagctcccaaagaaaaactaggcatacttcataaaattacagaagcagggaacaggatgacaaatgtgatctacatttgaaacctgaggactaacatgtgaagttgcctctgaagagatggtaagggaacctgtctgtgtgaggggagtggtggggaacaggacagttaatggacgcattgaacttggtgtcatctgcgtaattcaaagaaaacatgtagtggtgggtggaggaagatttggatataataagttgagtcacaggactgacgttgagtgaaggctccaggaaaaaaaaaatactaggactgacattttactgataatttacaattcttaagggggaaaaagagaaaaaaaatcaagcatagaaacaaaggaataataataggtattaggagaaaaaagaaacacgtggactaagtgagagaattttatgaaagaagggatgctgataggtttttgacaaaacgcttgggcatcaagagaatgaaaaggctttggtttgggggaaaaagtctcattggtggcttttgagaattcagttttagtagagagatggagttgttttaagaggaagtaaatggctaattgtagaagtgagctagggcaatgcccatcaggcagtctcttgaggtccagtgaaacattgaggtttagaaggcaattattgatcacattcagaatcagcttacacagaagtctgttgaacaggaagcaagtctgccaagcagggcaacatcgagtaattcctttcaaagggaatccttgcagcggcccactcagcaatctaatcagataacctaggagcactcctttggggctccaggtaacagctcaggtgcaaggagacgaaatgcacagtgggtgtgtgcaggaccttctgccataatagcctccttctaacaaggggtattcctctcataaacattccttaggcacaaaacacaccaagttacaatacttaccacatgtatggaactccaaaactacggtaccgccatcaggcattcataatttactggtatttctccaattcaagtacaatttattttttaaaatgacgctaggaaattgggagtccacagatcagcatgagcatgaataagggaccctctgtgtgaaggaagttaaggatcttttcacatggagggtgataatgaaaactttaagtgagatgactcactatagaatccaggcttcatgaaaaatatggaacttgggaaaatgtaataggttgagtgactagatcgatagtggaggttcagaggcagatggagagaggcaacagaacagattgcatcgtttcagtattgaacaaagtcttaagtacataatgagtgcaaatatttgtttgattaaaatgagtgcaaatgggagcaccaagttcaacatcttagtgtttagatgggtgacatacaaggatgatgatggtttgctaaagaagtaaataagtacaaataaaaacaatatagagacagagacgttcaaagtaatagatggcaagaaaccacaggaaatgcaaccctgttggtgaaatcactcaatcatcatggaacagtcttgagtaaaaatgaaattggttattaagtgaatttgtttttttattttatttttaaattattttttaattgatgcatagtggtacatattcatagagtacatggtgatatttcaacacatataatgtttggtgatcagatcagagtaattagcatatccagcatctgaaacatttattatttctttgcattaggagcattcaatatcttccttctagcaacttgaaactatataacaataaatatatattaactggactatctccattaatgctctatgtagccatatcagaagtccttagattttttccttcacatttttttttgcttatttacagcacaagcacgtatgattgcagcaccccctaactgttctcccgtacttgaagaaatgtccagtcccctgaatgaactcacctataactgtatgataccctctaaatccagctataaactataataatcagcttataggtgaaaaagagtcgaagatcaggggtgcaaatgaacatcgagatgatccaatgtaaactctgttttgttgatgcggaaactgaggcctggagagttaagtgacctcctaaacttgcagttcttggtaacagttgtgaacatgaattccacgtctagtgctctagactaacccatgctgtcttcaataattccagtgaaaaagcatagcagtttagtcctcccaacaccaatgcatgttcccacattcccttttctcaatctggattgttttttcctggatgagtcatatgtttctttatcaaattctaaagcttcagagtgaaagcagaggcacagccatcctatatgaataaagcagatggaagtatgggatggtttcatatggaagtctacaggtacaagtcacataactatattttaagtcagcatcttgtaatagcttccttccagtgtgcgttatgggttgtagcatgttgtggtcagaagacatgtatttaagtctgttctctctagtttatcaggtacctggctgtaggcatattcacttaacttctctgggtatcagttgaaagatcattatatctaactgtcagaatagttttgaggatgacataaggttaaaatgtataaaatcatgagacattttcctcagtacatttgttttctctttttacttttcctccaattctgctatcaaagctctggaatgtattaccaatacatctgtcatctgttaatattaatgggtcttctgtttccttaaaatacctcgataatgtataaataggaaaaatattactttatatgacaatgacatcaagaaaaagggagaaaaataagatctgagttttctaaaagaaaaatattaaataaacaatatttttaagatatatgaattcttcagagaagacaatgtttacacagggtgaaattcaaacgtaattttctgctgaacaactgtatatggaggacatttatggcaaatacaaagcagtgtttatatcatttgcatgtgtgtgtttctttgttcttaaaaaggtttcagtgaaagacaagagcatcgtcttaaaagtgaatctcaaaggttgaggctgttttgttcaaaggagtagacttcctgaggtttatgacaaatcaatgcgagggtcaaatttaaaacacctagagaagtagagaatgctgtattctttatattatccaaactattcaattaggtttttggaaaaagattgataacataaattctaggttatataggttatctccctaaatctgaataaaattctgagagtgtttagtgcttatagctgtaactgagtacattttccactatccctccctccccacaaaaggatagattggtcattgggtcagtcttgttggagacgactggcaagtcaaatggttttggaaagtaaagtggatttccgaacagaaaatgtttttccgcggaaactatggaagagatcaaggacgaaggcaaactaaaccttgaagatgaggaacggtagtgagccatatctaacaaaagctttactattcatggcttcctagtttgcaacttaacgtgaagtttgttcacatagatctgagaaaataatacctaattattgtgaaagaggacttaagagggattctttagcatggttcaggtggggctttaataagtaaaggcaaaaatatttttgtttcaggtctctaagatacatttcatgtaaaagtccataatataaaatgcaagcctatacctctgagtcaaagattcaaaagcacttttaatattatggggaaaaatttttttaaaaagccttgtagattatcttcaagggtttgaaattaattccaagcattcattagaggacaggaaaagtctgaaaatattatagtatgcatgagatgacaaatggaaattaaatgtgtactatccacactataatatttcagagaatatgaaaattaatagtgataccacagaacctgtataatttttttcctccgtgattttgtagggaatatggaattctgtgagaagaccttgtagttctcatattgtacaatgttctttgaaagcaggtgcgtatgccttgagttgtggtctcctaattatttagttgagaggtgtaaccaatggactcacctgtgtgaaaggatattggctctttatggacgcggaaattcaatgatagtgattctcaaaatgtggttcctggaccagctgcatcagtattactttacaacttgccaaaaggtaaatacttggcactcactccagaacaactgaattagaagctccaacaatcagcgttataatatgttttccagagaattccattgcagctaagttttaaaaactgtagtctctggcaaaatccgaggcacaaccagacacatctctgtccacattttacagtctctggcaattcatactgaaccacttgtaataaacatgttattcggggttcatcctaatattatgcttctagcttttgaatgatttattaaaaatatagctagtaatgcccttctaatttatcagcaatgtatccttttggtcacccattaaatcacatgagaaatgtttaaattcctgttactctggcagtggattgaaatccaggcaccgccaggttaaaggttccttgggtgattccaatgtgcagctacattttgggactacttccttactaagcaaatttctcagcttgattatgcataaaaattaccagttcaccttctgaaaacacaccctctacccccagagattctgatcagaaggtctaagatagttctaggttgttgcatttctaaatagctccacatacaattctatgttgttcagccagtgctggtaccaatatttggaagctctagagagaaaacctctcggtacttgttcttgtcaagtggtaagggatactttaaaaaaaaaaaaacctaccatgaagaacaactcacctattgcaagtttttgatctgtaggtcagagaagtgaccttttaacacaaatattatttgaatggcgttgtcaggttactttcactggggaaaaaaataaaaaatccatgaatattcagtgatacaaatggttagcagaagacaatgctaaaaatgaagggtattatgacagccaactgttttaaaacttcaagtttggagatctttgttacttagaattttgtaatctgaacaattattctgaaagattttgatggatcattagataggcaagcatctgttcaagtaaaactggttatttgctgacaaagcagaagataattaagaatcataattaactataagctagacataagtcaggattataacacttattataaccatgtataatgataaaatttctcattatattcatctaaagatttttgggtgcttaccgtgagccaggcactgtgttaggaggcaagcaaaagttacaaagaatggatgataatcttttgttataaaatgtagactgttgttcttaggaccacaattcaaagaggaagtgtaagacaaaagttcaagaagggcagtggaagtgaatgtggaacatactgaaggattttacaacacactttgaaacgtttaaaaaacctgcaatgattttacttgaatgcggaaagacagaatgctaaagctcaagcattgaaagagaactaaatacatagggtgtgttacgggctgaactgtgttcccccacaaatcatatgttgaagtcttaacccctggtaccctagaatgtgactgtatttggagacagaggctttaaataagtatctaaaacagggttgttacggtgttctctagttcggtctcactggcatccttaagaggagattaggacacagacacacacagagggaggggtatgaaaggacgcagggaggccgggcctggcgcggtggctcacgcctgtaatctcagcactttgggaggccgaggtgggcggatcacgggttcaggagatcgagaccatcctggctaacacggtgaaaccccgtctccactaaaaatacaaaaaaaattagctgggcgtggtggcgagcgcctgtagtcccagctactcaggaggctgaggcaggagaatggcatgaacccgggaggcggagcttgcagtgagccgagatcgcgccactgcactccagcctgggcgacagacagagcgagactccgtctcaaaaaaagacacagggagaaggtacccaagtacaaggaaagacgactcagaagaacccaaatgtactgacaacttggtcttggacttccagcctccagagttatggggaaataaatatctattgcttaagcacccagtctgtgtattttgctatgacagccccagaaaactaatacagatagtaacttgctgtagacactgtctacagagtaacaaacataggcaattaactgaacatgggaacaagacttagttggccaaaggtggtggtgcttgcctccaatcccagcactttgggaaactgaggcaggtggattgctttggcccaggagtttaagaccagcctgggcaatatggcaaaacctcatctctacaaaaagtgcaaaaggttagccaggcatggtagtgtggtgatacatgcctgtggtcccagctactctaccctgaaggctgaagtgggaggatagcttcagcccgggaagcagaggttgcagtgagctgtgatcatgccgctgtcctccagcctgggtgacagagggagaccctgcctgggagaaaaataaaaattaaaaaaaaaaagtcacttctgactatagggattatctgggagtctgcaaggtcttctaaaaggtgatattttaaatttaaaaagttacctatttttaactcctggtagaagtaaacattgttcttccttgaaaacataaacaaaacaacacgaacatctcagtattgatttgtcatctccttttggaccagatcaaagatctgcctgagataatttgacttatacataatattaaatggtattagagtgaggttacagtatatgatttcagtgtcttttatctcttacatactgtgttctctacccggaaggagtgaagcagactgaggggtcacgtggtcctatagtatagaaatcatatgtagaaattgattcagctctgatgcatacatatggatggataccttgatatttaaatgggacctctgtctcatttctccatctccctaaataattaaaaatcagttcactcttccgggaatcattttgaatgaattgaagagtaatttgcaaagcaagacgtataggggaaagagcatgcatgtgtgtttgagtctatggggacatcgcatttggcatgaggtgctcaggattcagaggactgtcttgcattttcctagcagtcagtggaggccttagcattccaacctaggaagctctatagatgtaagcaatgtgtttgctttatttgactgctatttatatgacagtgacaaacagatatggggtaaacttactgttttgaaaaggtcagacaaaggcaaggaaaatagaagcaaatgaagtgaacgcatgaaaaatgattactcaaagaaagatacaattatgcagagcctgaaatcaactcttggtttaatgttgtgatatgagtctctcaagagaggacagcaatccaaaaccatttccccagagaagcatggaattttacagttagatatttatttattgtgggaagtatttttaaacatctttcaaaatgcaaatacttagtgtcaatgtgtttttagaccctcctctgtgaaagagatacgtagaatggtagaacaaggtaagagtctaaggggaagtgggataaaatttcaggaagtgaggggttgtgaatagtctgaaatggagtatctgagctgcaggaggagcagcagccacttactggtccctgcgggcctgtgcccactagggcatatcaaaccctctgatggagctgctccaggctagcctcgtcaagccatctcccagcctcaggccgaggagatgcctgacggggccagcctggagcagctgcatcagaaccctacagctgttaagaacctttataccagcagccacaataacaccaaggtcacacaagatttcaagcaatggaggatgcagcaagacaggtgatagcatcagtgaaaactttaaatgagctacaaatgttaacagtgttcccctgcttaatttactgttttcctaaacagctatgaactatttgaggtgaagctcaaaaggacatactgaggtccaggaaattgaggtcaagctgcattttccagacagaggtttcaaatcctacatgaggaggaaggttatttacatattaagccttctgcgaagttcaataggtagactcttgagaaggcaagtcttgatttgtagaaagggctccatctcttaggcacctgagacccaggtcacccttagcgttgctcaggttgtacttcagaaggactcccaggtaagggaggagtgagagttaaattctagctcctgacaagcagggctgtgggtacccagaagatggatcactacttctttatatgcacaaagattttttttaattttattgtattttaagttctcggatacatgtgcaggacgtgcaggtttgttacacagataaacgtgtgccatggggcagcagccatcactgtagctccaggccaccattttttcctctgctggtgctggggagactggatggcttggtcccaagaggtagttcctacatttcagcacaccagctgtggaagatcgtggcccaactgcctctttaggacagactctgacccatccctcctcactgagtgggccctccctgcaggaactccagcaactccagccaggggcttagggaccaaactctgatcttcctgggcctgagcccctagtgggaggggcagctgtgatctccgtggatcagtagatttagtctcttctcctgctagctctgaggaatccggacagctcagacgagtgggtttcccccgagcacagcacactccctccaccaaaggacagtcaaagtgctttgttaaatgggtcctggatcccgtgccgccctgactgggtgagacttcccaacagaggtcaccagacaccttatccaggagcattcctactggcatccggtcggtgccccttgaggacagagatcccagaggaaggagcaggaagccatctttgcctccttaggtgacatctccaagtgtgggagggacccaggtgaatagtctgaagtgaacccccagcaaaccacagcacccctacagaggagggacctgactattgaaagaaaaacaaaacaacagcatcaacaaaaaagtccccacaaaaacctcatccaaaggtcagcaacctcaaagatctgaaccagacaaactcatgaagatgagaaagaatcaaccaaaaaaatgctgaacactcaaaaggccagagtgcctcttctccaaacaatcacaatacctctccagcaaggacacagaactgggtggatgatgagatggatgaattaacagatgtaggcttcagaaggtgagtaataactgttgagctaaagaagcatgttctaacccaataccaaaaagctaaggaccacgataaaaggctacaggagctgctaactagaataaccagttgagagagaaacataaaagaccggatggagctgaaaaacatagcacaaagatattttaaatgtaccaagtcatacagccattgagaccacatctttttaagtttttaatttgcaaaaagttgtagaggcagcccctatctccctttgtggtgtatcagcctcagggatcttggcaggtggaccagcattgggatctttcacagcataatttatctccatgcttctggtgctctgagtatctggatggtctgagactattactatgaagaacaaagtcatgataaggtatttctgcagcctaagaaaactgcagcattctgttcactgagaaatttgtgcttccataaaaaatgattttaaaaccctatctattattgcagtgaataaaatgagattttgagcctattgttggatttaatcattatttttatggcagaactggggttgtgggagtagttataaccagttgtgttcttttaatctcttttattaagtcatttatcataagtaaaattcagtttctgaccttggtgctttatttaagtttccaacttatctgtttcttagcatgttttgtgttcccattttaagtctgtaagggttatagaatacttatttcattttctctataagaaactgtttagcaatctaggatagtgttatgattaaatggcaaaaagaagagataatgtcaaaattaaagctacttaacagtaaggggcatggaaggctacatatcaaacccatctacactcaagcttcattttcaataggggattttctatggcctcttggctttcttgcttagcttaatccaagatttctgattatcaggacaagagaagagacaaagggtgaacacaaaaagtcatttagaataaatgtatgtcatatgatagtccaaattaaatgcttttggtattgctgtatccatattcctttaggttacatccattgattctttttacatctatctgcattgcatagccctgtaatacttaaaaaatttcaaacagagtaatgaaaagcatggaaattcaaaagacaacagtgaaagtaatggaaaacagtattaataatgtccagtggttgaatggcaatgagtgatactcaacgattgaggagtgaataagattaattaatttaactttgatggtgatgtcctctcctagaatcttgtttcctttcatgtttttggtacgcatccttcctctctctgatgttctgtttcaaaatttaccctcactattaagcttttcctattatgccaaccaaggttaacacatttttttttttctgaattcctataatagtgctgctatccacgcaactatggacttggtgagggcaggaataagatcagtttgcatcccatcagacccctagcactgttagcatagaattgggattcacttgtttgttgaataaataaatgtctggataaataattgccataaaatttgtacttaattttcatagtactctcataaaactgatatgtgttgagtgtgttttcgattataaaaatcttgaagagaggatcagtgactttcagctcttcattttcctaccctgacaatcctcagttctaactattgagattaacctcatgaagtagagtacaaggtacccaagggaagtctggagtagtccctgtgacatttctggtcttcacagaatggtgtttgtggttgtggtgagaagcagtggaaggttcctcccacacacatggtctttcacttttccctgaaatctggcacccttgacctgcttgtaacctactttgtgctgacccattcaccttaataagaaaggtaaatatataagcattacagtccaaatattttttgaatttttataaatggtgtttaatgctatgagattagaatgaatctaccatttgtagacatttattaaatgtctactatctaaaaatttaaatgtatgtacatcctcttttttgacactcattcgacactcattcacttcaatgtttttaaatatacatacagataatgaccaaatttatatcttgctgcactgacttctaaactctatgcagccatgaaaaaggatgagttcatgtcctttgcaggaacatggatgaagctggaaaccatcattttcagcaaactaacacaggaaggaaacaccacgtgttctcacgcataagtgggagttgaataatgagaacacatggacacagggaggggaacatcatacaccggggcctgttgcagggtgtggggtaggggagggatcgcgtaaggagaaatacctaatgtagatgacagattgatggctgcagcaaaccaccatggcacatgtatacctatgtaacaaagctgcatgttctgcacatgtatcctagaactgacagcattataatgataataaaaaaaataatggagatagcattagggatgtcagaaggagagcaagtttgatttcagatacactgagtttttaatgtcataagagatttaaactatacagtccaaatttttggagaaggattgagattttgttttcctattacacagaagaatcgaaaatgaaagattttattttctcagcatggatgcatccaggttttgtgtagctgaaagctttatacaaattggaggtaggggacctcttgatacaaaactacaaataaagtactaaatggagtctttatttaatgaaaaaacccataacaaatatttggagccttggatgctcgagtctctaattttttaagatgtcaagtgctttactagaaatacttacaatgttatgatgaaatgcttcctgagtgtaacctggcttcccttccttagacgagaactcctagaactcacgggtcctgaatctaaagcttaattcaccttgcagtaaattctcctctgtttggtccttgaggattgataaagacttattttgtgtgtgtatatgaccataagatatttcaaaatgcacttttatttcttctttttatgtatctagggtaacttttaggttaagaaaatgttttatttaggcttttctaattgcaaaaaacaaagattctctcaagctatttcagcagagggaaggctcagttcaggagctgagaaagtgttcacccactcaacataaccatgttggatatataatgcaatccagaccctgtaacatacagacacagcaccttctatcaaggagaaggagtgacttagaatcatcatcacataaatacatgtgcaaccgactgcaatagtgctatgagagacacaatatgccgagcacatatgacaaggaaacaaaccaggtcccctgggttttgtttacatgtttgctatattcctcttgtttttgatgatattgctggaggagacagaagggccaggacaatcaagattttcccgagcaaggattatttgagctgagatttatgtatggataggtatttgctaggcaaaagtagtagagatgagggatatgaggtttcaggccatggagttaagagacaagactagcttgttacaatggctcatacctgtaatcctagctacttggaggctgaggcaggaggattccaggaggccatgagttccagaccagcctggatattatggtaagaccactgtctctaaaaaatatttttaaattaaaaaatgagttgggtttcgtggcgtgctcctatagtcccagctattcaggaggctgagatggaagaatagcttgagcctaggattctgaggctgcagtgagctatgattgtgccactgcactccagcctgggcaacagagtgataccttatcacttaaaaaaaaattaaaaagaagaatgaaaacacaatacgcaacataacatggtgactcaaacctaaggttgatttagaattcgcaatagtttcaatgaaagcaaaaagtcatgagtcatgtctcttctttctatatctattctgtctagttcatgagtactggccacaggtgcctatgaacccttgaaacacagcattccagattgagatgagcttccattgtgaaatactcagtatgtatttgtatgtacatagtttgtaaaaggctttgtatgacaaaaaaggatgcaggatatctcattacaaactttcatattgcttgcatgttacaataataatactttggatattgggtaaaatagatacgaaaattaagtcgctggttactttatccttttattaaatgtggctactagaaaatttaaaattacacatgtggcttacctctgtggctcccattatatttctattggacattgctatttgagcaatgactcttagccctggctgtatgtacatcgccacccaccaggccacacaatagacctagggtagtagaatctcttagggcatctgcattttagacaaatgacctcatttgttactaatgattgtcacacaggtgttccacaggctgttcctgtaaatgccatggctcagatgtgtgtattatacattgtttctgcttctttcagcccttaagcctctggtaagctgtctctttgaatctagtcagagtccaggaatcttttcctgctagcatagcctcatgtgcgaaataagttgtgttgattcatttgccattaggacgactgtggtggcagcctccactctggatttactctgtagggattcgtaagtcatttttagtccatgactcttctcttccccctaggaagcccccaccagagacaaaactagagccgctttttatacctgatttttcggaagtcagcttcagaatggatttgtagaaaatcttgtatctctaccagctcattacactttgggtaacgttattgaacgtagaatttaagtttttaaaacagaaatgtaagtagtttcacgaaagaacaacttgtatagatcatgataacacctcgttaaattgaatagatccttgtcttagctgctaagtaagttgatattcctttaaaataccattcatttgagaagcagcaggaataagtgtagttttttcctctctccattgaactccagcttcatgagattatttattttattaaataaattcaagcaacctctaaaatgttctcaatttttgcagcatgatgtctaatgtctttatatggagtgtaaaaactctcacagtctggtccaagtccagtcttgttccccagttctccctctgctccagacaccctgaatgccagccaaactgcactacacattatccctaatgcatgctctgtgtattagtctgttttcacactgctggtaaaaacgtacctgagactgggtaatttataaagaaaaagaggcttaatggacttatagttctatgtggctggggaggcctcacaatcctgatggaaggcgaaaagcatgtctgacatggtggcagggaaagagggaatgagagctaagtgaaaagagaaaccccttataaaaccatcagatctcatgagacttattcacttccacaagaacagtataggggaaccacccccatgattcagcgatctcctaccgggtgcctcctataacacttggaattttgggagctacagttcaaaatgacatttgggtggggacatagccaaatgatatcactctgcttcttcaaatctctagtaatttgaaattattatcattattactacttttgagatggagtttcactcttgttgcccaggctggagtgctatggcgcagtcttggctcactgcaacctccacctcctgggttcaagcaattctcatgcctcagcctcccaagtagctaggattactggtgcccaccaccaaacccagttaatttttatatttttagtagagatggggtctcaccatgttggccaggctgctctcgaactcctgacttcaggtaatctgcctgccttggcctcccaaagtgctagaattacaggcatagccactgcacctggccttgtaatatgaaattagattgctcatcctagaatcttgtaacccttctccataacaaacttctactcatcctctcttctgacaccttccttcccgactcccttacataatgttagtttgccaaactctacttcagtactaaactctaaaggaatttatttgcatgtatacgtatttttcacaagtaagcactagagcacaaggttgaagttcattacatacctgtctttgatgggtagaaagagcagattatttgaagacgttactgtatctctaccttcagcctatgcttttctcttgccatgtattccagtttctattttttcgagacagagtccggctctgtcgcccaggctggagtgcagtggcgccatctcggctcactgcaagctccgcctcccgggttcacgccattctcctgcctcagcctctcgagtagctgggactacaggcgccgccaccacgcccggctaattttttttttttttttgtatttgtagtggagatggggtttcaccgtgttagccaggatgctctcgatctcctgacatcatgatccacccgccttggcctcctaaagtgctgggattacaggcgtgagccactgcgcctggccatgtattccagtttctttaagcttcctatatacagtgtgatttaaatctacttatcatctggatgatttgtcttttaatatacttccatttgcttatgttgagtgaagttatctgaggttagaataacgtacataaaatgatatgtgaattgtaggccttggagagaagtcttaaggacactcctgtttttagctattcttcttttccatttgctgctgtggactgtggtttattttagactaaggaagggcatggtgcggggtttccactgctgcttaaactggagttgaaatcctatgttctgcttcctggcccactcccagcctgcagaagcccccagcactgaggacaatctaaacgggcgggattgaattcaccttatcaccacttcgcgccgaaatttacagtctacgttgaggggttctgggttttgtttgtgttgtttaaattgttgtggtattgatattactgttttaaaattaataattatggtagcatgctttggttttgaagcttcaggttgtatatactgaagagcaacatctttaatttttattatttttattttagattcagagggtacatgtgcaggcttgttacctggatatatttatgtaatggtgaaatttgggctactagggcacccatcacccgaatagtgatcattgtatccaacagtaatttttcaaccttcacccgctctgacccaccccactttggagtccccggtatctataatttccatctatatgttcatgtgtgtctattgttgaactctcacttataagtaagaacatgaagtatttgattttctatttctgagttatttgtcttaggataatggcctccagctcaatccatgttgcaaaatacattatttaatccttttttatggctacatagtatttcatcattttatatatgtaatatatattttatatatgtaatatatattttatacatatatatttatatctattttatatatatttttatatctatacatatatattttatgtataaaaatgtaatatttaaacatatataaatatatatgtaatatatgtatattatatatttatatgtgtaattatatattacgtattttatatatttcatatatatgtaatatctattttatgtaatatattacataacatatattacatgtatgttatgtagtatatattacatattacatatatacacacatatatataatatatacacacacagacacacacacaaacacagagacacaaacatcttcttttcctagtcatctgttgatacacacttaggttgactccatgactttgctattgcaaatagtgctgtgatcaacatatgagtgttgggtagatacacagtagtgggatggctggatcgaatggtagttttacatctttgagaggtctccgtattgttttccatagaagttgtactaatttaatttcccaccaatgttatataagcattcccttttctccgcatccttaccaatatctgatgtttttgactttttagtaatagccattctgacttgtataagatgatcatcattgattttgatcatctcattgaggcttcaatttgcatttctctgatgaatactgatgttgagcacatttttatatgtttattggccacttgtatgacttttgataaatgtctgttcatgtcctttgcccactttttaatttttttgttgttgttgttgtttaatgaagttgttctttgagttctttgtagattctggacgttagtcctttgtcagatgcataatttgcaaatattttcttccattctgtaggttgtctgtttattctgttgtttatttcttttggtgtgcagaaactttttagtttaattgcatgttatttgtctatttttgggtttgttgcattttctttgaggttttcatcataaattctttccctagaccaatgttcagaagaatttttcctaggatatttcatgtttttttaatagtttcaggtcttacattcaagtttttaatctatcttgtgataatttttgtatatagtgagaggtatgagtccagtttttttaggcatatggctctccaattttctcaacaccatttattgaataggatgtccttttcccattgtttatttatgttgattttgtcacagatctcttggttgtgtgtggctttatttctgaatcctgttctattgatctgtgtgtctatttttataccaataccatgctgttttggttattatagccttacagtataatttgaaatcagataatgtgatgctccttgcttcgttccttgtgcttaggattactttggctcttcgagctcttttttggttccatatgaaatttagaatttttttttcttattgtgtgaaaaatgacattagcaatttgataggaattgcattaaatctgtagattgctttggggcagtatagtcattttaacaatattgattcttccaatccatgagcatgggatgtttttttcttttgtttgtcttctatggtttctttcagcagtgctttgtagttcttgtaaagatctttcacctccttggctaaacatattcctagatagtgtgcttgtgtatgtttgtgtgtgtgtgtgtgtgtgtggctattgtaagtgaaattgagttcttgatttggttctcagctcgaatgctattggtgtatagaaatgatactgatttttatacattgattttgtatcctgaaaccttactgaagtcatttaccaaggctagggatcttttgaagggacctttaagatcatgtcatcagtgaacagagataatttaacaattccttttcctgtttggatgccttttacttatttctcttgcctaagtgccctggcaaggacttctagtactatcttggaaagtcgtattgagggtgggcatccttgtcttgctctagtttcttaggggaaatgctttcaacttttcctcattcagtgtgatgttggctgtgagtttgtcatttatcactcttactattttgaggtatgttccttcaatccgtagtttgttgagagttgttatcataaaggcatgttggattttgagtgctttttctgcacctattgagttgatcatatgggtttttttttaattgtttatgtggtgaatcacatttactggtttgcataggttgaaccatcctttgattactggaataaaacccccttgattgtgatggatcatctttgtatatgctcttggatttggcttgctagtcttttgttgaggatttttgcatgtgtgtttttgcatgcaatatcccagcatcagggatgttgacttgtatttttctttttttgttgtgcccttgcctggttttggtatcagagtgatactagtttcatagaattagttaggaaagaatgcctcctccttaattttttttttttggaatagtttcaataggatcgataccagctcatcttcattcatctggtaaaattcagctgtgagtccatctggtcctgggctttttgttgttcttggaagattttttgttactgatttaatttcaagcaaaatcttttaagaaagaattgtaaaatatacatatctaagcccaattaagaccaataaaatgtttgtaagttgaattaaatagtttctctttattcctggtacagtttaaattgccacttgtcttgaagtaaccattgtctcagctatgttacagataccatagcttgtaaaaataaacaaatgaatttgatgccaaacttgaagctcatattggaatgtaatggttttaatgcagacacaatttctttctgtatcctgattagattgaagcattgttttctactgtaacagcataatatttcatcaaaacatacctgtgtttgagagctcataaggtcttcttgtatattgggaacagatatggcaatattaatgactatgttaggttttttatactagcacactttcatatatgtatttgtatttataagaaatttttctttcaaatgctgcgttcaattgacaaaaaaaaaactgcaaatgaagcacagatgctgtgaattggaatacaatgtgcaatgcaatttagccctgtaggctttctggaaagaacccacttcccctatgatgagtagagttgtcagtagtgacaataatgctgttagacgtgaaaaccaagtgtgctcacctatgattgactgacaaagccacggtgcctccatgaataaaatccaagtgctgcgttacaattcatctcatgatttttgtggttcagtaatttatctttataaaacaccaatgacagctagtattccgttgttcctgtgagtgaaatatgatatgcttgcaatatggtttgaggattcactaactatggctatgtacacataatttgtaatcaagttcatgcatgagtagctgaaatataaataggaacatttaagactgtctcaaaactagattgaattctccatttacgtagtcatagcaggatggttcaggtacatgtcataatgagcctttgatgaatgtttgagacattcagaaaaggagtagaagccaaatgagaaccaaaaagaaaagaaaaacagaagaaccatagcattacaaagctaaagactagataaacttaatttttcagaagcaaatcacataatgaaacaccaaaatgagaattaaaaagtcagaatttactactatttgaactcctgagtttagccattttttctctgattttccaatgttgaatggagataattcaggttgctaagtataatattgaatatatatttaccttagaaatttgcacatatacattataagcatatttgtggggatgctgtacactagaaagtaccatgatttactcgtattatagtctatagctgctatattcatcctcccaagaaatctgttattatgccatttcttccgtctataaagttcttactagattaagttcaaacttctttttttttttacttttcataaactttattgatagtggccacaataatttttccttttctttctttttaagtaaacaacatttaaaagataatagtaaatgaattcaaacttcttaatttgaaattcgaagtccttcatcatctggtttcaactggtacctctggtcttatcactcattccataccatgaaatgcatgcaaattgctcttgctgaattatacataatccacttgctcattcagcaaacatatattgagtatgaacaactctgtgggtttaaagatagaaatatgctgctaatggatattcatttatatattctaggagctcaggaaggggtggaaaccatgcaaaaaaaaaaaaaaaaatagcctcctacacttccatcccttaattcttgacaatctcttcatttcaggtagcttttccatcaatttccataaatagaaacttttccatgaagtcttccctatatcctcaaaagaaagtaatccatccattccatagttcatagtgatttcttttaatattaagcaatgttcactgacttttatagttacttctctacatatgtcttccataaatcagtaagtacctcagaagttgaggaccatgtttcaaatattttctctatcatccacagtcttcagaatttgtaactacagaacaatctgttgaatgagtaaaatcatggaagtatagttggggacaaaattattcttatttctttcttaatttacctccttaaagatgtaaaagaaaaaagtctaatttctctcatctatgactgcagtgggtgtaaaatcaaaccatttaattattaaaatgaaaaatagcacatttttaaaagattcacagtacattttgtgaagttttatactgaataaagttttttataaggaaaaataaagcataattattggaaataaataaaagcgtgataattgtctccattatatagctataaaattttatgtctatcattaatcccttataattatttaaaattatttcagtcttttcgtataatgttaagtaataaaacttgcataattatttttaaaagtctaaaaattataaataacatttataattctgcatctgtgataggattttataactgtacttgtaacaaaatggagcttacatttttaaatgtaaaattgaatgaatacaaattactttctatcctgaatacagagcattatacatagcttgctagacatagccaaaaatacatacttgaaatcattataatgaagatgattaaataactataatcattctgaaccctatctttatgatattatgccaaatgtgttagtaatacttacctacattttgacatgttataatctacataaatttactagtgatagatatacttggatttcagataatgcactaaaattttctgcatataataaatatttttataaatgtattatttcttccagttaaaaataatcatctctaaagaaaaagtaaaatataatgctataatttcttgatcaggctaatggtgagacgattattcattcttaaagctttgactcagagataataaatcttgctgagaaagacgtttgaattcattatttctcataataaatgctcagtaaatatttgatgaacttaggcgatgggtccccatagttttattgtcagtactcttcatgtttatgccaataggacctaataatcatataaactacattttcatctagcatctgatttccataaaatgataactttgtcttcttcagtatcatctcattgtcttgacatagtaagagctaaattataatattgattattattaagtgcctagttaaagaaggaaggaaatcatcctagtcagtttccttatgttgcttcataaacctatccctagatgatccaccagcttactatacaccaggcattgttagaattctcgtcagctctcaatggctcccttttgtcacaaagtcaacattgacttgaaccaatgtaaacgctaaatactttaagaatgaaataactatatgattcctgtcttgaggtaacttcatcgatcacagtagaaaatggtaagtttacaagatgctaagtagggatttattaggatgtttacacggtggtagacagagatctgtcagataggtggacggcctaaataaaagcatgagatttgttcttaaattctgtctgcagagcacagtgaacaattcaagtctacatgtaaagtgatcttacagtgacttacaatggactctttctgccttttgtatagtacaaatgatgtttgttttccaaatgtatacagctaattgtaaactctttcttgtgtaaccataacttttgtttgagccaagacattaccagagtgggaaagccgctgtttaaacaaagaagaaaatcaacagtgaaaagaggtgtctagtgaccaatttctgtttgcttgagttccctttgagaacgggctgggaataaataaattaaacaactgaggcttttacaggaaaacaataacaaaagcccttttctgtctttgcacagttcagagacaaaaacagaggtcacacatcctccagcaagtctgcttcatattcaggcgtctcttacagggacgaaaaaatctctcgtagaagtcatgctcaataaaatgcaaactcgtttacgaaaatgccaacattttcattttcttttgatgactttctcagagaataatgatgttcagcttagggttttttattttatttttatttgtagtgccctttgggaaagaacattttctcttttaaaagccacacaaagtttaactcaagcagtctcattgttctttctcccacaaagctagcaagaaagactaatgtattacttaatgaagctattcattgcttaataaaaataagaattagtaacaataactgttatattcacattaaccttacttttatgctttaacatagaaattgttctgatgtactatatttctaccataatttgctttaaaaaataaagcgagtgggaagtataaatcccatgatatgaaaagtaagatatccttttcattgttattgtagaaatctgagttaataacctgtgctaaacccagctaacaaaatctcaagttttggaaagtgcagagttgtaatactgatgataagtggcagctctgaaaagtgaaaaaaaatctttgacttgaatttcacaaacttgggtcttactaccaggttttcaacttactagtttatatgggcaagtctcttaaattttttgaatctcgatttaatcatctgttcattttcaaaatgggaagtaactctggctgttacacagaatggtcacttattaaatttttgatgttcacatataacttaaaagaaagttcatatgtaactttaaagaaggctatatgtgaacattacaaataatgataaggaccaatataataaacctctggtgcaagatttttataacgaatcatcagcattcaatataggaaggctgcaacattgctcatagatatctcccttgaaataggtaaattcaccagatttacaaaatggattagccaaaagcttatattaaatattatttttaaaagacaatatgtatattaagaattgatgctctgtgaggtcagtaactttatttttgatgtagtcatattgtctagggtattgtctgacatagtattgaataattgaatgaaagaattccctgaatatactttcctttagtatattcacaggctgatttagttcataactacaatcctcatgaatatgttcttcatgaatatatttattaaaagactaaacctatgacccttagcttttgataaattaaataatccctacaatactactaatatattcacatttattggatatatttaagagaaatatattcatgaatatattcataagatgaatacattcatattcatagaatatattcaagaagaatatttcttaacacaattacctaataaattggtaaaattgatgaatttggtgagttagtcatcacctgattctttagataattgtttttggccaatccactcttagagaattggttttcactgaattgatctagagacccttcccttgactatgacctgtgtgatcatcagcaggtagctactagctactggagtttaccaccctctacacctgtgagctgagatcaccttctgtgaaactgctgttgggggatagacaggacctccatcttccaaaaggagggaggttagaagccaatgtcttcttcagaccaagagtgacttaattcgctcatccggcttactgtttcaaattcttctccctaaattctgtgccttcttagtcctccttgttcttcagaggctacggctttaccttggggagatttgatagtgggcatgaaaccttagtacaacttgttaaaggctgagctagacacaaaggggacactctaatttagctattagtctaagtgtgtaatccatataaatcaggtgtgaccagccacatgaaactcctttctcaaataatgtatatttagtttttcaaacttgacttatatccccagctaccaaagaacttagcttctccaggaaagtcactgtcattgtgagccatggtttggatgacatcatcatctctcaaatatgtgagagcagagtgaagattgagaatcttcaagctaatttaagccatgacagtggtgagatttcaagagttaaacattaggctatttgaaccatctggttatactttttagtctaaggcatacagagatggtgaatttaagaagaatgaagatgaggaaagcctgagaaaatttaaatacagggaagatgatggactctctacagtttaaagggaaagcaaaacaaaatggtgcttaattttatattatgtatctgtgtgtcataaaagagccttaatcatggttgataattaatcaaaggaaagccctttatttttattattaatttattactattactattatttatatgtagagaaagatgggggtctcactctgttgtccaagctggtcttgaactcctagtctcaagcaactttcctgctttggcctcccaaaatgctgggattacagatatgaaccacttcacccagccaccattaagtttacaaatgaaattagacataatttgaaagtgatatcaacttgaaaacccttaaaagtgtcctgaagtcaccttcaaaaattttatgaagacattgtctactatgccatagtccaccaataatttcttcttatacactgcagttcacatgacattaatggcattgatagctatcagttttgctaaattataatatattaatatcctacaactatatgcatatttcatgagttttttgacacatctatacccccatctaatgagttttaaagataacagtgactccaatattttccacattttaaggtatttttatgttgtacattaaatatattcttgccctgatttattattttattttgttgacatatacatatggaaaaagtccatattatgattgtatagttcaaaggcttttttttaaaaaaaactgaacatacctatgtaactagtgtctatatcaagaaatagaatgttaccaaccctccagattgcttttagtttcaataattcattttaactagagggatgctcatctagcaaccaactttaagcaatacgcagcaagtagctaccaaaaacaatataattgtgctatataataaaaaaagattatctgtggatctagctaatgttgtctttagataggacatgttctataaataagaaaatgataattactcatttgtatcatagaagtttaacattatatgtcatctaacctaccagaaattctctcacataattgcctttgtggggtattgctggatgacatcttcatcctaatattagtattccagagaatttctgaaatagagaacaaatgcttttcccaaaaatcttacttctatcttcaatttcccagtactttctgggactctacaacttggcgttaaatcacagaagtggctatgaattccctttcagattttacctggtaaaagatcttagttctttctatggtcctggtttcatcttccatattggtatgtcatttatttattcccaagattctatgacgttaccaggacttcccatcttccctttactaagatacaatattcaagtgacgagtcctacattttccacatgtaattttcttttttcatctcggtgaaatctctttcatctctgtaggtgttccatggccattgtgtttaatgtttagagtcatccagaacggcaagtacaaatgtgaagccaaaagttttcaacttcaattatataagtatttattttaatgtgccctaaataacgtgtttttttccccccaaatcaatacatcatcattggtctttctattcctctctatggcacatgaatgtattctagtcttttttttaagtagttagcatgaaaaggaatcttgtaattcagctggaatgaagcgttcattttagtgataaaaatttggaggacagagagagaaagcaacttcttcacataatattacagtacatgctgcccaaattctaacccaactctattttagtatatcacacggctctcctgtcttacgtagcatgtaatgaatatcacatatgtgtgcatacacatatacaagcacacatacctgacttatgcacatgatgccaacccatgaaaccatattaataacaaatcaatatttttaaaatttatgctaggataaaaatattacattttaaaatatttttatttttaaccattaatcaaatgcctatcacatttagtttataatccacaaaaagacttggtaacatacatttatatcctaatatgtgttacttcactcacataaatactgttttaacgtactcacctatggcatttttccacacaagttttgccactaggagtaagaaaaactaccaaaagggcagttgacactcaaaaaagattattgttgaattgaagatttctgaagagacatagttaatgaataccttgagaggtacctttcaaggttcagtcctcattaatggtttaattggaggaaatgacattgagctgaaacatacagaagctgctaggagtcatgtagaagaataagtagtagagaggttggcaggaaaaacctacctgtaaaaggtaagcactgagtttttgcctatatctgcagcctgggtgcatcctttgaataaaagttaaagattatctggtggcatgtataaaaacagagttttataaaaaaaggattaatgcagaattatctgaaataagaaactctattcttattatgcaatttataaagcaatttaagaataattgtttctattcaaatcataaaggattgtacctggatgtaatattttaagatgtcttttccttgtcaggattctgatcatgatgatttcctgaacttgggaatttctgagcccctgagtgactggataacctctctaacttaaaaacaattatctcactcgtgttacccagtaaacacaggtataaaaaggctctattttaatgaaagccactaaaattcaagttctttatgattattatggaaccaaaattttgaaatatttcaaagaatagaattaatcatacatactattttaaaggaagccattaaattacatttctgacaatttttcattttaagcttttgttataaacatttagaaaaaatgagaaaattgattcaagaattaaccttgtctaaattgtcattattttcatttttgatattcctattattcctttttaaaaatactttttgcattgcatctataatactaatatgacagaatttaaaaagtcattgaccaatagcattacataatttcttccttaatacataagaggacaggaactatgtgcctttgggacatggagaagaggcaaggtgctctgtaatcattctagtgttcatttctctaacaggataacaccagccttgaagacgggaccaatagagttttaatggcatattacaattaggatatggaaaacaagagaatgcctatatttgggatgacttcttgtcagattcccagttggataccaaactaatctcagctacactctgtcttccccatttatttttatttattcttccaaagctatgtaactctgatttgtaaaatatagagaagcgttttctagaaattataaatatgtacataaagctatttacatatcattagaccatacagttgggcaaactccataaagtctggaatcatcagatttatttttatattgtctacaatgtgtcaaatagatatatcctcagaaaaagtcagaggaattgatttgaatgtccttgccgtttacatagtgtcaattttctataaaccaaggatgattttgtgcctttatagaaaactaagatattacatttatctgaaacatatatgggacaaaaataaaggtctaaaaataacttagtcaatttagatttaagaaattgtaataataataatgaaaacttatattcctaaaatgatacaataacaatcttatcactacaaatctctgcttagaacagaacaaaacagtgactgtaaacaaatactaatatttaatttaaaaaattaacttggatatttattttaaaaagctaaggaacaggaaatataacctataaatgtttaaatagaaaaaacggaacgtaagaaaaataatctgaaaagcataaatgaaatgataatatatgcattacccaataaagtcaaatggtgcaattaaagaatgatgaattatataaaccagggttctgaacctgagagaagacctaaaccactgaaagtgcatacaaatttggggtatatatgaatgagtttttcttggatcaggattcatagttttcattagcttctcaatatacaccactattcaaagttcttctcctttatagctaaactactcgagggtcatatcttccctttccattcacctaccatattctcccctttccactccaatcaacattctccttcacattctcaaatctaatgttcacttctcctccttgttttacttgatgtctcagatgcacttataagagttgactagtccctgcttcttcaaatagtttccttcttcacatcacattctcctattcttttactggccactctctcagtaatctttctttgttaaagaaaaaaaaatattcagtgacacttgttacggcatggtgagaaatattttattcagtgccatctcaatgggtatggggaccacagcaatgggattttgcagtggcggagactacgctcaacttcaaatatagcacgggcaagtgggaatttatatagccaaagaatagagtggggtcagtggatgcaacattactaagaagaaacatcaggtgcaaacaggattctggttaaactgtcctaacaggattctcactgaaaacaagctggggtgatccaccatcccccgggagatggcgaaggatgaggaacctgatcagatatcatcggggtaattagatatggaaaatcagagcagggggagtaggaatgggggtgtgtcttgctaaactgacttagcagggttctttgctaagctgaattgtataaggaattgcacagatgggccttggagaaacttcaggagcttaactaaagtttagtcaagcaaagaatctctgctacctggcctctcatccatttcctcaactttgaaaatttagagtactccaaggttcagcctaaactctcttttctgtgtcaagtctctccccaggtaacttcatcttgccccgtgacttacactcatgacatacgatttgtatctccagactacatttttttcttgagctccagacccaaatatataactgcctacctgatatctctacttggtgatctaacagattcgcccaacctcgactccctcccccagtctctcattacagttaaatggcatcaatttccactcagttgcttaagttacagatctatttctcaaactttcgacagccagtcaatgacccaccagttgtgcttccaaaacgtgaaaaatctggccacatttctccagtgctaacctccgtccaaacttccatcgtctcttgccctaatgacggtaagagcatcctaatagatgtccttaccttcactcttgccttctacttatcaggcctttacctatatattttctcttatttcctcagtccttcccccttaccttttgcactctggtccctttggtctggcactccaatacaccaagcatattttctctcagggcctttgcatcaaatcatcatgtggctgacctcttgttgtccttcaggcttcagatttactgtcacctcctcagagcattacccttttgtcaatcattcttatctctctattacaatctctgttttagttattttatagcagttatcactgtctgaaattgtacctgtaaacccattgtctgtctttgcacacaagaatataagctccctgagggcaggggccttgtgtgtcttctttactcttatacccctggcacctcaaactatgccagttgcattgtaagagatgaattaatgagtgaataaatgagtgaaagaatgagcttgactctttgaaggagaactgtaaaagggcttaagctggtgggagcaaatttacacgttcctctctttagagaacagctgaaaagttaagatgaaaagcaaagactgtcaaatcaccccagtcataagaaatcagagaaagcagacgatgatcatcacgtgcttcttcctgttttttaacctttcttcagttatcaaagtaacgagagtagtttgcagttactcatggccaaagccagatgaaatacaacagatattaagtgtgacatctcttcatgatatgaatattttctctgttatacttttttgggttttccaagttttttccaataaatgtcactttatggatgaagaattgtattctttaaaagtctgtatttaaaacctgaaacccatctcaaatgccactctataatgtctttgtcttgtgacctcacacactacatacaaaatgtgatgtgttccttttctaaaacctccaaagtgccttccctttatacatacatgtactttgtctttatacatacatgacaaaataataatgataaaagctgctactgtctctcaatagtatcaggtacctcatatacattatgactcatgaatcatgatttcctctataaggaaaccaagttacaaagaaatgtaaaaacttattcaaattaaaatagctaaatatttctagaccagaaaccagttatgacttactgtatctctagtgctaaaatagtacttaggaaatagtaggtattcaatacatatttacaaataaacagaggattgatattgtcatttgaaaccctggtataaatgacatcctggtatgatacccagacttaacggctttaccacaccccatcttagatcttacctacattttttcattaatcaatagtcagatgaattagaaccctccttgaagccaacaatagcttcctattcatgacaacttgtattgtgttttatattcaacagagaatcaaatactaaaaaaaaaacaggagagacaattggggagagtgagaaataaagaggaaagaaagataaaggaaaggagggaaggaaggaagaaagaaaggaaagaaggaaggaaggcaggcatctgccaaaagtgataagattaatgaaaatggctccttgtataaacatattcctactaaagttacctggtctgtaagattatgtcaagaaaagaaattaatcattggcagaataataaagtttcaaataagagtttttgaagtatagtgatgtttgtcttttggctaggaatcagtaatggttgaaaaagctaccaaaatttttttcatgaacatttagtcttggggtagttatttaatttttaatatgctaaaatattgatctctgtaagttcaacattttaagagtctaattgttttctcctgtttaagagcaaataatttcatatatattgggtttcccattgtttgatgacgtagaaaacacagcataaagtagacattgaatgaaatttagttgaattttaaaatgaatagcaccactattactccatttgaaaacatttacatattattgaggtaaaaattacatacagtagattctcatcgttctcattagtcaatatatagttatgttctgtatagtcactgtgaaaattgaattggcaactattgaaccatttttcctacgggaaatacagggttaggttcctgccagcctctgatcacaatatttgcaccaactaatcaatacataaccttgttttgtgtgtgtttctgtttaaagttactgtatttaatatttatcattgattaaaactgaactcatgttcaacagcattataacttatgcctgaatcaaatttaacaaacacatattttttatgtaaggcacataacagctttaacttaggaacactaaagagcacttcagtactatgtcaggggaccgcttttaacagcaaagtcaacaaaagcaccaaagtataaaaaatatgacactggcagggtgcagtggctcactcctgtaatccagcactttgggaggccgaggcgggtggattgcctgagctcaggagttcaagaccagcctgggcaacccgctgaaaccctgtctctactaaaattacaaaaaaattagccgagcgtggtggcttgtgcctgtaatcccagctactcgggaggttgaggcaggagaattgcttgaacccgggaggtggaggttgcagtgggctgagattgcaccactgcactccagcctcagtgacagagtgagactccatctccaaaaaaaaaaaaaaaaaaaaaaggcactggatatacagtgaaaagaggcactggatatacagtgaaaagaatacctgtttgcaggttgagaccttaaacaagaaggcaaagcgttagctcagttggaaacttgtgccttaggaccactctgtacatgcatgagtctttaaatgaccatgggtattgattttgggtttataactaaattttagcaagtaggcaaattcacaaatgttgaatctgcaaataataaggaccaactgttcatgacatgcgcagatcttaaaagtacaattcaatggatttggatgagtatatacacttagacagcaaacatggaatcagcatatagaactttttctctccctcagaaagttcctcgtgccaccctacagtccattcccacttgtgcccaccttcccatagacagctgctgttctgatttctatcagcttgatttttttattctttttttaaattttattttacttgaagttctgggatacatgtgccgaacgtacaggtttgttatatagctatacatgtgccatggtggtttgccgcacctatcaacccatcatctaggttttaagccccacatgcatgaggtatttgtcctaatgctctccctcccctttcccctcactccacaacaggccccggtgtgtgatgttcccctccctgtatctattttataaactagttctatgaacatattcataaaatatgttatttttatgtccaggtttttcttacaaaacacaatattttaaaaattcattgatgctgttgcttgtatcactagttcattcctttttcttttttattatttagcaatatttccttgtttgaatatatactgtatgtacatgtgtttatttccaatttgcaactgtcatgaataaggctgtcaagcattcctgtatgagtatttttgcaacatacattctgatattggtagatatatacttaggagggggattgttgggtcataggattaatatatgtttaactttattaaaaattgtccagagttttccaaaaagattgtacaattttatactccaaccagcaatgcatgagggttcaaattgctctagatgctagttagcccttttaatttttggccaccgaaatgggtataaaattatatatcatggttttggtttccctgatgactaataatataaagcactttttaatgtgcttatgaataattaatagatctttatttgggatgtgacttctgcccattttttccagtgattattgatttacaggagctcttagtatattttagtatattctgttttaagatacatgcactgaaaataatttttcctagtctctttcttgccgtggattttattaaccatgtctgttgatgagaaaaagtttttaaatttgatggatctcaaattatcaagtgattttgatgtcctctaggaaacctctgttagcccccaggtcctgaaaatattctgttttcttaggtctcaaatcctttcagaactatttttttgtttgattgtataaagtagaagtcaaaaatacatcttctctgtatttatccagttgttctggcatcattttttgtaaaagacacttttcattcaccattaaattgtcttggtgcctttgttaaaaaacaattgactacctacatgtgagtctatttatgatctttctctgatgatatacatgtataatcttgaaatcaaatgataagttctctaacttggtttttcttttttgcttattttgaatatttaaggattttttttgcattttcttaaacatttttgaatcatctcatgcatttctacaaaaactatattgttgggtttcggttagaatcgcatggtatgtatctccatttgtttagtgccttaatttctctcactgatgatttggaggaatcagggtggaactttaaaagctcccccaaatgactctcatgtgcagacaagataaggaccactacctagatccttttttcttagaagaatttgggtgcctgtaagaaaagaattcatcccatccatccctaagattctacgtattaaataaatgaagtggtcatttctgtttgtttgtttatttgagacagggttttgctcttattgaccaggctggagtgcaataccacaatcttggttcactgcaacctctgcctccctagttcaggtgattctcctgcctcagcctctggagtagctgggattacaggcatgcaccaccatgctggctaattttgtatttttagtagagacggggtttcaccatgttggtcaggctggtctcaaactccagaccttgggtgatatgcccgcttctgccttccaaagtgctgggattgcaggcataagccaccacacccagctatgaagtgatcatttctaataacacatccaaaaaatgtcatgacatacgatctccccaatgtatttgttttacttaaagtttctattcaagtgatttttccaaaataaccacacattccaaagtgactctttgtaactttacaataaggcatttggcagtttctttatcataaaaaacaaaagtaccttgtacctgcccaagcacctttttacatgttttatctgacaacaattgatcatatttataatgtggtttagattggcatgtgaaaatgagaaaggtcaaaatggatccattttcttatgatatggaatttttatagataagaaatagtgcatggcatatttatatgaaaatttatatacctttttaaagttttattgcataaaaggataattgattattaataagatatattagtaacacatcatagaaccctgtaactgcctaaagatgaattcatattctaggaaattttgctctcaagattgaatattgatcacaagactgaaaactccagtcactgtaattttacttgaagcattttctaacagatgttacatcttggtttgccattatattttaaatacgttctttttcttttttcaacattcattaaaccagtcttttcttcttgtctctaataagagcaacatctgtttcttcttgttcaatcaaagcaacttcctcaagagtcttactttaaaaatgataacattagaaagcacggatagaaaacttttcattaatattttacatttgcatacaaaacaagtgtttctaacaattataagttagggaggtgttagagaaaatattataaaacaatttagttataaaaatataaaatgagaaggtgctgtaatatggtttcaaagatgttcgttttaggttaaattttctttatatgaatatcagtttccttttagaaggtacagttgaaacacttttatcattacgaattataacaatggtacataccacactgtatgtggtacagaattataacagtggtacataccacaccgggttccaattcaatctcagcctcttatggggcaagctccacgtgtgcctgaatatattatgaccccaaatataaggcaattctccattttccctggattattttatatttttactaacttgcacataaactgtcaaggcctaagtgaagatgtcaataatatttatgtgtttttcagattacatacataaatcatttagaaagttcattttttcattctcactttttagaaataattttgttctaatgtctgcacaggcaactttaatgtcagtgtctttgccctaactttgtgaatcatctacacatttctgtagaacaaatcatcttcacctttgtcttagttgtttaagatataggataagtttcccatatcactgtatatgttttcccaagcctcaaattcccattaacaaaggactggctaagatgcattttttagttgtcctgtaggtgaaatttatgatctccacattgtaaagacttactgcattgctttcttgtttagaaagcttatcactacattaatatttgtaattatgagatagtaaactccaaagacaatttttttttttgttttgagatgaagttttgctcttgttgcccattctggagtgcagtgacacgatctcagcttgctgcaacctccacatcccgggttcaagcaattctcctgcctcagcctcccaagtagctgggattacaagtgcccaccaccacacccggctaattttttgtatttttagtagagactgggtttcatcatgttggccaggctggtctcaaactcctgacctcaggtaatccacccgcctcggcctcccatagtgctgggattgcaggtgtgagccacagcaccctgatgaaagacaaattattaaatgtgtctcagcttacttttctatgaaataaaatgaattaaagtgtccatgtttttgtcttaataatatagatacactgtctcctatctggcagccaccattctaatgctgtacaaatactaatagtaactagtatacaaatacttaatccacctactcaaagcctcattttatttccagacctgatgctgtatgagatatggctatccccagaaactgagcacttctccagatgtggtagcaaatggaagtgtgtgtgcgcatgcgtgtgtacccatgtgtgtgtgtgcatgcgtgtgtgtgtgtgtgcacgtgttgtgtgtgtgtgtttgcatagtataagaaaactctgatcatggatgcacagggtctatataaataatgtattttgttgtggttcttgtttatttgttcaagctctagaaccaactatgtctgagttcaaattctaacctttacctgttaccatctataggatgcttacagattggtagactcagtccttccctatatactggagataattgtttaaaaaaattttgtgaggtattacgaatcaaatgcaagcaaagtatcaccatggctagcacatagagcttagaactttatactatatatgctgacatataaaaagatcatgaaattctattcttctctggagacagccttcaggatactatttcttacaagatgtagacaaaatatgaaagaagcagcacatttttctataagaaattgggtcttccttgccacatttaagaataaacttcattacatttggggacccatttttatcatagattactgaggtattacctcttgataattaacattaaaatttcaaaataataattggaaatgaaatgaataggaatcaaagcttaagctttgatacagtagtggctgctatcagcaaggatcctttaatctgggttctaatttctctagtaattaagttcctggaagaaaataaaataaccttttaattttaatctgattagaataatagaccttttgccatgaaaaattaaaaggaagatgttccatttctaaattaattttgtgatggagaaattgtcgtggaattctctgaaaggctttcttgttcttccacttagagtaaccgaagatattttataagggtctatctctggacatgtgattatttaggattggatttggggactgaacaaatatcacgttgatatctttgagatccatgtcctaaaactgtatttcatagcagggtttgtcaaattataaagacaaaaatcaaaaaaccatgcagtcctatagttaatcaacaataaatcctactttgtactttaaagggaaatgctatggtgaagatagggtcttcagtgcatcaattccttgggaatacccaaagggacccacttgagatggaactatttcagtaaacactgctgcttgactgacagttaacttcaagaataagcctttacatgcatagagtaattttatagtacaagagattgtatctgtgttgttcttcagaatatttgaaagataagaaataacatttattgttttcccaatttttgtatggacaggaaaaataaaactctgggattaaatgacttaagatattcttgtcagaaacagaacttggacttaaatcatgcctttttctttttccagtgaggaactatcttacaaagtaacctatgagtaccaaaaagtagaccctgatatatgaatatgggtgcatattgtttatttgacattggtccaataaatgcaatctgggagaggggaggtgagacaagttggggtggaaagccacaaaaaggttctttaataaggagattgttactatgggcacctgagttctagcccactggagtctctctgagaggctgtagtaactacagtcccttgcacacctagtttctggactgttcctctttctacatcattggaagccattgaaatgtatgggagttttctgcaggtgacagccagagtgggatgaagagatatacttcatttaataacttgataacagagaaaggtcaattacaaatggacttaggatgatggggatttccaggaacatctattgacattaaattaaacttaacaaaaaaaattatatccacttaatccttacccttagaatgagtcatattgcacattaccgtgtagagctgagaagccatagtcagcaactccaatgctatttttattgcttttttatgtttcatcatttacttggccatctatgaaacctagagtgccagattcctggtcatgatcactccctcagattcattcagttattcattcacacccactatgtaccagacatggttttaactttagggtttttttagtagagaagaaaacagacaaaagagagcttataatcaagtgatagaagacagaaaattagtaagtatgctagtaaatgaacatataataaatttagtaatgagaaactataaggaaaaataaagctcagaaaagaaggaatgttgggagagagaggaaaatgatatgttatttagaatagctaggaaagaccacctctctcttaagatgacatttgcacagagatctgatgtgagggagcaaaaccatgcagataattcacacgaggcattccagatggttcacatgacacatcttagttcaccaaaaggactttagtcagtacttttcgtgagttcaaaaagaacagaaagctgttatagggaatagtgtgatctcagttatacatttataaagataataccactttgtggggagattagactgttagtgcaaagagtgaaatcagaggaacaattggggggtaatgaaatactctgtattcatctgttgatggacactttggttgcttccaaatcttagctatcgtaaacagtgctgcaacaaacataggagtgcagatatctcttccgtgtacgtattttcttccttttgggtatatacgtagtagttggattgctggatcatatggtagaccagagatgatagtgggctcacatagctgtttgccttattacattatttatattatgcatactatttatacatatattcacttgtatgctaaattttataatttggaaagtcttttgcattaattcctttagagcagggattttatactgttttcttgattgaaacaaaatgtgctcagtggccaggcgcagtggctcaggcctgtaatcccagcactttgggaggccaaggtgggtggatcacttgaggtcaggagttcaggaccagcctgacatggtgaaaccatgtctctactaaaaatacaaaattagccagctgtggtgatgcacgcctataatccccgctacttgggaggctgaggtgggagaatcacttgaacccaggaggcggaggttgcagtgagccgagatcccgtcattgcactccagcctaggaaacaagagtgaaactccatcacaaaaaaaaaagaggggctcagtaagtattactaaattaaaatttgaaaatcctaaaaaaaacccacaaaaccctgaggggtgattatgtgtaataatacttactatgagtaactactacaaacatgtgactatcttctaagctccaacagcccttaagttctttaaaatagtttttctatttcttagtataaaccaactagtaatgtatgattttcctataaaggagcacatgtagtaaatagcctaggctttatgaactacatagtttccagtgcagctgactcttgatgtagggcatgtggtatgtaaataaatgtacttggctacattccaataacatttatatggacactaacatttgaattgtatataattttcacatgtcactaaacattattcttcttttgatttctttccaaccatttagaaaagtaaaaaccattcttagctcacaggttatagaaaagcaggtggcagcaagccagatttcagccacaaactgtggtttttcagattcctggtataaattatcaggagcttggagccttgatctgtgtgtcattgatttgctctcattctatttttggacacctttattcgttagagttctctttcttttgtgaaactgaagcacgtcctcatgtaacttctacctgtggattctacattgtgccgtctgaagaagaatagcacaaaataccccccacccaccaccttgtcatagcacaggccttcacagggtcgaagaaagcccctctggccctcttggttttctctgctacccagtgttaaactttgtccagatgcttatgtttcctggctgctctcctatttttgctttttaattttctgactattcttcataaaatgaacacaaactaaacaaaagctttaagctactgtccagctaatggacaattcaatctaatttttgtttccaaagatcgttgtatcaagcaacaatgaagtgccattgttggggatatgcattcttgatttattttgctgttttttttttttaataccatgtactccattataaagataacttatttgtaaatgttcagataatcctatcattattttccatgactattagtggtcagttcgtacttataactacacatgcacagttattatttagtacttaatttctataaactatacttaccaaatgtgtttattgagagaaaacaagctatacagaaaaataaagattttaaaaacaaagacagactttagataaaagccataaattcattttcttgtctgagaataagatctagcaaagctaaccagaaaataaattactaagttaaagtagttcataattcactaagttaaaatagcacataatcataaaatgtgctcagtggctggatgcagtggctcacgcctgtaatcccagcactttgggaggccgaggtcatctaaatgactttttttcaatccatttctttccctaagtacacagcggtattaatactgcttctctacttgattgggttatattatgccttattcagttaggtggagtatagaaccacttatgatgatgttaaagagacatgagacgtcagtttgaattgtaagcagcactgtattttccaagagaaaaatacttttatttgtaaaatcgtgatttgttgattttggaaattgtgttcagctgggtaattttaagataaaaatgacttttatcttgtacttaccaggttctgggttgaatgatggacagtggcacgaggttcgcttcctagccaaggaaaattttgctattctcaccatcgatggagatgaagcatcagcagttcgaactaatagtccccttcaagttaaaactggcgagaagtacttttttggaggtaagaatgccattcctttttggttactaatccattgcaaaaaatgaggtttcaaaatgaagtttgattatgaagtatttatatttgactcaactgactcagtagatctcatgacaaaacaaactgtaattccactgagcaaaacaaaaaaagaaaaggaaaaattttatttctttctgatgaagatattaagatgatgtcaccatattcttctggcctaatttaaatcattgaagtataaaaaaggagattctaaattcatcctcataatcctcaaaagtcaggtccttggaatatttgctgttcacctagtgctttgtaactaattattcaaaccttagtgtcttcaaacaaacatttattatctcgcagtttctctggatcaggaattcagtagtaatttgctgagcgagtctttcatgaggttgacgtcaaactgttacttgtggctgcatcattggaagcctcgtctgcttccggtaggtctcacttacctggctgacagttggtgctggctgggatgcctcagttctctgtggcctctgattctgtaatacctttcttcttcaagtagcctctcccgggggtcactgggcagagaaatagagagggaaaaggaaagaaagagaggaggggaggggaaagccagtaagtcaggaagttctccagataaaaactatgagtattttttaaaatataatccaatttagcagtgatatcccatcactactattattttcaacctgtgggaagtgagtcactaaatcccgtccacagttaaaggaaggggatttcacaagggcatgattataaagagccattgattcctgggtgccattttaaaggtgcctaccacagtctaccttacagaagaagacatgttgtcacaaacatcttggttcttaagtaacgaaaagattagtaagaagaagattatcttaatgataaactctatgtgtgaaaaagtgttgtagcaaagacctgtcacattttctaattgaaaaaatgtgtcctgtcagaaaatgatctttttcataactaatacattatgaggacatattttattaaagtgctgggtactttgtttagatcaatacatcttttattagattattgtgtttcctgtcctaaatcacgcaatgtgagatgtaaaaaataaatcacatgcttagaaaaggcttttatttaagctttaaaatctgtatgttacatgtttgcctctgaaaatgtttctatttgtatttacatatctactttgtttaattaaatatatagttatatagctctctctctctctctctctgtgtgtgtgtgtgtgtgtgtgtgtgtgtgtgtgtgtgtgtgtgtgtgtgtgttctagtttttagagtaaggtgacatgagagcagccaccttgtttatctcataccctgctatattcctcaaggtcctagaaaaaatcctggaatgttgtagatgaacaataaatatttatgaaagacttagtaaattctacaaattaagcaagacgtcactttattatgaattgtctagagaggaaacagaggaggccctaggcaatttactgacttgccactgagtttgcagctagcaccttaagttttctgagtcctataccagggcatttctccccatctaattagtgacaagttagagacaaaaatcatgaactagggctctgcttctttaatcttccataatatttgttggaagttaagactacatgatttttaaaagactctcaataaatatttgatgagtagacgaaagtcaaacaagctgtcttatgagtgaatgaactggacatactgatgtgagaaaaaacaactcaatagccaaactggttaccgtccaaaaaaatattcaatatgattggcttatggccaacagttttcattgctatgatcacaaatagatcacagttgtcagtgggaaagctactgataatctctgctgatcccttgactggaatatttttggccatacatgagctccctgaatgcctaaggccagtttttatcgatttcaatctagaggggcgagcacatagctgtaaccacacattcatggcatagagtttataggatatgaggtctttatggtgtgctatttacatcagtttacagattctggtttttgagcccaggagtcaggagaatattgatttcctcttgggtctatggtctgcctttaggatatactgtcagctaatgatcacgatgcttgttttgttatatcgtcattagctgaatcctaagtgtgtaagaatcatgagaagaactcattgccattctggctctcaggccccacctctggaactttgaaattcaagagaatgagaaattgaatacttaaaaacttcaagtgattctgataaacacagtctgagaaacagaattatagattgaccttagccaatttgcacacatgccttttagattctttttgtaaaacatcgtcagtcactgaaaagtttgggatgcatgagaattagctactctcctatagctttgcccccagagggcaaaagaagggaagtcacaggacaagttatgatgcccataaacatatttattaaatgaacaattattaccaagaaagcacagcactgttcataaacattcttctgcaagctcagtgaggtcccagctctctaacttgctgcaccttgaatcaaatgttctcccgaagcagcgacgctgaatggtgggattcagctacacccagagctggtgccaggtgacagaaagcctcctcagcgaatgactggcacaggatcactaagtgatgctaactccagaagcatttctaagaactcaggttacaggcctcgccagaatcttttaccatcttcacacaaggctgggtgtgtctctaaaaggtgttgtggcaaaccacagacccttaatgcctttaagttcactactgatatctcctttctaacatttctttaacatttatgctatctaacagaccactgatttcaccaaagaaaacccagtttggcattcagttcattagaggacttgttgattcagtgaattaagttgatatgggaataaatagtaaaaatctaagagtcaccccctctggtgtgggtgtaccgtttctgcactaaaactcttgacacctcttacttgtggattcctgatcagaagaggaactgcctctggatcgcaactttaactaaaacacaaatgcacacaactctataccatctgtgctgaaaattttaaagtaggattcaaatgttaaaataaacacatcttaagaaatactagtatagtggaaaggagaattgactttgttctaaaacacgagctttggaatcctgcatacctgattttgaatatggctttatcacttaattagtggatcctttaatactgtatcttactttcttcatctattaaatggcaatagaatctgttttctgaacactgtgtggcataaacttaaacctgggatctgaccctaggaaatgctaaatgctgactgactttccaatgcatcttgagcctttcttttaactctgtaagagacagcctcacaaggaacactggagacttcagaccattatttatttaatggcctctcatcaacttctgcaccactcaaagtatttcttccccacactcactgaagaaaagtatttttcctgctcactgaaagcctcaagtaaaggctttcctgccgtcctacactctgttttgtttccaaacccttaaatacgtccacattttgtttcttttgaagttaagtcccggttgtgtagctttctttgcagcccaggctgggccgtttcactccagtgtgcaattttatctctctgtgcttgctccctgctaatgccggcaaagtcttagtcctcctttgtaacatccatgatcagatgatgtttaatcaccaagaattcttttaattttttttttcttggggataagcagacaaagagatccgttatttggcatgtttcttcagtaaagtgtgttttagctgctttaacatgttttattttcctccaactagaatttttttagataacactccattaatgttaataatcaaaagaatgttaaacacaataattaaatttacctattgactgtttacgtggtaataagctttctgatacaggccggaatccatggctatgagacagcagtatgatttttaaatttctaaattttctttgttgtggtcatttttatttcctcttttgttatcattaaaagaaaaaggagctgtgggctgaagaggagagataagaagcttctagagccagtcttactggaagaggagttctaaagaactcaatggggaagcaggcaggtcttaggaaggtaccaaagcaagtggtgaaggcaagagaaaaagaaagcagtggagctggcctgagtttgataggataggatttgtgttaatgaagtttaataagagggcacatctctttccagctcaccagtacataactgtgttggtcagttttggctgctataagagaatactataggttgagtggtctaaacaacataaatatgtttttcatggttcttgaggttgggaagtctaagaccaaggtatcaaaatgcgggcagattccacgtctgctgagggcacataatgagaagctgcagacaaccattttgttattgtatgttctcatcgaagaaaaatagagacagagagagaaagacagagagcacacactcttaagtctcttcttatgagtgcaccagtcccatcataggggctccaccctcatgacctaattagcccccaaaggccccactcctaataccacccacaggggctcggggtttcaatatgtgaattttgagggacacaaacatatagtctataataatggcctctcaatcctcattgaaatagaccatggattttaaatattaggttgtgcaaaaccagttggggtttttgctattgaaagtaaaggcaaaaacgagctaaccagataggtatgtaaatatagatttttatcaagtagttatgttttaaaataattaggggatgtggttatcaggctccttagctatttattataggaaaataccaacactccttcaagcatttggctgcctgaaaatttcttagtgatggaatacactccatgaaaagcctcccagatagtttcccagaaatccttggtttggctcatccatcaaagaatacgaacttgcagcatcccattcagaatccacttgtcagcactgtgaagtatcagctgccttgcttttgtaccaacaggaaatctattgtttagaagtttgttttctagctctttttcattgttctcccaaaaagaaaaataatggaatgagacacattttatcaaatgatataagttagacaatgtgtcatttcaggagtgtgcaaattgaatcctaaacaaactttttgaaggtacgtattgattttctagggatgccgtatcaaagtaccacaaacacggtggcttaaaacaacatagttctattctgtcaatgttctggaggctggaagtctaaaatggaggttcaacaggatcctgaggtgtctgaaggccccaggggaggatccttcaactcctctggcttctggtggttaccagtaatcctcgttattctctggcttatagatacctccctccagtctctgcctccatcttcacatagtctcctcccctttgtgtttccgcatctgaatttccttcctctgataaggacaccactcatgggattaggtatcatcctaatcattatcacctcatcttaacctgattgtatctgtaagaaccctatttcccaataaggccacattcataggtttcacagttaggacttcagtgtatctttttggaggatacaatttagcacatagtaaggtataaatgctttattttacaaccccctctaatgaaaaattagcagacttcctaaaggagattcatacttctaattttatattatctattctcaaagatggctcttatgaagttaaaagtcaaacacatactttgagaaatgtggataactaaaagttagaggcattcaaacaaacaaaaacaaaaagtatcgtgcatagtggataaaaatgtgctggtcataagaatttgatggtcaaatttctgaatgtgattttgtaacctctgcgtaggaccacgtatagaattgcaaggaaaccaattttaaaattctccaagggaatttcatgtccatatgcataagagagagaacttatctctgataaatattggaaagctttgtgtaaaaaaacaaagtgtaaatgataagaaaatgtatcattggtttgaaagcacattctacgtggaactaaccgaatgttgtatcgttacatttgggtccttacacatgtaatgtagagagaagagaacacccagctaagacttggggttagcaaccctcggagcaggattatacttagggacaaggggaaagaatctggcttcattgctttggttgacccgaaaaattttcaggaacaaaggaatttgtaacttgaccttgatatgcagcaccatgggaacctcccactaccaaataaatgaaatcattaaagactttacttgtagatagtaataatactggaaataaaacaaccacacacacacaaagagtgcaattaaaagaagaaaaaaatcttaaatttgctttcatttttccttagaatgtagttccctttccaaaattacatgtatttaagaataaattaagtcatctttttgtcatactgtacttgtcttggaattttgtacgatgggcatctactaaacagtgaagcataagcttaaaaccatagaaatattacaaagtgttcccagagagttgtttacgctaaaacaacatgaaaagttgaagagaacaccactggcaccccatcgatatacattaaatcccttagcagcagtaagaaatgtcctcacatttaacatataaatgctgggcaagtcagctgtcttatatctaaaatcttctcataagaaatgccttcaggccaggcatggtggctcaagcctgtaatcccagcactttgggaggccgaggcgggcagatcacctgaggtcaggccccagcctggccaatatgatgaaaccctatctctactaaaaaaaaccacaaaaattagccaggcatggtggcacacgtgcctgtagtcccagctacttgggaggctgaggcatgagaattgcttgaacccaggaggcagaggttgcagtgagacaggatcacaccactgcactccagcctgggtgacagagcaaaactccataccccacctgcccccccaaaaaaggaaatgccatcaattaaatatggttatttccttcaaaatataagtccttaaactcaaactgtaattagattaatgtttgatttttctctacactggctgaaatagtaaatctttttatcttttttctaggcctgcttttgcaaatgtttttgaattcgctttgatgttttcattcatactgtctgttatagaactaaggcctacattcattcatttatatccaaagagattatgggcaactaacaagtagtagagcttggattaataaatattttctgaaaacctggcattattgttcatgttgaggtagtgaacaaatcaggggaaaaagtgcttgctcttggaagattacattctaggccagatagtaaaccaataacattggttaaatgagtgtatttgggggaaaattaatcagggaggggacaggaagttcttgggaggggattgaggattatctttaaatggccagagaaacctttgattaagaagatagcatttgagcaaacccctcaaaggagtgagaacacacacaccatgagaagatgggagagaagaacactcttggtagaggggaaagcaagtggaacccgatatccagctggtgtgtgcagggagcgattaggaaagggagtcagtgtggctgagaaaaggtgaggttggattgtgaagggtctttaacaatgactgagaaggttggaccgagtgaatctagtttattttaaaacagtctctcaggctgctgttttggtaaaaggctgtagttggatgagggagaacagtggcaactattgcagtaatccagatgaaagaaaatcgactagattgtagcagtggagccagtaggtaatgatcaattctgcatacacatttggaggtccagccagcaggacttgcagacaggtgagatatggggtgtgaaagccaaagggtcaaggatgacaccggtcttcctgacgaaaaggctcatacctcccctttccactgttttacactttctccttcccctttcacaatttgaggtccacttcactgtgtttccctgaaaatgacttttgacctatacatcctaaaactaaggaatttgttctgtatgtggtcatagttccaccaaaattaacggaaccatggacagctccctcccaaacaaaattcccagcgtcctgtctcttctagtttcttttgatgggttctcagtcagttccgaaattcctcagatcaagtcttggctgaatgctctttctgctgcatctagggtcaagaatctactcatctaaaacctgctatggtaaattaaaattccaatcagtctctaatttggggaccttgccatttagaaataagcaaatggagaaccctgacttaaagctaagaagctgttatactaaaaatagcctttaaaaatattgattcacaaataacctcctcaagcatatacttccaccttgaaaataccacctaactgtaatcttttccttttggcctttgttccatcagtgttccaacaatactactggggttggaggggggtagaaagtaaactatttatcgcctcttaaaatctaaactggaaattagctctcatccacatttacatagtgctgaatatccttcattaatgctaaagtacttggttaccctatctcacttttgtgtaatatgcctctctttgaaatgctaatttagtattaaaagcaaaagccaactttttctaaccaaatgactaacaatttattaaattttagagtgagatgaggaaatcacaacttagaaccttagcaatttctgtaagttgttaatggttaatttaatttggcttggctaatattatataattggaaattatttttatttactgcttccaaaccttttagttaacattttgttttatatttttcttagtatttttaatattttccctctggtccattattattatgtgattattttttccacttttttcgtagaggagtttgtcctcccctaattgtagtgagtcacctagaaactctgtgtcaattaacattttaagcagtacctgattatgcaaaaacaactccttgtccttgaaaatattcaaatcaatatttgctattttatgcaatgttcctcattttaaaaaacactttttttaacttttatttttggttcaggggtacatgtatagggttttctatataggtaaattatgtctcatgggggtttgatgtacagattatttcatcacccaggtgtaataagcatagtaccatataagtagtagcttttaatacaaaaaaatttttaagccatcactttctattatgagaatatcaatgagaaaaaaattttcaatctaattcccaaagaactttcaggctttttttatttgtttaccaattatatgcataaaagaaaagagcacaaaaaaaggaattacacattgaaattgaacatattaacctcatcagaaactgtttttccacttggagattggaaagtatttattatgtagcccaagattcccaagacttttttttatagctcccacaagtaaaatttgattagagctatgttttaaactaattatcattacaattattgtgatattctacatgcctttgcctttttctggctcttacaactggcttgcattggaaatactcagatttaaggaatgattacaagaagttttcaaagaaaaatatcataaaatttcaaaaactctttgactttcaagaattggcttaaccctgcggccatttaccattgacatgttctgctttcttttttcttgatactgattttgctcttttaaaatgattagcctaaaagaacatcaagatctgactgtgaaaataatacggataacactaaagataagtaaattaaatattattttgtatgtgaattttttagcaaatatcttctatatctaaaatgctcttaagtagagaaactactggccaaatttttaaaactgtaatgccttgtatatctggtgcaaatatgtgataggtgtcaagtgattacttgggaagcataaataagtctacagtttatcctatgaagttgattttattgtgctttaacaaaaagaaaaagaaatctttaatgtatccttcatgtttcatgaataatcagtgttaaaaaaaattcaaagagacatgttaaaagcatagtaaggaaggctttattcagaaccattgcaatagatacagggaccactgcaatataattttgcagcgaggaagagagattgggctcaactccaagtataggaaggacaagcgggaatttatagcaaaaagcagggttgggtcagtggatagaaaattactacaaagaaacaatccaggagtataggggtttctaaccaaagccacctaaccagaattcttgccaaaaacaggctagagtgatcagacatcatctgtggggtggtgcaggaggaacgtggtcaggtatcaaggatgatgagatactgagaacgatcagctctcaagggcggggagttctggctaaactgacttcgcagggttcttttgctaaaactggattttacaagagagtaaacagatgggcctaggagaaagttcagagcctgattaaaatttggtaaagaaaagaatcttcatcatgggttagttcaggtactctaagaagcagaggttaagacagaatcagacaatcaaaagatttattgggcaagtacttctaaaggaaaaagaggttaaagaggagctctgacattcaagaatggtgaaagggaaggatgagtgagtgggtagggccccagatggttgcacagctgaggcagtattggccagtctctagcaaaaattgtctgttagaatcctgtgtcagaaagaaatggcctggctctcttactcctgctgtgttcagactgagggcagtccaggcagcgtggcctcagctggtaagcatctgtggaccctatttagagcagccaactctgacctcaggtaggaagggaaatgtcaccagggcccttccttagtagccacaagtcatttggtaatgacacaaaaatgcaatacataaaggtagttacaggaagttattttaaagcacttcttgacaaaccagaaagaagtttgtgtttttttttccccaacaaagttgatatttttgtttgcatatctaatactctatgacagaacaagtaggtagaggagatgaatttagcatacttacttttttgaactgctggaaattcaagtaatattcttatatgtacagaaacaaacagaatgggatcccgtgcctataactgtgatggtctgttattgcttattttgtctgcttgcctgttttgtttctcctttaggcaatcaattatttgtatgtaaatttaattattaaatttattattatttacatgtctctcttttaactaaaaagttaagttctttctggttctgtggcttgttttccattgttgagtttttaaaaagatcagattttaaaataagttagtttttctagtttggtttactcacgtagtaattaaatagagcttttgctgaactcacccctccttttatttttaatttctctttctactttgggttccctttgtccatcccagcaaccagatgtttctcaagtaatgaaaaatattttctactcctcctgggaattttattttattttattttttattattattatacttcaagttttagggtacatgtgcacaatgtgcacgttagttacatatgtatacatgtgccatgctggtgtgctgcacccattaactcgtcatttagcattaggtatatctcctaatgctaaccgtcccccctcccccgaccccacaacagtccccagagtgtgatattccccttcctgtgtccatgtgttctcattgttcaattcccacctatgagtgagaacgtgtggtgttcagttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtatttgtgtctttataacagcatgatttatagtcctttgggtatctacccagtaataggatggctgggtcaaattgtatttctagttctagatccctgaggaatcgccacactgacttccacaatggttgaactagtttacagtcccaccaacagtgtaaaagtgtttctatttctccacatcctctccagcacctgttgtttcctgagtttttaatgatcgccattctaactggtgtgagatggtatctcattgtggttttgatttgcatttctctgatagccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggattttagccctttgtcagatgagcaggttgcaaaacttttctcccactttgtaggttcccatcccactctgctggtagtttcttttgctgtgcagaagctctttagtttaattagatcccatttatcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtgtaaggtgtaaggaagggatccagtttcagctttctacatatggctagccagttttcccagcaccatttattaaatagggaatcctttccccattgcttgtttttctcaggtttgtcaaagatcagatagttgtagatatgcagcgttatttctgagggctctgttctgttccattgatctatatctctgttttggtaccattaccatgctgttttggttactgtagccttgtagtatagcttgaagtcaggtagcgtgatgcctccagctttgttcttttggcttaggactgacttggcgatgcgggctcttttttggttccatatgaactttaaagtagttttttcccattctgtgaagaaagtcattggtagcttgatggggatggcattgaatctataaattaccttgggcagtatggccattttcacgatattgattcttcctacccatgagtatggaatgttcttccatttgtttgtatcctcttttatttcattgagcaggggtttgtagttctccttgaagaggtccttcacgtcccttgtaagttggattcctaagtattttattctgtttgaagcaattgtgaatgggagttcactcatgatttgactctctgtttgtctgttattggtgtataagaatgcatgtgatttttgtacattgattttgtatcctgaaactttgctgagataagaaattttgtaagactttttggctttcaagaccctaaaaatggttgaatatctaatgggaaaatttgaagtgtttttggggaaatttgaagtgtttttaggtataatgtgtgggattgagggtccgggaatttaggccaaagactttcctagtaacatataattcagcctacttcaaaagttagccttaaacttacattgtctttaatacttttccaatcaaaaaaatccccaagcctctctgacatctagatctttctatctcattcactgaagttaaatacaattagtgccaaagttactatggcatcattcctctgtagaacttaatctataataaccagtaagttcactacctcacaattgggaagagagaccttctctgtttttagacacccttattagatcagtatgcaaatataaaatttgagtaaagatattctctgccagcattggactatatggtattatttccaggagaagctacatgcttcaaaaagtcagcaataaaaaaaaaaatcctttaatatctttggaacttttcctattatctatgggctattgaacaaagagatggactcaaggattccatatgtatacatgattttaggtttaatatttaaaataaaagaatatttgaagggcagaaaatacatgtaaagggggaattgcccctagtaaatatatagtcaatgttatatgtagaaaaaaatgttggaagatcaaaagaaggaaaaaattcaattgggctttagggtggaaatgcaagctatcaggctgaatgaagcagacgggtaataaccactatgtaaaagcttagaagaaatagaaatagttctactatttgctagcctagtgcaaaagttgattcgaagagcagtgggcagagattttgtgtgtttgctaagataatacatgtttcataccaggctttcacactttaatgtccttaagaaccttctagggtactttacaaaaaaaaaaaaaaaaaagtctttggctgccttcttagtaaaattctgattcagtaggtatgaggttgggcccagaaatatgcattttaaacagattttctttttttcttatcattttattggccaagaaatcatatgctataaaattcaccatttaaagtgaataacttggtgtgatactccgaatattcacagagtcttgtaactatcaccacaatctaattttcggccattttcatgaccccaaatagaaccccaaaactattagaaatcactctgaattcttccacaaaaccccaaatcgtaggcaaccacggcaaccacgaatctactacttcctgtctctatggatttgtttattctggactttttttttttttttttttttgagacagagtcttgctctgtcccccaggctggagtgcagtggcatgatctcggctcactgcaagctccgcctcccgggttcacgccattctcctgcctcagcctcctgagtagctgggactacaggagcccgccacacgcccggctaattttttgtatttttagtagagatggcgtttaactgtgtcagccatgatggtctcgatctcctgacctctgatccacccgcctcagcctcccaaagtgctgggattacaggcgtgagccaccacacctggccttattctggacattttatataaattgaattgcttaaaaaattatcttttatgactggcttctttcatttagcatgttttcaacctttattcaactgtagtttattcaattcatgtaacagtactttatccctatttattgccaaatatttttacatatatgtatatacatatatgtgtgtatatatatgtgtgtatacatatatatgagacacttattcattcacaagtgatggagttttgggtctttccaccttttggctattatatataatgctgatatgaacattaatttacctatttttgattgcacatatgtttttctttctcttgggtatatacctaggagtggaattgctgtgtcatatgataagtctatgtttattgttttgaaaaattactaaattacttcctgggtgatctcaatgcttgtcattctctctccatactttgagaaacactaatgtaggcaaagatttggggataaaaatgtaggaaaaaaacaaatgtctgttattatcagacatttgttgcactctgataataaaaaccttagatttcatgaaatggagaggaggattagaagagaggcaaagaaagcatcagaaaaataagacactggataatgatgtgaggttagcatcatcaagggacaagttagaaatccacattttaaaaaattaaaacaaaattatagctaagtgattaagtagtataagaaagtttataatgtgtgtttattaaaaggagtgttaagattttatttatgtggagatgatacaataaggttagccctcaatcacttattaaaatcaatttattaagatttaaatacatatagtaaaatttagttacacgaattttgattcatatacttttgaaagaatataaataatggtaacggatcccattgtatgattacagaataaagtagttatatacaagaatgtttattgcaacaacatagtcatcaataactagaaaatgcctaaatgagcaacagcagaaagatgctaaaagatactgtggcaagtctataaaatggagtattatgcagccacccaaagtcgtgattttgaataatattaaatggtatacaaaaaggttaatgacatagtcttattgcaatggggataaaatattttaatacaatacaaatttataattgcattctcctagacctgtctaatattttccatatcagtgaatgtgccattgccctccatccaggataaagaatgactttagtcttagttttatcttaatgcaacaaatccagtccttcacccaatcctatttaagtatttatttattatccataactattcatctcataaatgattttataatccatctgcctctcagctgtttcactgccactgtgataaaccagactaccatattctctctgcaggactgcttaacagttccctgatttatccactgacggtttcagtccattctagttagtcctctttcaatctatcttccactgactttgtcttgccaatttcccctaccctttccaccctcactgacttcctgtttctcttgtgattgcaatacttatttatttgtttagcaatgcaaatttataacctgaattacaaggaccttgcatcgtatggttcctttctgtgttacacacatcattcatcctcacccagccttctgcttctgtgcaccagcatcatgttggccttccttgagctaatagagtgttatgctgcctttgtcacagggatcctacacattctactatttcctctgtctggaatgttcttcagcctaagatgactacttctttctcaaatctcactttaatcaacacttcttcagggaagccttccctttgtctcagcccctggctaaggtcaggttctttagttttgagtatatataatagattataaagatatatgaattagggagattatttgtttaatgtctgcctacctcactgtcgcttaaacttcaaaaaaaggatatatatatatatatgtgtgtgtgtgtgtgtgtgtgtatatgtatatatatgtgtgtgtgtgtgtgcgtgtatatatgtatctcttttttttccttggcttctcttttcctggttttcccttctcttaactttctgctttctacggtttgtctctttcttcttacctagttttgtacccacccattcctcactgtaaaagaaagtaaaacagaattttagcaatactatctctgattcgaagaatgaataattttaatgttctcctttcttttttcgttaaaattttctacagtagccatttgtaggtataaaaccaacatgacaagcacttttatagtactaaaaaataataagtgaaaactacttgaatatatttccatataaaaatgtaaagttcgctgggcgttgtggctcacacctataatcccagcactttgagaagctgaggtaggagaatcacttgagcccaggagttcatgaccagcctgagcaatgtggtgaaaccccatctttgcaaaaaatacaaaaattagctgggcatgggtacgcgcacctgaagtcccagctacttgggaggctgaggcaggagggtctcttgagccttggagtgcagtgatccaagatcgtgccactgcactccagcctggagaacagagcaaccctcttttgtttgtttgtttgtttttttaaagacaaaaattataagacaaaaatttaaagacactgttatactatgcagccataagaaagaatgagctcatgtcctttgcagggacacagatgaagctggaaaacacaggaacagaaaaccaacaccacatgttctcactcataagtgggagttgaacaataagaacacatggacacagggaggggaacatcacacactggggcctatcgggaggtggggggcaaggggagggagagcaataggacaaatacctaaagcatgtggggcttaaaacctagatggcgggttgattggtgcagcaaaccaccatggcacatgtacagctatgtaataaacctgcacgttctgcacatgtatcccagaacttaaagtaaaattaaaaatatatacgtatatatttaaattttcaaaacaggagaaaaatgtttactttagaaaagcatgtctttaattttttctaattttacatagacaagagtttcatgtggtaggaaacaaactagataagataaagggaggtgaaatttgtcaggattatttttaaaaatataagtggataaaagtaatcttctgacatagcacttgtgtttaaatgtacatttgttacttacagttactaataatttattcatgtaacaaaaattgttgaggtttcttcttttttgtcattggtgagtggattttactttccagtatagaatgtccataaacgcaatgtgtccagtaagtttaattttaaaaggctttatattgcatcaataatttcagaattctttaccatacttcttaattctttaaaaacattaagtatatatacatttttattagggaagttaatctcttgtgttatgtcaaagtatataatggtaaatatcaactaaatacattgtttcttttatttttcctttgcacttatatataagtaatgttattttgttttaagacaacagtctcactctgttgcccaggctggagtgcagtggcatgatctcagctcactgcaacctctgcctcccaggttcaagtgatcctcccacctcagcctccctagtagctgggactataggcgtgcaccaccatgcccagttaatttttgtaattttagtagagatgaggtttcaccatgtcggccaggcttgtttagaactcctgagcttaggtaatttgcccacctcggcctcccaaattgctgggattacaggcatgagccgtgacacccagaaatgagtaatgttaaatataggatttctatattgaaaatattatagatataataatattaacttttaagatagagggaaaaaatccaaattattaggatagtcttcagctatataattatagaaatccaacttagtaacgatttaaactggatgaaggggctggtatggcattttgtggtttcacgaagtatgaattctatttcaagcatcagcaaactcttttatatagggtcatatagtaaatattttaagctttttgggccatgtgttctttctcacaactactcaactttgctttgtagcagagaaacagccataggcaatacaaaaataaatgggtatgtttgtattccagtaaaacatttacaaaaacaagtggtggattgcatctagcatgcaacctctaatttaacaagttctaatctatctagattttccaccatctttagtacattgtttctcactcttggtcaagatgtcttccatccccattccatacagcaggaagaaagaagtgaaaagagtcatggagcccctttctttaaggacacttcctgaaagatgctgaagatatttctacacatatcctgtcagccagagcttagtcctgtggctacaactagttgcaaagcaagctgggaaataaaattcttccagacattcatgaatccagtgccccctcccctcaaataaaaggtgcagggagattttttactgaaaagatcatgaaaacagattgtagggaaaactgacagtatgtaccaatattagtacacagaaatacctatattaaccctttttccaatacataggacatttttatgttccttcaagtgagaccttcccaaaatctcataagttattgcatccatctcaaatccatctctgatgatgtacagaactctacgtcaggtcaaggtttcatttcttgtggtagagtagtatataaattaaaaacctgtttactgtgaaatacactcctcttatgaaaataaaagcatgagagacacatagccattgctggtccatagcaattttaaaatcttgctaggcaggaatagcaaagaggctatttttccagtgccttttgtgacccaaagtttcactctcgcagaggtccctatgagaagccatatcgtgatcctatctgagaagggcattctgctttttcctgtctagtgggctgcatgctttcataactgacctcctgctgatacaaattagtgattaaggactgctgaagtcattgaaagggcacaaaactttgcaggccatgcttatggtttccttggcaatgtaagtttctcaaaaatgttatagtcttctaatctattttctttcaggcagttctatgtgcaaataaccacacctaaacatctgttcttgacatagtttaaaacctgttgactattctttttcatacttacctctgtgttctgccaattcccagtggaggtgagccctctaatctgccttcaagagaacttgcacctccctccttttcttctctctgcctttcagctaatgtcaaactaccttgaggtcctgaaaaagaataaacctttagtggacgatgatatcctcaatctgatcactgcaacagtgctgtgccccagtgtctggtagataacccttacctgaaggttatgaaagacatcctggggccacaggcttacttccttctaaagctgcctcttggcagctgtggtttagacttacaccataatgcagtttaggatacagagttattttttatttttttcatttttatttttttaaccctttcaagcttctgaattagggattttccatcattttagactgtcaacataagaagaaagcaccttctacttcacagtagctttactctcatctcagcctttaggctggtgagttctagactaacttcatctctctcctggagactttgctaaacacagcaagaaggagccagtgccagtgcgcaagagcacttgagtctttccaagcatttctcttaacatggaaagtctcagttggcacctaatttgccttccaaagacagcagttgacaatataaccaaatatttagctacggtataacaaagatctcagctttccacagctagagtatcccagtcttcaaggcctggtgtccaccacaggcaattccatatgctttttaggctttgtcacacatagcaccctatttttatgtatagtacaaactatggtatgagtttggattaggttcagcttgagtaacagagactgaaattaacaagatgaagatttcttcctttgttatatgagagaatatagaattagactgttcaaggctaatgcagtgttccatggagtcaggaagctaggctttttccatatttctgctttatatttagtacaagcaaatatcccaaatggcaatttgagtgccagatattacatccaagttctagataggaggaaaaaagcatcaaaagatatggggtgattctcacccttcaaggccactcccctgaaatctcatacaatgtttacgcatgtatcacctcattggctggaacatattaatgtggccacatatagttgcaagggatattggataaccaaatatccaggtaaagatctaagtctatgcaaggggggaaagtaattattgaaggctaattagcatctttgtaatactcctatatttgatattaaacagtttatattatctgtgaatttgattatagtttgtgtgctcaattgtatttaataaagtggcattcaatatttattccctccgtgagcaaatcttgaaaatttgtatacggctgtttaacctaaggatatttttgcatcagtgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggattagtcttgggagggtgtatgtgtccaggaatgtatccatttcttctagattttctagtttatttgcgtagaggtgtttgtagtattctctgacggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctgtatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccgactatgtggtcaattttggaataggtgtggtgtggtgctgaaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgtgagtttggaaaattcatttaaaggagttcatttctttttcaagttttcaattatccatcatcctagcctgaagctttttataacaaattatttagagtagtaaaattagttttttaagcaatagaatattttttaattacgcatttatatctctgttattcccaatcatatttctgttctccacaaacagctttattcaataaatttcttgcctttaatttgagagaaaaatggaccatttcccaaaacattaggatctattaaaaataatgtggatggttatctaagagcttttttttctttagcttagaaagcaaaggattatacatttcttagtttccgtatggcagaactattaggaaaaaaaaaagaaataagatcatgaaggtatagtgtgtagaataggaaattaagaggccagagaaagtatctttggaattaggaagctgtctaagacattgatggcttgaaaagaagtaaggtgtattaggtgaacaactagatcacaaggttcaggagagcaggagctactcttgattttgtttatcccagtacactaaaatataacacagtgtctgatgcatgcaaagcactcattatacatcttttcaatgaattcataaggataattaaccatattttaaaaactattagaaatgtttatattattgtgtcctagaagacaacagtgtgcatgatttaagcatttttattttttgcaatcacgttattaaagaactctaagttgcatcatgccacatcagatatgtaatccattcagccttatgttttcatctctggctgtagcattaaagcttaatttatagaaaggtgtgttctttccctagatatcaacttaaaggttaaagacatactttagaacactttagtctttcctcaataaacatctccagtttttcctcataacaatttcatcaaatctttcttcaacttatttgtatattttaaatttatatggtcccttaaaaaatcacatgctgattttatttttactttttttttctagtttatcatttgtttttcaaagaaaaatatcttttaaactacttgtttaatgttaaacaatgagctgggggggcattttgtttttgtttttgttttaagtactctattaattttcattgccagtgaagacctaactggctaaacaaagatacacctcagcagtattcttgtttgaaacaacatatgtaccaactaggaaaaatgcattgttaaaattcactgcatgcctgtaggtaatggcagaagtgtggaaaggcagcctctgactttttaaaacatccatgtttcaaaataattttaggaaaataaatgtataggcctggcacagtggctcatgcctgtaatcccagcactttggaggctgagacaggtgaatcacttgaggtcaggagttcaagaccagcctggccaatatggtgaaactctgtactaaaaatacaaaaaattagctgggcatggtggcacacgcctgcaatcccagctactcaggaggctgaggcaggagaatcacttgaacccaggaggtggaggttgcagtgagccgagatcgcgccactacactccagtctgggatgggagacagggcaagactccatctcaacaacaacaacaacaacaaaaattagagtatttaaaactaactaaacacaacttatttatagtggtataatatatccatttaatgttttggaatgccatgtctgcctctgtgaaactagactgttgggtttaattatgcggttcttgcttttctgaagaggtgaaagaataaaatatcttggtgggaggaaagtcctagactgagggaaggcatggaaatagtttgctttatttacaaagaactgaaaatgaagcgtaactcctattattgctgtataattattgatttggcttttctttttagccagtcaaatgacagctaagattccctaaataatagtgggaaaaaatatgttagtcacagcttccatctatgtgttgaatacacagaatgtaatgttttcttattgtgattaaacacataaagcataaaagttaccattttaactatatttaagtgtacagtttggtgacattaggtacatttaccttgttatatgaccatcatcactattggtgtcttcaggacttttcgtcatcacaaatgaaaactgctcattaaaaactaactccctatttcttcctcctccagcctccagcctccactaaccagcattctattttcctttttttttgagacagagtcttgctctgtagccctggctggagtgcagtggcacaatctcggctcactgcaagctccacctcctgggttcatgccattctcctgcctcagcctccccagtagctgggacgacaagcgcacgccaccacacccggctaattgcttttgtatttttagtagagatggggtttcaccgtgttagccaggatggtctcgatctcctgacctggtgatccgcccgccttggcctcccaaagtgctgggattacaggcgttagccactgcgcctggacaccagcattctacttgctatctttatgaatttgaatattctaggtaccttatatgagtggaaacatataatgtttgttcttttgtgcctggcttatttcacatcacgtttctttaggatccatatatgttgcagcatatgtcagaattttgattcttttcatggttgaatcgtatttcattgtatgtgtctatcacatcttgtttattcattcatgcatcaatgaacatttgcggtgtttctgctgtttcactattgtgaatgtactaatgatatacaaatatttgtttgagcctctgcttccacttcttttagatatatacccaggagtggaattgctggattacatgttaattctattttaaattttagagggactgcttcactgtttccacagcaatgacacgattttacatcccactagcagtgtacaaaggttctgattgttccacatccttgccaacacttgttattttcaaggttttactttgttttgcttttgtggtaacagctcttctagtgggtgtgaaatggttttctttcacaaatgaggtgaaacgtatagaagtgaatgtttcctgtcctcacttacccttggcttttatacttagcccatttcacatttcacaatgagaccactagactataagttctttgagggtaggaagtatgtctgtcttatttaccagtgcttttcaacttctaatataatgggtacttaatacatgctgaatgggtacatgcataaatacaagaatgtatgacaaaagtaaatgaataaacaaacaaatgagtacatcttagaatccaatagaaagtattgctaatttttcttttgttggtcaggcaagctgaggaaatttctaagcatcataaaaccccaaagctgatatgaaggggcttgttaggtttttctacttaaaaagcatacatgcccacaacagaaatattcattggcttcttactagttctaggaactcttctgagcattttgctgaacttatctcactaatcctcatgatagccctagctgctggctctaccttatgatgtccattgaagagcctccagtgatgtgatttgctaagaatcctcagctcttaagagtccaagtggagattggaatctaggtgtgtctgactctagacactaatctcttttagccagcataatatattgttcaccagaatgcctgcatttcattggcattttcttaattactgaaaagtaattaagaaaaggttaaattgcaatcactgcttttgatattccacaaacatcttacgttaaaatttaatgaaatcaaatagatcagaataaaaaagcaaaatgtcagattagctacattttagaaacctctaaaatgtgggaaagctgttctgcattccttttgtagctgtctgaattttgcaattatgaatgtgcattattttttctcatgttgactttcctcatgttatttataagaacaagagacttacatatagttgagcactttaaaatatctgttctgagcttagtgggacttaagaaaagctctcttccttccacaagtttttccttattgtctccacaagaatacttgaaattctcatatcatgtggtcttttggggtaaggatttaaaagcaggagtgaaaatgcaaatgtcatcccaaagagttgatccattaagccgttatcagccaccaataccttagcaggaattagttgattagaaaccaaagaatctagagagaattaactgtgtaaaaaaaaaatcacatactctagtaggccagaataagctggcacttatacaaacaaaatctagagacaaatttttggaaaaaaaataaaaatagaggtaagttgggacaaaaataacgagcaagtgtcaggttggccgcgaatgacaggaaagaagcaaggtgggctacttcagtcatatttttcttccacatcttcccacaaagaaaatgagtttccaactggaaatgggagaacttggcaagtatcagaaaaaagaaactggaatccacgataaagagggagagagcctctaattgcctgtgaaaggagctctcagcaaaggatgtagatcagtgatacaaattttaacagttaaaaactaaatcatacattctgtgaattcaacaactaatatagctggaggttgtgaccagtacatttgtttgagtgtccaggtcatccagggtcaataaaagtacacagcttctccactactgtagtcacaatggacggttcctcagccacatgtgtgcaaggactgggacgactgaatcgactatttagagggccgaggccagaaactacaggcaagaataagccttccatctctggaaatattataaaattaattcttaaactgataatttatcagcacagtcattaatgaagcaaacgggttgcactaagaataattccagaactaatttcttttaatagaattggtagttggcaagatcaagaggctttcactgacaagtaaaaatcattggagaggaagcccccacccttatacatgcatataccatttgaaataactactataataaaccagcctgcaggcgggtgccatattactcagctctcttggtgcagcagtggttgggaactggagagacacagtaactttaccatgatttttcagcaaggtctttggcaaaatctgtagttgaaccttaaaactctagttaagttaactagcttttccttcagtatgcatttgtaacctcaaattaaatagacacagaccaagaggaaaggtgaaggaatctgctgcttttacaaagcgaaggcacctctcctcatctgtctctaccttgaaactgcaatgaaaaataagacagaaatgggatgagaaaacatgataggatttccagtgactgttgtctggtgattaagggattgagcacccccccacacacacacacacccacgcatatacacacacaggtatgtataccacattctctactaccaccatggataatagagtgaatctgagttcattgaggtgaaggtgggtgaaccatcttttataattcttacacattataaaaatgtataacattcttataagttatacattcttataatttatatatacagtattaaaattgatatacacagtattataatttataattatacattcttgtaatttatatatacattcttataatttataagaatgataaaagatccagttttttatagaataatggtagaagttgtctccaaggctgctttattttaagaagacttactgaatgttgtaagcagctagttggtgtatttgtaacataagatacgattgccagaatcctggcctcatggtgcaggtgtaagcatgtaagtgtgtaagcatctctgcccagggaggaaagtatggaggagggcagagggcatggctctccttcccactcatgaggccttctgacatatcttctccaaactctggaccctagtcttgatatatggttcttacttagtatatctcaattttttttttctttaggcactagttcagatcgccatttatagttcttaatttatgctttacatcttcctctactcttttgttaggtcctttgtcacggtgcacttatgacatagaaatggtcaaccaagaaaagtcttcaagaggcaaccctaagccattactatgattcccttcttatgtaatgtttttaatcagtgattcttctggcataataaatatatttggcctttggctctgactcctggcacagagcccctaagacccttggagcttcctgagtggcaggaatgtcttttattggtcacaaagagtttcttttgatcacatccaacttagggcgaaacccctagaaagcctcaaaatgaggctggtcaccagaaagaccaaatgatgagagggttggaatcttttaccccacctaccaacctcctagaagggaagcagggctggagattaggctctatgaaaattcctgaatgacaagagttgataagcttctgagttgatgaacacacagaggtgctaggttagtggcatccccagagaaggtatagaaactgtgtgcaactactcccccggtgcctcccatcatgccttttcctatgcatttcctccttttacctgttcctgaatgtgtccgttgtgataaaccactagatacaaataaagtaccatcttgagttccctgagatactctagcaaattattgaaccctaggagaggtttgtgagaacccaagatttaaagctggttggtctgaagcattgatgggttggacttatgattggcatctgaattatgattttggaactgagtccttcacctgaagggttttcactaactctgggtagttagtatccaaattgtattgaattgttggataaccagttggtgtgtagaaagttgtagagttgctttactcccaaacttataacatccttctttttgccatcctaattggtatgaacagttttactagttgtacaagtcagtgatcctgttcatcatccttggcttcaccctgaactcctcatcaggtaaaaacctgaacatttggtgtcagaaatgctgtgattagagggatcgttattttccctactctgattataacatcaaactacgcttatcaaatttacagatgacacaaacttggaaggaatatctaaggacattatggaaaggttaaaaaggatttgaagagaaatgaaactatctgtattcaagcttcctttctaccactaactagtgggactcagttttcttataaaagagtaatgtttggccctgggagttgagtaaactgctcatacaactagggactagtgagtgactgaagcataatcagagcctaggtatatttgccttagcttttaaccagaatatcagagtggtccaagcaggaaattatgcacctgaaataaggcaatggcagtgatcatggaaagggatgacacagaaaaagactcaaaggactttgaggtacaatgttccctggtaaaagctaaagagaagggcctgaagaattcaggttgaagccaaggatgataaccaggatcgctggcttggacgactagtagaacggttctatcacttagaatggcaaaaagaaggatgcaaacatttggaagtaaagataaattctattataaatgtcaaaaaggagatttcaacattccttatgtaaacaccttgtatataattgggtaaataggtctaaacttcagaagagataatttgggagcaccaatacagcattagccgtggcaacaatagtcaaaactgtacatatgaatgagagtgcacagaatgaggaaccagcagtaccaaccaagcagtgagggacagcagcattaaggagtggacagaggagacagagacacaaatgagacttagaaaaagcaggtagagggatcggcagagaagcacagggcacggagtctatagaagccaccagaggagagagagagggtcaagcagttgcagaatttggcaaaggaggatataaagactcatcgagattactagaagtgttctccttttggccactggccagaccttgttcacttcttgccccttgttcatctcattgcccatggaactaaccaatgatcagttctcaagacttttccaccagtatcctcactcaggagtgatctcaccagctgcttcagtatctcagaaagttcccctatggtcagctggctttactgttcacaacatgtttcaaaacatgagattgacatgttttaaaaaagctgttctcagctgccctctccttattaaggtataccatgacatggctttggcaatagttaatgcagaaatactaataagaaatgagaacattgttatttgcttcaaggtaaataagagttggcagagtaataaagctgctcaaatacaatgttcggatgatcttacctcacattaatgaagaagggccaagaacacgggaaataatagccgtattttcttctacactggttcaactatatgtactatgatgcgctctattctgggtaccaaacttcaagaaaaataattcatttgaagatacagaaaagagggcaaaacggaaaacattctataagtgtttttgtgtatttgtttttaatgatgaagttatccattatagcaacaagttggacacattttcagaaaggaaggctcctttctgctttcttcatcatttctaaaaatgcggatatttttacttaccactcagaaaatgcctgattaacacctggagaggttcagtactggcaatccaaactgtttagcagggcctcctgggaagagcagagaaaatagctgaaaaaaaagagaaaataattctaatacagtaattatcaggtcgagcatggtggctcatgcctgtaatcccagcactttgggagaccaagacaggataatcacaaactctgaagttcgagaccagcctgaccaacatggtgaaaccccgtctctactaatagtacaagaattagccggctgtggtagtgcacacctgtaatcccagctactcgggaggctgaggcaggggaatcacttgaacctgggaggcagaagctgtagtgagccgaaatcatgccactgcgctccatcctggatgacagaatgagactccacctcaaaaaataataatcatcataattatcaatgtgggttggtttctatttatttatataggtggatttttcataaacagatttggaaaacactggcttaaaaacatgcaattttcatgaagcagggcctcctgcacagtctttaatatacaagggatacattaaatgtgaatgtgcaagggacacagtttctcaaatttatttgaccctttttggactgtcttgaggccatagtgctccccagaacacacattgggaaactgatctaggaagtgaaaagagaagaaggaagtggtagcacaagccaagacagatggaacttgttgactgactgccacataaagttcctgttccagagaaaacagaaggcatagtgatgactacagagagaatactgataaaaggcaaaacttgatggtgagaactctcggcgttctgattcttatctaacacattcacatttttatatttatttccattgatccatggtaaggctaaatgaaaggcactttaggcataataagtaagcattaaaatcataaaatagacaaaaataaaataaaaacttagtatattgtcattgaatgctaacagctacagaatctgaatttgcttgagagctgcatacagaaaatgaatccttttaaacaactttctataataaaagaaccaaaccactattgaagatagtagtaaattttacttaaatttttgaaatatcatacttgttcactttggagagatgactaagtaaatataattgacctagaaataagtacattgggaagttttcatatttttaataatcctatatattttttcaaaacaattggttaatagatttatcctagttcttctttattacctacttagagacctctgtacaaatatgtgcttgttaatcacataaataatgccataagtaatggaaaatgctggtgatttttagcaaatagaaaatagtaaaaatacaggcagtcatggactagagtataggcataactgttaggcacaggtaacaatatttaggacccaagtcatcggtccagggatgtgtggctaagatggaagaggtaaaacagggcccttcacatcaaagcagacttggatccatgatgagacacaattgttttctgtatgccaaagccatgaaaatctttcaagggctcatgtgcttgaattccttgaactcagtttcctgctagaatctctgcatttttcagtcctactcccatcttgactgccatcccaaaggaagatgtgtctaactctggtcctctcaaagctaatgtcttaatccaacacttctattctcccctttggtacatcaatccatcttttgtagttattctatctgcctcctccttcctcttcaacttttaatgggctctgatttccttaacttcacaaatatgcaaataccaaataaaaccccaatcatcccttgactttgccttttcttcacaggaattgcttgtctctttcttcacttagtgggtgaaattattggaaaaataaccaataactgttgactgtagttcttcccttgccatttatttcttagggaagcattctggctcttattatcatctctaataacaacaataatggagtaacaggcacttataaccataaatgcattccatagaagatagaaattgttatacagttggccttttcttctgaaaaatctcagtgggtttggttatgttcttttggagacaagactagaagtgaactgatctgcacaatttggagatcaagaaggtaattctagaggaaaggaatagcagagcacggaagctgagaaggagccagtgagattgagagtagataaccctctctgcagtgtgactcccttactgtcacccctagctgtctagcaaatctaactgaataacatgcataccatgaataagcatgttcgtgtgtgaaaacgagggaagggctagtttttctctcccaggttagtgttggtaaacaaagatacatatagggatattctcattacatatgtctacctcccttactgtgggtcttatttaataaaagaatgtttcttcagcgtttgttatccaaacactcattttattttcacaataatctcacagagtaccacatgctattatccctattctgcagatgaggaaattgaagctcagagagtttaagtggcttgccaaggcctacagaaccagtaagtggcaggaattcatattaccttgtacttagtaggtattcagtttatattaaatttacctagtttgagaggcagcatgcattttagtgaattggattgtgagtatattcatcaactcttgttctatggtaggatactgtcttaaatctaatatacaagcaaggactcatgctgagttaatgcttctaatagaataacctagaaatttattattttactgtggtgctgtcagcactagaaaaactttatttggtttctgtttttctcatttttgctgcaaataaagagaatagcctcaggaaggtgatttgcctgtcatttgatctttatgaagaaattacacataattaacttatttcatttttagtaagctactaattaggtgcttcgttgagattgcaaaggtttaattttctggcttccagcatggaagtaaaaaagaatccactatcatagagaaaacaaaatcatcaggagttcttgagcccccaaagaaaataaatgattgaacaaaagaatagcaatgggaggctttaatctgagcatttaaagagaaacagagacggaggaaatcttgcgatcaaagccaccaaatgaaaagagaaataaattatttatttagcagagggtaacatttttcttcgtgatacttatttttcttagaaatcaaacccatcctctctattgtgtcataatattttagatttcacagcatggattactgtactcttttatttttaaatttagccttattattcccaacaggcaacttaacatttaatatctgaaggtcattgctgtacaaatgtgatgtgaaaaaaaataaaatttagcagctgtatcatattatactaatcagaaaggaaggaaataaagaacaaacagcagtgtaagatggctgcagtgtggatgagtgagatggactaagcaattaagtattttgttgcagagagaatctgactgtgtattgtttttctcaaattttcagcttgtattaggtagagtcaaagagaatatagaagtgttgagaattaggacaaaattcagtttatcttatatgaccttcatttgtggagtaaaaagaacatatttcagaagacagatatgctagctcttgaatactaggtgattttaatagtattatgataattttattagagattatttacaatcaagaacctgagaggtttgctgttgttgttgccattgttgtttttaggaatgttcacagaggtcacattttccaaccttagagttttgctgcttgatttcttttgtatttgtagcttacgtggaagcagcaccatgctcagcacaagaaaagcctttcaacaggagtttaagcacagctatatgcaagtgaaattaaacagaaaacaatcccaatagtcctattcttcataagaccttaagacacttggggtttggtttaatttattgaagtctctcactcttttagcatatgggtgataatagtcaagagaaattatttaccatcatctactgatgaaaatcgtaggtggaagagatcttggaatccttctaggattggtaagaacatgaaggtttggggagatgaaatcttgctaaaattatagaactagttagtggcagagatatgattagagtccaggacattaaatatctagttcagtcctctttccactgttcacctctgagtctctgctccctcaatgctaggacccaactattgattatctcttgatttttaaagtgtaagaccatggtactgtttttcatagccacctacaattctctagaactctatggaaaatttcactggcattttatgataccaaccatggaaattccctctcaattccaaagggacattggcagaattttataattaagggccatgtctagtgttatcagccaagttatgtcccccaccagcttaaatttttttaaccaaaatgtcctctatatactgcaggagatagggaagattatcaattagggaaatggtaagaaaatattaaaacttttatttttataaaatttaccaatatcatgcacccacatcagtccacttgcataagtcaagagtgataaaatatttacacaacaatttcagtgaagcaattttattactcacagataggtagcaaaagacaagggaaggttaggatgtatggtgagccagcccccactaaggcacaggaaaactgccaagggcagatgaagtctcatctgtgcatattctgtgttgcactgcagctgagggccccccaaagcacatactgccctgggttttatacccaggggcaatggaattgctgagctaaagcatttcaggacaccctgttctgggaacaatgggaacagagttccagcctgttccttcatgtcttcaatgttgcatttccaatgtattctacagttactctgagaactacaagtgagaaaggggccatatggggacctgtcctgcagtgctgtgtgtcttctaagttagggtatgcaatataaaaaaaagtttgaacaacaatatcttaaaaccccttttagaaagtcagctgtagtcatgaaaaggagtgattctaaggtctctacaaattgttatcacaaaataccacatagtctccatcacaactccttaggtctctgtaagttgtcatcacaaaacaacaaaaacaaatcctatttgaaccctctgccatttctaggatgagcttgctcattatctctgaagatttacatggagtattcaaagcctgcagggtggctccaattagtatccattttgagcattggaatagaagaaaaataactctagtcatcagtaaaatgtccttaaatagttgacccctgaccttactgataaaatttttaaatctgcatgtcaagagaactgaccttgaccttgacatttgatggggcactgcatctgagtggttagaatttgatttgtggttttatatttagtctggaaaagatgaataggctactgtgttagttagttctcacattgttataaggaaatacctgagactgggtaatttataaagaaaagaggtttaattgactcacagttctgcatggctggggaggcctcaggaaacttacaatcatggtggaagggcaactcttcacagagtggaaggagagagagaatgaatgccagcaggggaaatgccaggtgcttataaccatcagatctcatgagaactcactatcacgagaacagcatgggataaaccacctctatgattcagctaccttgaaattttaaaaacttgaaatttttagcctaagtatttcttttcctcatgtaaaaaattcacagaatcaaataaaattacagtgattgtcttaatcacctttgaagagcaagggcagtctacactgatttttttaaaccaaatatagaacataagaagaaagagtgctctttattttattgtgaagtaaatgccctggtgattgttaataagtcaaagagaagtggttttgtcacagaactgttagaatttaagtagtatattattaaagcctattagatcaccatactccttttcaaatttttaatagtaaggtttcaagtctaatttaaactgaaaacgttacagagaataactaaaacattttaggagacttttttccatactaattagcattttaaatcagcctttcagagtacaggaaaaaaaactccataaaattttatttttattaagtgaaaactaaatattctgccaacacaaatatttgctaatatgtatacacatgtgtatgtagatatataaaaagtttggaaggacaggggccaaacagaaaatgggggtcttgaagagggctgggggtagggggagctcatatttatcatgcttctgtattatttgaatactttttcatgtaccatttacttaattaaaaattaataaaatcatcttaaggtacttgtatctgtattttaaatatatttattcaaatgtattttaaatgctgccttacaagaaatacaaacagcttcatataaacaattctatcatcattgaaatgtctactttgacaaattttgaattcacattcattgtttttaaataagttatattatttgttatttataaacaataactattgctattgctgtggtttggatgtgatttgcttccaaaaaaaatgatattaaaatttaatcccctatacatcagtgttgtgaggtggggcatagtggaagatttttggatccatgggggcagttttctcatgactaggtcaccctcctgtgggggtgtgtggattctgttttgcaggaatggattagttcccataacagtaggtcattataaagaatatgacttcttctttcattatgtgaactctttgtgtatgtcagctcctcttctgctttccaccatgagtggaagcagcacaaggccctcaccagacacagctgcccagtcttgaactttgcagccaccagactccatgagccaaataaacttttccctcataaattactcagcctcaggtattctgttattgcagcactaaacaaactaagacgagtactaaaaataaaatattcataggtgaatattgtaaaaattataaaagaaaaaattaaatattctgtgtatacagaaatctgagtttaatcaaagcaagaattttttttccttcagaatgtaataataatcatttaatgggcttatttccaagttttacttctctaaaatcaaacagtaggtccaatgaatgtaatgtgcttggcatatcctcaaaataaatttgcccatttgagaacatcatagagataatccagtaaattggccaaagaggtcatagtaagtgaaaaggcctaaatttgaactgagtcagcttagcttggaagctcttgctgtctctctcagataaaagctcctgcactgcagtaagcagctgcatctacataagtgccggacttttcatgtccagctaatctaccacattcactctgtcaccaatggcattggacacattctgattccaccctttctgtttcgctttggctaatagatccttttctagcctgcatttacataagagataaagatactatccagtagtaactttaacctgaaggtacagaaaacaattctgtgtgtccattatgtttgaatatcatgtataccctgtcaaagggcagcttcccttactcctaagtttaagggaatctgctcactggtcccctcacatgcaacaaggttgttctcttaatgtatgctagaaaggaaccatattttagcacaaatatgtgtcctttatgtaaaatgtcacacttttaaatcacaaaatacatacccccaagcaactccaatcataggaagctcttctatagatgattttctgtgctttttatttttatattctgtaggaatactctttaaccagataatctcattggttcagccagtacccaggcttctagatgctacatttgcacatactaagcaatttatcttggtcgtggacatgttcaactcatctcctcatagtatcttttgcacttggagaagtaggagctccttgtcaacctctagccattaaagagtcttctgaagtttatcttatatgtcctaaaaacacttatatgtcctaaaaacagtgacatattctgtcattgtaacaaataatggtaattattcattttctttcatatatttaaattgggataaagtttaaactaccatttcacactattttttcaacactctctccacattattgacagttcagctatgatacagtatacaatcactatctttttgactattgtctaaatactgcttgctctgtcagaaatgacctcctatctatctcctgaggttcagtttcaatgcctcacttcctatgaccttactctccccagctctcatcagctgccaccgctagatgctcctccctctaggattccataagaatttgttcatatttctattaacacatttattatactacttgagactagttatagacatgcctgcctcttccagcattgtgtgtttgtgtgtgtgtgtgtgtgtgtatatatatacatatatttatattataaatatagctctagtttctggggagaatatctgctccattgcagccatgtaaaaattgtatgtagacaagaacagaaaaccaaacactgcatgttctcactcataagtgagagtcgaacaatgagaacacatggacacagggaggagaacatcacataccggggcctgtcggtcggtggagggctgggggaggaatagcgttaggagaaatacctaatgtagatgatgggttgatggatgcagcaaaccaacatggcatgtgcatatctatgtaacaaacctgcatgttctacacatgtatcccagaaattaaagtataaaaaaaaaatttaaaaaataataaaaagggaaaaactgtatgtagagtgaataaatagattaaaaatggaattgtctgagaagttggttgaacttcttatgaacttttttcacaacttatttaggttgatacaacatggacttcaagagcctgaggttttagaatcagaaaatatctgatatgagctgagacttttattagcattgagaaattggctaagacttgttaggatgatcttgatcagtatcatctgatgattttttttttaatatacaactcctaccccaaacccaacaaggttctaatctaggctatcacacacacacatacacatacacacacacacacacacacacacacacacacaaatgctacaacacatctaaatataagaaaccatttattcatcttaaaagttgacttacattaatagtaatgcattaagtatatacattaagaactgtcttaatcagtttaggttgctatacattgccatagaccatgaggcttaaacatcaaacatttatttctcacagttgtggaggctataacttcaaaatcagagcaccagcatggtggagttcttgatgagggtactcttcccggtttacagatggccagcttctcactgtgttttcacatgactgagagagactggaagcttgctggcatctcttctactagggacactaaacctgccatgaaggctacactctcataacctaattatatcccaaaggtcccatctccaaatcccatcacatttgggatttcaacatatgaattcagttcatagcaggagcagaatgtaaataatgataatggaacatgcaatatttgctaacttataaggcttctaatgtatctaatttaaagacatatatttgagttttctttgatcaaagaaaaaatatgtctataaatgaatgtcagctataaaaacatttgcttatgatctgtcatttccacttaatgataataatgttacattgcatccatgctgctttttattttcaaggcaatttcacatacattatctgatttttcaactggtggccagtttaatgtcagaaatgtttccaagcttctatttatatttggttgtttaaagaagattctatacttatatgtggttacacatgaaacatacatttacttcagcacaccaaatcagtgaaacccgtagcaatttcagttgtgctcatccaaggacaaaattaggttttaggatttaacccaggtggcataataaaatttaaataacttgtttacctgagagcagcagcaacaaaaagagacaatcagaaatacaagccacaacagaacagtaatgaaatgtgatcctaaaaatattaataagtgttgaccctctgaaataaaataactaagaaaaggaaaaacaaaactaagggtgctcccaaagttgataaacaatgcatgaataaatgagcccctccactgtattccttcctttatatatataatacatatatgtaaaagtgatgtatatatcacttttttcacgggtcataaaatttgtatgttaataatttgcttgtttaccattctaatgtgttaaaaccttatacacctttgattttcccattgattactcttaagcagattaggcaatcaatacatgtttgttgaattgcactgaacttttaagcaagggtaaaatgatgccagctagaagcctatatattgtttcctgaatggtaagcagttcaaccaagaaaaaaaggtgaagcagatcgctttctttgctgctgttattcgtaacagtcgaatacaggttaccgtgtttttttcaatataaaatatggttgtcctagccataatcttggtctcgtgctaaatatattattcatgacatataatgagtagcttactttgtaaagaagatgtagtgatgttagcagtaagagtgaaattggccatttccccctcgtaaagctgtgtcttccccaagcaataaaatatggcttggttaagtggaacatgtggataaaaagatgaattgcccactatcttggagcctcattttaatatttaattttactttgggcacatcctgatacactagagaaagcctttatttacttttattttccagcattcattttgttgctctgaaatataccaagtactttactaagtgttaaattagttttaatattgtgaatataaagttttaattttatgaataagtttatagtactgaaatcactcagtgcggcaatgataatactgatcttggacctgattctcgattctcccttttttggcaaaatatggtgcatgggtgacatgacatttcattaatttccattcaccaggttaattctctattgcttatcttcatgtgagtgtgtgtctctgtgtcactaggaccacataaatgggggcatcaaaactacagaccacaatttcaaactgtccttctaaagtgaccagatttaaagatcaagaccagtcatttggagatgaaatgaagaatgctgataattatttattacctattacctgccaggcatcctatcaaacatatcacatgttctctcatttactcttcaaatcaacactggtgttcatattttgtagatgatttgctgaggctaagggaggttaagcgactctgaaaagataccatagctaaaaaatgtcagagatgagactgagtcccaagactttgtgattttaaagcccatgtcttttccactgactccaaagaatgagcagttgccagtagcgctgatttagaatcatcaagcagtcatgttgtctcaccattttctcccatcacccaaaattctacccacgcagctctgttattttagcaaaagactctaaatgctattaaaatgcagacaagatacagtgaatgataacatttaaagatatttagggtcagtccttttcttcttaggctgaccaaaagctaagaggataaattgaactggctgattaggcagaggtaacactaggaaaaaaaaatgtttagaaaactcgaaagacagattttaactgcttcataatttttctctgggctattgttattgctagtcttcagagaagcttgtgtggcacaaggaatactaagtgaactgaatgatctgaaaggtatatatcaaatgtgctgttaaagggtctttatacatagatggtaaaaccccatgataaaacttttgtagatacttcagcattatgcaaatgattgatcactttatgagacaattttgaataatatgtgtgaaattagttttctcctacttgtcttagttctttaaaggattaacagcatccattattctttgatgttattactgttaatatttttgaaaattagggactttttttaataaacgtacattaggatcaaaatatttcacatatcatctgattcttctgttgacctctaagtgatgatgatgtagttgacagatggtaaccctgcatatccaaatcaacatctctttgttttgtatgtgtcatgtagctttttattttgttactataattaaagtaacaaaattaaagatccaggttattatataaaattttcaggaaactatatgtctttttctagtttgacatgtttgtgtttttatccatttcttggtgtacacataaaatttaagtatgtgccatgggtttatgagccagtactcataatgcatcctgaaattttccagtggcagatataaatacagagctgtcatatttacgctgaattataaaacaactgaaaacaatgaaaactggtatattctgagtgggtggcatgttaaacccacacaattttgtcatgtttacttttatttgtactcgtttgacagcagggagaaagtactctgcttaaatctatttcgataagatagttttaaaactttataactttatgtaaaagcttacataaattccctttgctgttagttgattgaaaatggaattctttagtcacacataggtaattataaaatgaatgtccttccatcaacatatgcttccttgtttggatcaaatatatgtcttcgcatttgtagacattttcccttacttttttgttgaacttgtgaagtgaatgttaagtttatgtattcaattatgtggcgtgttacatacagaagttttctcccaactgcaagactttattttgctgggttaaaacacttggctaacatatggttgccaaagataaggtgcctatttaaaaactgatgttcaaaaaagctggtcagtgatagtttttttctgtttcattaaagacaatacatgctttctactgttttctttttttccttcagcagagttactatagaggaactatattcagattatttgtaatactttggaattacatttaaatttatcactgtatttccatgtttgaatgtcagtgagcatgtaggagcatcacatagttattttgtagcaaggaactagaatctaaccctcaaagagatggcaattttaagcatcctgtgtattcctatatgcttaagctcaagcttaattaattaataggccgcaaacagttaataggttaattttctacccattaattttacgaaatttgaaagaaatatttttgatagctgcaaaacgtattacatttctacaaaggaaaactaaatatgacattgtaaatagtgttccagacttatttttggctgtgtcccataatcgaagattttattttattttattttattttattttttttttttgagacagagtctcgctctgtcgtccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccataatcgaagattttaaagcattaaagtttattcatccctattgtcaatcctattctttctggctatattcatcagtcattgccttttcagtaaaacatattaaacatattaaagggatctgaaaacttacatgcaaatgagttgtgtgaatgtggtgaagagagagttgcaggatgttcagatacaattttttcatgttaattttatctcagaaacttcagggactaccacaatttacacagcaaattttaaaatttatagactgacattttgtttcttctttttatttatttatttaattttcaaccttcaaagagtggatctagactgacctttcaaactttgcgtagtctttttcaaatttatctttcaaactttattttccacttgctccactgctccattgctgtaccattgcttttatcacttttttctcaaacatgttactcttagtcctgtttttacttggttgtagtcactgttattctcctaaaaatcatgcattcattcattatcctattatgaacaaaaaatacacactagtcattgaggatataaaaatgaagaaaacatgaattcctacatggaggagcctattgtttagtggaagagatataattacagaggcaaggcactagggtaaaattatcttatctgttttcagattttgatgatcaacaaatcattggtccttccctataagaataaaggtagctattccacattaaaaaataaatatgagccatttgtggaagtcatcttcccttgatggtgagtgaatgaggagggtagttgtaggtcaatcttggtcagtggacttgtttgcaaccctaaaagagagcttgtgttaggacaaaacacactgaagataatgagtgaagagttgtgaagaatttgaattctatatgatgctgatgggcaccagagactaccttacctctgtatttcctcttatgtgaaaagattatatatatatatatatatgcatatatatatatatgcatatatatatatatatatgcatatatatatatatgcatatatatgtgtgtgtgtgtgtagcgtttattccaatttgtcaaagtattcttttgcttggatccaaaagtttcctaacttacctaagtaccattaaaataatcagatactaccagaagcaacctacagattcaatgcaatctctatcaaaataggaattacattcttcacagaaactgaaaaaaattctaaaatgtgtgtgggatcacaaaaatcccagagtagccaaagcaatcctgagcaaaaagaaaaatgccagaggctttgcgttacctgacctcaaaatataccacaaagctttagtaaccaaaccagcataatactggccttaaaacagatacatggactaataaaacagaatagaaaactcagaaattaatctacatgtctatacagccagctggtttatgacaaacatgccgagaacactcatggggaaagggtagtctcttcaataaatggtgttgggaaaactggatatccatatgcaaaagaatgaaactagacccccacctcacacataatcaactctaaatggatcaaaaacctaaatgtaagacctgaaataataaaactgctagaagaagacatagcggaaatgcttcaggatgtcaatctgggaaaagattttatgaataaggcctcaaacacacagataaataaggaaaatgagattatatcacagcacaaatcttctgcacaacaaaggacataatcaacagagtaaaagcctacagaatggaagaaatattttccatctactcattagaagattaatatccagaatatacaaggaactaaagcatctcaacaacaaaaatatattttaaaatgggcaaatgatctgaatagacatttctcaaaagaagacatacaaatagcaaaaaaaaaaatgaaaaaaaattctcaacattactaattatcaggcaaatacaaatcaaaaatcacaataagttatcgcaccgtcagtaggaggctattatcaaaaagatgaaaaataacaaatgctcacaagtatgaagagaaaagggaactcttatatgctattggtaggaatgtaagctagtacagccactccagaaaaaagtatggaggtcctcaaaaaactacaaatagcactaccatatgatccagcaatcctactaatgggcgtttatccaaaggaaaagaaatcattatagcaaagagatatctacacccccatgtttattgcagcactattcacagtaaccaagacatggaatcaacccaggtatccaacaacagatgaatgagctaaaaaatgcggtatatatacacaatggaatactattcacctattaaaaagaatgaaatcctatcatttgtggcaagatgtatggaactggaagacactgtgtaagtgtcaggaatagaaagttcaccaccacatgttctcactcataagtgcaagcttaaaaatgttgatctcatagaagtgaaaagtaaagcacaggatactagaggctgaaagagtaaaggcaagggaagatagagaaaaatttgctaaaggatacaaaactatagctaggtaggacgagtaaattctggtgttgtataccactgtaggataacaatatttaacaataatacatagtttcaaatagctaaaaagaggatattcaacatttcgacattctcaacacaaaagatgagtttgagaggatgaatacgctaattatcctaatctgaccgttatacattatatgtattgaaacatcactgtgcatttcatgaataggtacacttatttgtcaattaaaagtaaaattttaaaaaaatcagaaatattaaaacaaaagatactattagcagcttaaatatgaagggacctgaattctcaaaaagcaaaagtagataaaactgtgagaatttcaactctaaaaatatacttttcataagttaaacaatatttttccttgtgaatttttaagttcaaataatagtgacataggtgcctgctattttgtagggtgaatttcattaattttatgacacttggattccataataacctgtcaagatagatagaaaaaaatatataacattccaaattaaatgagaaaattgataatcctagaaatgtatgttatttgtaaaaatcaacattatagtgcagatatcccgcatttgattataagaactcttctcatttgtctatctgccatacttcttattggaactcagagctgatataataattctgatggttttaaaactatctgtgaacatatgtactaccctaccatttggtgagtttaaagtttggaaatcattaataaatgatattcccattaacaaaataaacatcactgaagatatatgttgagagatgggaaggagttggtgggtcaagagagacactcttttgtcctttgtccctgtctacaacaccattttgtggtctggctattatttcatagttaccactaccatctggaaagaaagattatcccacatgcctgggctcttaaattattgcaatattttttgcatgaataatgaacaaatttataaattataacatcattcctgttatgtttctaatatgaatgatattcacttgcaagtgtagggcctttgccctgattatagatgttagaaaagaatatgtgagaggtgttatagaaataactgaagtaagaatttacacgtttgttatttagtaaaagtcaatatatttctaaagacttgaataaaacaaatgcaattttgtacagaattcttcagtgcattttctaatttctcctctctgatgtgaaaataacacaagatttagaaatcacctgcaataaaacatgtttatttacaaagtgaaatagtttatgttgtattaacttaaattttcctatttccgatgcccaagtaatacccctctaagcgaatcatgattattgacaagtttacttttatacactttatagtactcatttcccataaataatgtatgattctttaataaaattgataaatattcaactctcaataaggcaaaatcctatgtattcaaaataaaatttaattgaacattaaaattcttgtctagttcccattttgtgtgtgtgtgcacgtgtgacttaggctgtttttcctgacatttgtgaagtcaatgagtttttctgctgtacattagtttctccccttcagtgctgccttacagtaccctattgtataaaatatgcattcagtagagaaaacaatatactgcagacatcagacttaaacaaaacactttttattgttgctttaaaaaccagactttacacccctgcactgaaaataggaactatttgttcctagtccatgtgcctggaccaaagcattttaaagtacctaaaaaaatttaaatttataaattcaggtttataaattgaccttattgaccaatacctataagtccttttaactttagaaaaccctccacaaataacaaatatgatcattttcatttggctatttttaatataaattaattttttcttacagaaaggaatgaaaagttttattaattagagcacttacttaaaccaatgctttcaagcaatctttctttggagtcagtgattatctttggctctataccaaaaacttcaggtattttttcttctttgcagtgttttaaaatgtatttggttgggtaaaagtcactgtttttaggtttcaaaatgtttctacaatatattaagccctgatatatactaatttacctctttatgatttgagtgctagattagttttacacctaataatgtagaaaaaaaatttaagcttataaatttgtatatattatactaatttctgaatataagcacaggtgatagcttattatatttgttcatatgcagctcctggaataatcctagaacaacgcatagtttataaaaaaaatagaaggggagtaggaaggaatgaaaggagagaaaaatagcatctgagcagtctgagaatttcacaataatagctgttctaaagtttagatgactataaattattcttaaacagttatgttttgcctatgtttaatatatataaaacagtagtatttgtatttctgtaattaacatttctctagaaaacagtgttaaatatatatttgttatagtctaaatttgtgttcataacatgtaaattgcaagcatgagtttagaaactcatgattttgccccctcctttaaaaatcagttaatcaataatttgtattgatgcactagaactccaagcaagcgtctcagagtgttctatcacaaagaattattaaaaggaaagcttcaaagctaaatcttcaatggtagctaaagagcagataaagactatatgaatctgattccccaagacaagaagttcttataaattaaaggcaaataggcaagtgattaggtaatatgaacatgtgatttaaggtgaaaatcttctttcaatggccgtgaataaatctcctttaaagacattatattgtgttcactaaattaaaatgtgccaattcttcaatgatcaatggcaatttgttttgctttaattagctgataaaacaaatgaataaatagcatcagctaaggtcatctgttctacctgttgctttaggttaatgtgtatttcatcctcagattccttagctctcagaaatttgactgacatgactcaaggaaataaaaatatttgaaatatgtatataatttataacataatgttagttttatgtaaaagcaattcagcaagtctgaaattacttttctgcaatgactataatgtaacaaatagaaataatttgtaacactgtgttctatgtcaattgtacttaaacacttttgagatatggcagaggatcttgcttccctcaggactaataatgtacacttcatctaagtccaaattttaattaacagttcttgttaagatagttttttctacctctaaacctaatcatacttggtatttaaatggcatattcaataaaagttgtcccatttcacctgttttgaagtcaaaggtttttgctttaaaacatttttgaactagctctacagtttttagaagctgtttagggacttcacatactatatgcaggagtaagtaactaattggtgctatactttatggtattgacacattcaaagaacttcattgattcagtacactttctctttcttaaaaacatgagacccttaaccatggtagaattctcattgttaatttattttggctgctctattgcctgttactaagttattctgtttcaagggcaaaagtatattttttccacatggaaaaaaattcaaaaccaggcagtagatagataaaattattctttgccattagcatgctaaataatagtattgcaaacagcagttcactatgcacagcttgatacgatagatgaaaatattagtttatgaatctgatacttaaactttactaagtaaagttagtaaagtaaacagtctttactaagtaaagactgggttctttaaagcccaacctttggtcttttgaatcgttctctatagcaattagtcactcatataaagtgagatattataaaccgcaactctgtttcagcatgtagaattctttatatatatatatagacacacacacacatgtatatgtatatatacatacatatacgtatatgtacatatatatatgtatatgtatactttaagttctgggatacatgttcagaacgtgcagttttgttacataggtatacacgtgccatggtcgtttgctgcaccaatcaacctgtcacctacattaggtatttctcccaatgttatccctcccctttcccctactccccgacaggccccagtatgtgatgttcccctccctgtgtccatgtgttctcattgttcaactctcacttatgagtgagaacatgtggtgttggttttctgttcctgtgttagtttgctgagaatgatggtttccagcttcatccatgtccctgcaaaggacatgaacccatccttttctatggctgcatagtattccgtggtgtatatgtgccacattttctttatccagtctatcattgatgggcatttgggttggttccaagtctttgctattatgaacagtgctgcagtaaacatatgtgtgtatgcgtctttagagtagaacgatttataatcctttgggtatatacccagtcatgggattgctgggtcaaatggtatttctgggtctagatccttgaggaatggccacaccgtcttccacaatggttgaactaatttacactcccaccaacactgtaaaagcgtttatatttctccacatcttctccagcatctgttgtttcctgacttaatgatcgccattctaactggtgtgagatggtatcttattgtggtttttatttgcatttctctgatgaccagtgatgatgagcttttttcatgtttgttggtcgcaaaaatgtcttcctttgaaaagtgtctgttcatatccttcgcccactttttgatgtttttttttttcttgtaaatttgtttaagttccttgtagattctggatattagctctttatcatatggatagattgcaaaaattttctcccattctgtaggttgcctagtcactctgatgatagtttcttttgctgtgcagaagctttttagtttaattagatcccatttgtcaatgttggcttttgttgccattgctgttggtgttttggtcatgaagtccttgcccatgcctatgtactaaatggtatttcctaggttttcgtctagggtttttatggttttaggtcttatgtttaagtctttaatccatcttgagttaatttttgtataaggtgtaaggaagaggtccagtttcagttttccgcatatggctagccagttttcccaacactatttattaaatagggaatcctttccccattgcttgtttttgtcaggtttgtcaaagatcagattgttctagatgtgtggtgtcatttctgaggcctctgttctgttctattggtctatatctctgttttggtaccagtaccatgctgttttgattactgtagccttgtagtgtagtttgaagccaggtagtgtgatggttacggctttgctctttttgcttagaattgtcttggctacatgggctcttttttggttccatatgaaatttaaagtagttttttctaattctgtgaagaaaatcaatggtagcttgatggggatagcattgaatctgtaaattactttgggcagtatggccatttccacaatattgattcttcctgtgcatgagcatggactgtttttccatttgtttgtttcctctcttatttccttgagcagtggtttgtagctctccttgaagaggtccttcacatcccatgtaagttgtattcctaagtattttattctctttgtagcaattgtgaatgggagtttgctcatgatttggctctctgattgtctattattggtatatagaaatgcttgtgattttgcacactgattttgtaccctgacacttttctgaagttgcttatcatttcaagaagtttttgggctgagacgatggggttttctaatataaaatcatgtcttctgcaaacagagacaacttgacatctggcttgaggagctttaagtgaccagatcatggccattgtttcgagtaaagtggaacccgtatacttgagggacgtggtaagaccaatgactactgggtaaataatgaaactaaggcagaaataaataagttatttgaaaccaatgggaacaaaaacacaatgtaccagaatctctgggacacagctaaagcactgttgagagggaaatttatagcactaagtgcccacaggagaaagcaggaaacatctagaatcggtatcctaacgttacaatttaaggaactagagaagcaagagtaaacaaattcaaaagccagcagaagacaagaaataactaagatcatagcagaactgaaggagatacagatacaaaaaacctttcaaaaaagcacggaatctaggagctgtatttttgaaaagattaacaaaatagatagactgctagtcagattaataaagaagaaaagagagaatcatatagacacaataaaaatgataaaggggatctcaccactgatcccacagaaatacaaactaccatcagagaatactgtaaacacctctatgcaaataaactagaaaatctagaagaaatggataaattcctggacacatacacccacccaagactaaaccaggaagaagtcaaatccctgaatagaccaataacaagttctgaaattgaggcagtaattaatctaccaaccaagaaaagccaaggaccacacgaattcacaaccgaattctaccagaggtacaaagaggagctggtaccattccttctgaaactatcctgaacaatggaaaaagagagactcctccctaactcattttatgaggccagcatcatcctgataccaaaacctggcagagacacaataagaaaagaaaatttcagggcaataaccctgaggaacattgatgcaaaaatcctcaataaaatactagcaaactgaatccagcagcacatcaaaaagcttatccaccatgatcaagtcagcttcatccctgggatgcaaggttggttcaacatatgcaaatcaataaatgtaatccatcacataaacagaaccaaagacaaaaactacatgattatcttaatagatgcagaaaaggcctttgataaaattcaacaccccttcatgctgaaaactctcaataaagtaggtattgatggaaggtatctcaaaataatacctatttatgacaaacccacagccaatatcatattgaatgggcaaaaactggaagcatcccctttgaaaactggcacaagacagggatggcctctctcaccactcctattcaacatagtgttggaagttctggccagggcaatcaggcaagagaaagaaatagcaggtgttccagtaagggaggaagtcagattgtctgtgtttgcagatgacatgattatacatttagaaaaccccattgtcttagcccaaaatctcttaagctggtaagaattctttatttagtatttagtctagttttaagaaagtcttctctcacctaccactattgaagttttatgggaacacaaatgatattatagtctaagtgaaagacatgttcatagtaggcttacaagaaatatttcatgaaaaaacactttgtactgtaaaatttgtacataagccattgaccattttttcatgagggaaaatataatgtcataattcggattggtattttagtgaaatggaaggtcgctgtatggcctcttcctcattcaaagtttgtgaaactctcttctcttttctttgaggctgtgtcttgagcaaagttttactgcaagttggaaccaaactgagatcaaatggccaccagttagtagtgacatctggaaagtcatcttctgtattgggaactcacctaataccacttgaaattatatccttgtctttcattcaaactctgacctccatctttctgattgtaacatagtcatcaaaacctgctaattgctcatcttcttgtaagttatttatgtggatgacctcagcgaatcttctcaaacattctatgaggcaggtactattattattctttctgggtctacccctttgtcctctagctattttttggagagctgataagtgaacttgaaatctgactacagggacttttctaataaccagataactttatttctctcttcttgatatatttgttttctgtgctcctgcatctagactgggtcgtgataaagctgagtccagctgtagggccagacagagccttcctctccacacagcattcttagcattgtggagctcggcttcaggaagcattttccttacttaatagaagctgttgctcctcttcatgggaagtcttggcaatgccagtgatctaaggtgatggaatctgttgatcctacatgcagcagcagtcggtactgaaatgagtaatattttaataatttttttttgccctttcttcttccagttttgctattcaaggtgatgtttcttagtcttctgctccttaattagcacctgttgactaaatggatcaacaaacctatcccacgtgtgacttactctcctggacacgagtcttgttttatagtctagcttagcagacttcccactggtttctgtcatgatactgtccatctagtgaacactttttttgttataatttcctccctctaaacttcatactgttaagtagtttctggagtgcaggatttttttctaaagtcagaacagtgggaaatgagttaataaagcttctacgttccttggaaagacccctgagagatacttaaccagttgcctgctgtgtaaatgttattgagaatgaaaaacaaaaagtaaatttacagcttctgttgtgtccacatccattccaaactagatgcaccataacaaaaataacacttagaactttaattgtagtatctgtgaaaaggcaccagtgtgatttatgtaataaattggatactaaaaactttcttatgatatcatgcatttaaaaattaggaaatgacagccctgaaggtaaatgtaacttgaatgatagcattttcccaaaagaaagcattagttttcaaataagtgtacttttaccaatttaccagtaaacagatcttgtcacagaaatacatacttataaaaactttggacatatttgaaaaataagcagattttcttaaacctcagtttttgggtggtcttattttcctcttctctataagcaaacctttgcccatcaaatagatatgtactttttaatgaaaatatcatatggtaattatattacccataaatttctcctatggaattttctagtaagtaggtgttattgtcacagaaatacttatttgtaaaaacataaagtaaattaatcattatatgctcattgagtaaacatagctgagtaataggttgcagtcatttttaacacaatttaacaaatgtttgaacgatctataatttttattcatgtgtgatttatggcatccattttaactaatgtaaagggtagatgatgaatattagtatcagtcaattccagacttcaaccttaatacacataaaagtgactaccaagcattttctcctaattaaaaaaaaagcaaattttatttattttcaatgaaattttagcttctaatagtcttcaaaagctatgtagttattataataatgttgccattcctcaaaaacattctcaggctgctttggaatcaccttaagcatttatttctgaaaacctattcatgtactccctaagcatagatgaacacaatggcctcatttgttaaagctgtttactccttgtttggtaaagctgagctcacaagtcaaaaccggcctgcagacatacggttttgggcaccatagtgttttctaaagggattttaagaccattaggcacatctagctcaaaggtaattgtcttatacctggcacacttcattttaaacttgcttaatctctagaaacctatgctttagttatccctaaacaagctgaatatttagtttacttttctgcatctcatagtgatgtctaataggcatcaaaatcactcaaaactgtgctcttaatctttgttcataaacctgttctgtttcagttttctccacctctgtaaatggccgctctattccaattactcatactgtaaaacttggagttctctttgactcaatcatcagcaaatcctgttgcctttatcttaaaagtatgagcaaaatctgctacctgctgtcccgagcccctatagctgtcacctcgctttactggcttatcacagtgatctttgaattcatctcccttttccacccttctttgcctatagcctgctctcagcacaatgggcagaatcatccttttttaaaacacaggccagatcattttaccctctccttatgacctttcaatgctccccattttactactaaagaagtcacatccttgaatcagcctttaaagtcctatacaacaggtccttggaatgtttctgacccaccccatgctatttctccttcattgcctctgctttaactgtgctctttgtttagcacactgggaacagtgctgccccaggatctttgcacttcctgttccttctgcctggaatggtcttctcttacttgctcacatggccacttgtctcctcttcttcaaaatattgcccaaatgtcaccttcttgatgaagccttccctgaccgccctaaagtagaaacagcctgccacccacctctctactccctaaccctcttttctactaatttaattattttttcatccaaaactcttacctctcctaatatgatatgttctttattcatttgcttattgttttttataaacaacataaacttgaatataaacttgattataaacgtgaaagttcaaagaattttgtctgtttttttaactgccacatctttggacactgaatgagtacctggcatgcagacacaatcgtatattaaagataggtgtttctttccaaaactcctaacaatcctagaaaactaaaatatacaccactactagtattcaaaacatcttgtttatgcatggcttcaagctttgacctaatttgtttatatatgtccctatattcagttactgttttcataaactttatttataaccccttagctttcatcctgtgtcttcatccttgtggttcagcaatgatatctagtctatatcttggtatataaataatcattgaatttttatgatatttcagtatgttaaggtctcctaaagttgaatattgtaatcttaatcttttatttatcccgtgtctcctgtgattcatatatttgaaagtaaattttaattctttctccaaaagtgtgttgaccataccagtccctatctttaaagacatgagataatttttcaatatttattgtgcatctgtaattgataccattggcttattttcttgattaactcttactactttagatttctctatctaaggcattcatggtgcttttttcactctttatatatcctcagtgtaccacattcctttctaccataaatatttcttttgaaaaaaaaactctctgtaccctctgtagatgtcacactgtgttctttctgatgtctccatgacccctatgtgttcatggatatttattaattttatatagtgactggacactccagtgaattctcaccagccatttcgaccccccacctgccattccaactccccatccctaaatgaaatcagcagagagaagattaaggccaaggcaacaaaattatatgaaaaggtatgtaggtggtcgcagaaggggtcagagaaggtaagtggtttccttgaacattaccaatgggttggattcatccattagaaggattttcaactgaaggtcatgaagcccaaaacaacaaccaaaggttatattataccaatgaagggtgtaagagttcacagacataaaggctggagattgtagaaagccaagaaaagtcaaagtgctggaacttatcatttaaagaaaaaaacctaaaatatagaaaaccaaaaaagattaactaaataatctggaagtccaaggacaagagctacacagtgcaaatgaatttggaaagcaattatgaaaaactttcctttaggatgtatgatcttcttgagagctgtatactcttttacctattctgaaaagtaccttaagctagcagagtccatgattttctgacaacaatgaattttatacattcttgctatatgaacactaataatataatgttaggttattcagttttgtgtgcatgctttgcaattttcaacaagatgttccattattcgatctgtctatcttgttcttgcttactcagagatttctaggaatgcaatctataccctgtataatttaacttttaagtcacgttgtgttagacaagagttatgccttatcttctcactaataataaagtgtcctaggattaattttattatttagtgcatagttccctagttgtatatattacttcacaaaaaacaacctcaaacttattgagtaagatagtcttattgagtaagataaacttacttattgagtaagataaacttgaatataaacttgattataaatttgaaagttcaaagaattttgtctgttttttttaactgccacatcttgagtaagataaacttactcaataagataagatagtcttattgagtaagataaacttattgagtaagatagtcaccttttttatttttaacaatgacatattgatgagtcaggaatttagacccagaatattgaggatggctcttctctactgcatgatatcagatggctaagggggtaactcaaaattctcaagagctggagctggaatcacctgacagcttcttcacttctgtgtttgacactgagactgggaaaggtgaaggatgcattcggctggaacagtgggcctgagccctcacctgtggcccttccaactagagagtctcaggctggttaagtattttatataacagtgcagggctccaagattgagtgttttcagtaaaggagtaagctttgttatggtttgttttgagactaggtctcgctctgtcacccaggctggagtgcagtggtgcgatcacagctcactacagcctcaaattcctgaactcaaacaatctttccacctcagcctttcaagtagcggggattacagttgcatgccaccacaccagctaatttttctcttactcttagtagagacaagatctcactctgttgcccaggctggtctcagactcctgagcccaagagatcctcctgcctcggccacacaaagtgctcggattacaggcatgagccaccacttctggcctaagctgtattatcttttatgtcctagccttagacatcacataatgtcacttccaccatgatctgtcagtcacagtaatcataaacattctcagattccaggggaagagttgtagactgggatggatattgaggcatttgtagctataatttagaactgccacctcacctacaggcatactgactgaatgttctttactcctattccttatgttatctttaactattacagtagttgctgagtgttatggagtgcatatctgtgtcccttcaaaaacgtcataaaacgcatacccaaggtgaagccaactctaaaactgcctgtcctagatacagtttttggaaacatggcattggagaattgagcctaaatggataaagaattactggcataatttttgtatatttccctaaggccctataaatactataaaatgaaatacagaagttaataaaaaaaattaaaaaaatcaagagtcaattgagttggaaatgacttcaagacagagttgataacaatatatgctttatcaaagagtctattcagtgatgactgaatcagatttatactgatccatgaatttgaggtacaatcaagatgaaaccctcacctccaatgggtcagtgggtctgaaccttcacctgtggctcaggtgatagcatccaacgggatgctaatacgtggtgggacctttggaaggaaattagattcagatgatatcatgagagtgtggtcctcatgatgggattagcactcctataaaaagagaaggagactagagcttactctctgctgtgtgaggatatggtgagaagatactgtcaacaagccggaatgcaggccctctcctgacactggatctgccactgccttgatcttggattccccaactctgaactgtgaaaaaggaatgttattgtttaattcattaactctatggtatttcttcatagcagctcaaactaagacacctatttgtaaagagaatgtgactgttatttgtcaccccgtataaagacagttacacagtttaatgattatttccatatttttctaactgcacattagctgaggcataatttttcttgtacacattcttttttaaaaatgttctctttattctgatcatacctcaaattcatggatctgtataaatctgtatgattcagtcatcaccaaatagactctttgataaagcatatattgctatcaactcagtcttggagtcatttccaattcaattgcctcttgattttttgtatgttttctattaacttctcattttattgtatggcatttatagggccttagggaaatatacaaaaaaagtaattatgccagtaattctttatctatttaggctcaattctccaatgccatgttttcaaaaactacatctagcacatgcagttttagagttggtttcaccttggatatacctttcatgacattgaaattatataaatctttaaataagctttttgtgttatatagacctcgcttgtttctgtcaacagttggcgtatgctagtttgacccctacattgtccaagttattaaataacttgtagaagatcactgaatagaatacatgcttgtagaaaagaaatgcacatcaagtaagattctagtagtttttctttcccttatggttaacagattttaagatattatctctcatcaaataatcatgttgagagcttacattatctttttatattatctctttctatttgcttacataagctagtctacatgctgctaagaagaatgtggataaaagatccaaaatacttggtaataagtattcattggaaatgagtgtcactgtgtaatattgccaactttttctagttttgttatttccatgtacacactgaacacttagaaaattatatgtgtaactttaagtatttgttcacatatcattacatacatatacaattgtatatcagctgtcaacctgctatgatgttttctggtgttaaaagggactcagtttcttctatgtcatgtgaagaaacatgctgtcatccatcagactgttttacatttacataataaatcatgaaattccagacagtgttcactcatttatggttggtcattccttgatgttaatggaagacaaggcttatgagaatatttcacttctttaagttctgttggttaaaaatattcctaaccagcggatcacaaggtcaggagattgagaccatcctggctaacacggtgaaaccccgtctctgctaaaaatacaaaaaattagccgggaatggtggcgggcacctgtagtcccagctactcgggaggctgaggcaggagaatggcgtgaactcgggaggcggagcttgcggtgagccgagatcgcgccactgcactccagcctgggcgacggagtgagactcagtctcgggaaaaaaaaaaaaaattcctagccatgttaaaaattactttggcgttttaaaaatgtttaattttgatatactatgtcacaggaacaaagagtttataaaagaatttgtatttttttaagtaaaagaacccttataaccaagagccaattagagatgttcttctagcagcatatagactatgtaagctagtgtgaatttgggatattttttgtcattctttaatttctattctttacttagtttttcctgtttttaaaacttatatgaataggccgagtgcagtggctcatgcctgtaatcccagcacttgaggaggcagaggcaggcgaatcacctgaggtcaggagtttgagacaagcctggccaacatggtgaaaccccgtctctactacaaatacagaaattagccaggtgtggtggcgggtacctgtaatcccagctcgaacccaggaggcggaggttgcagtgagacgagaccaggccattgcactccagcctgggcagcagaggagagacactctatctcaaaaagaaaaaaaaaaaaaaaaaaaaaaaaacaaagaaacttatatgaatagaaatataaagtcgttcctattgtttctggctattgtcacacattatctttgtcagatgaatgtttgaattaattaataaatattttctactattctatttcccccatctttttgaatgttataacttcactttctattattttagtggttaccctaaaaattaaaacatggatatttaatatgtcaaaacattatcagtctctttactcacctcttagatatttcaagaactttaaaacactttctagatttacattatagtgtaaaatatatattctagatttttagtcttacaaagttatatttcctattttataattatttgttcatttctatcaacatagtcacccactgtttcccattgcttctagaatctcagaaggaaacaaaatcctttagaatttcctctacttaatgtttcttgatttttgtttgtctggaaatacattataatctgttgctgattttcctagttcttgaattatttgccagtctgttctgctggctttcattctctttccttaaatagttggccgttttttattcggcactgattatgatgctgaaataattatttgtgtgaattctttgaagtctatggtgaaggtcctttccttcatcaagaattttcattagattctcctgggtacctggactcacagtcattattttagatgcaaatagcataatagtcttaaggctattcaggcgtgctgttctttgtagatattatatcacaatctgtacttttatcccattcattagatttccaaaattttacataaagttcataggattctcattagctttttaatctggaatgaatctaaagttttgcctccacttgagccttctccatttttttctttatctgtctcaatggagatttgtcttatctttccagagaatatgttcttagactcactcattcctctcatcagttttctattttagtagactgtaatttttttcataattttcataaaatctaattttctcataatttccttttctctgccttctttgtattacctttcctttatttcagtagagtataaattttttcataaaatctaattctttcatagtttccttctctctgccttctttgtattgacttttcatttttgttacttcttaagatgaattctcaactgatactatattctttatttttagtataagtaaaacaataaatttcacttaaatcttctcttccgttgcatctcacaagttttgttatgcagtactttcattattgtttagttatgttcagtatcttttgatatccacaatcaagttttattagtccaggtatgtttttaagtgattttttacgaatttgttgcacgcacacacacacacacacacacacacacacaccccaatgtttattagtgatttctaatataattgcattataatcagagatattcttagacattttagagactcgcaatataatttattatatatccactttcgtaaaagttccatattttctggagcggactgtatatttcctaattgtcggccaaagaattatttatatatctttagatctcaaaagtttaggtgtgaagtttattttttattgtaggatcaaacaagttaatttagttcacaaccagcctggatgacatagtgagacccggtgtatacaaaaagcaccaaaacaaacacacaaaagataatttaacatggtgaccactctccaatgcattgttttaattagtttttcttaaaaaccaactttctcctgttgctttatttttgtaaatgtctttattgaagagaggcacatcagcaaggaaatagggccacatcctattggagggaattccgagttctaaaatgcacctctacattggcagagaaatgacaaccagttaatgaaaacgagtgtttggcagctgttgtctcctttgcctgaggccgttctctagtgtcacagcagggtaaagatgtgtgaaaagttgtatgaccagatggccatgagatccagaatgcctagaaataaaagttctaattgattctgcaaaagagaacttttaaaattgctataaggctagtcccagcatgatccagtacatgattaaagaacataataatattaaataacagcaaaactcaaagcaggaagaaagattgtcccatgctatcatgtgactcatccacacaacagaaaaggcaaaacacactcagcaaatggaagaatttaccacccttattctggccactcatcacctaaatgaacctaagccattccatctcaggactgtgccagttatcacacttccggctccagttaagagaatggtgggcaaacactggttaaacaatagagggtttttgtaaattatcatttttaaaaaattttatgagaagcctgaaaagtgggaatcctagatttggttaatgccatggaccattggtgttagacactttacttttcactctaccatctgtaatgggctaacctttgcggtcaggtccttccaggcatggttgatctcacatagccacatacaaggatgaggaaaagcctttctttctttctctctctctctctgtctctctctctcccccccctccccctcctcctctgtccccctccctccctcccttcctctctctttctctccctcctttcctctctctctctgtcacacacacacacacacacacacacacacacacacaaatatacaccatcagtgagaagtatcatgccagaatccctaacagattttattttggatcttattagtcaggattagtcaccatgtgctagctacatagaagcctgggcagggaagtctgtgacaggttcagggtcattctggacagctggtcaactctctaagcacagaaggaggtagaggacaattgagtagggcatccctgaggatattctgaagaatgtcagttgagttgtgttgggtttggttttctgtctccctgcaaacagtggcaagcctggaaacttgctttagctcttaaatagtacttttgtacttacttgaaatatagagtgtctaatattttgaggcatttcaatgatggcagccttgttctgtagatgttacagagagataatgaaacactcccactgcttggttcctgtccttttcctctgcccacggcccggtcagagctggaagggtcagtctgagagcaggagcagctctggctactgcaacctttgggcaaatcacttaacctttttaacatggaagtcttcattaaaataagggcatgcatgtatcaagggcattgtttgacttatgtgattatctcgcagttgcttttgccaatcacatctttctaaatacaaaagagttcctcttattgctgaagcacccagctaaaacagagttggtatttctcacaactcattcagtgtaattaaaaacaattaatagatacctactatgtataagatgccaacatgaatagatcatagttcctttccttggggacccacagtagagatacagttattgaaatgtaaatcaatacattaaaatgcaaaacttgtggaaggcagagaagtagcagaaaggagggatgctttgctgaaattaggtcacaagtagtaacttgctgagtttaaggacttttggactatggtctatacaacggaaaaaagtatgggagactttgaatactttctaaccacgttaaatactttataaccaggttattttatagacacaaagtaaaggatattttataaccatgttagaacttgaaaaagcacttgctattttggatttagtttattccttcttcttttgtgactctttatttccagcatcgtattggatatcttctcatgaagatggcataggcctttcaaactgaccatgtccagaaccaaactcattctctgtctcccccaagctaaacgtgtctcatttgtttttggtgcaagttactgacatgaccatgaacacagtcaccaaatagaaactaaggtttgttcatgagacttccctcttcctctcctactacacacatccaccagcatgtacgatgaattctatagtaaatcatttctcaaaatcgtttctgacttttctttctcgctcccttactctaagtcaagaatcagcagtctgtttttccataaagggcctaataaatattctcagttttggaggccatatggtctctgtcaaaattactcacctctgccattgtagcacagaagcagtcgtagacaatatgtaaatgagggaacatactcctgttcctcaaagttattatttctaacaacagattgcacttggcttaagggtcatagtttgcccatgcctgattgaggccctcctcaactttcacctggattaatattgcagcatatctctaattggtcttccaggctttaattctgctctacaatctcgcctttgtatttacctgcataaataacaaatcgaattcatactgtctgtatgaaaagaaatcattgcccataagaaagtgatatttcctagcttgtcacacgtggtcggtccttgcggacttagattcgtgtggctctttgtggcttcctgttccagcccttgttgcttcctgtagtcctcagaaattctgtcccttgcctctccccaaacacagtaacatcttccgtatttcctacatggttgcagttgtcacctcagtgtatgggtcactcacttatatgtgcatactctgtgtgcatgagagtgtgtgcgatttgctacagattttaattaaaaatattatagtcatatgcatgattatatttgtgtgtacttaaatatatatggaagaaatggacaatgacgtgtccatgacaacagagatactgtttccgtgcatctgtatttgataaattcttagtcatcttttaagacagagctattttgtgaagccacaccacacgtccttggggcagtcattgtctctctgagcaccctttgcacatcagtcgtttcttgtctatcacttgcagtggtgtgctggagcttgcttagactggctcaagaaaactgatggttaaattttcaggaattccgtgagtcgcttgttaaattgttgtaacttgaaattaaccatgatgggagtatctacaatagcagatgctacaaaccaggatgtgtttttagggtttattttgttggagaactggttgaccagcacaccactgaatctttccttttctgatcgacaactatgtaagacaatatgcctaatagatacccaatatatagatacataataacccttaatccttagtatgttttagatgactcagtagacttcctgactactgtctttaccaatgttctattagatgagatcaaaagatgcatctttacattgaatttgattttagtagagagaatcacttatttttttaattagaaattaagctgcatttagaaagttaaaaaataatgattactgattttacatttaagtcaactttcaatatgcttagtattaccaattgttactttaataaggtgtttttctgggaacattgcttataaaatactatttatatgtttttgtttgtttagctccaatatcaaagagaaatagctatattgcatgtgctataactgactgtcaatgaatgggtaatttaaaatagcctcagatgcctcaaaccttaacgctaaattcacctcacaaagggaatttattcaatccaaacgccctcctattgcttaaatgaagacattgatatgaagattcatatctgaagttaagatattagtaaatcaaacaatgtaaaattcacgaccatatatatcatacggatttggaattagctgagtgatctacttttgtatatttttgtggttaaatttaagcactatacatttatgagaatgattttctaagaagaaaccccatttattttctaagaaattgcagcctacctttctatgctggtttgttttatgtactactattgacttttcttcagttttatataagatacacagcctagtgaataataaaaaagtattattacatttactttaactcttagcctttgctttgactgcacagaaggagacctttaatttttatatgctttgaaattcatgaaaattgacatttttgcctgacaacttatttctccactttcatatgcctttcctcttgactgaatttagtcttttgtagtgttgcagaggctgtagattaccaagttctcctagattcacagggcagtaactataggcttgaagaacattcaccactaaacctgagtgaggctcattcgatgttgtaagaaatagagggctcatttgttccctctgacagcctctccaggggtgctcacttatgtgtacatgcactatgtatacatgtcctatgtgtatgtatgagagtgtgtgcattttgttatgcattttaataaaatatagtcatatatattattatagatgtgtatatacataaatacatatggaggaaatggacaatggtatgttgtaatgttcagaaatgaacaaggtgatgtaaacactgtccctaaatcttgtttcacagtagagtttccagtagatgacaagtacggtagccaccacaaagggctgtgagagagagggtgcatctctccaaaacaagtattccccacaacacagtgacagtaggctaaaacatttcgaatattttccctgcctgcttagagaaagcatagggctcaggctgtcattccatgttacagtaacagttctcgtttaaattcattaataaacaagcactcttctaaacttagctaatgtgctcttactcctgaaagataaagaaatccagttttgggatgctgacaaagtgagtcttctgagcctattagagtaaaaacagcttaccctagtgtaaggcaactataactgtaagatcatgaatgttctcgagagaccacttaaggacagacacaggctattctgggcatattttaatgtcctttttggcctttctattttaaaacatttcatctttcttgtgtgtggctcctatcattgctttcctaagtttaagttggtatattcaactgttcattcctgaactctatcccaggaacttttttctcccactcttaacagaagtcaagagacataggtcaattttctgtaatttagtaagtaattcagtagcactcaatactcagtatcatcatttatacattataaccattataacatttattctgcacatctaagtttgctttgaatgacagaattaatactaagagaccttgtctcccttgaaaattgatgggaaggaagctttagccagataaatacttttttaaaaaaaaatgtcatcaagtgagagagcctgaaccacaatcccaatgggatcagaacacttgagtcaattagccaagactccacctacctgtgcactagtgatggcccagccaatggaaacccactacttaacatcctggcaaagctccctgtctatgggcactgcttaactgggccatatcctcacttcctctctgtctcccctttctttttatgctttctttgctgaccaagcccctgttcacattctttcctatatttgttaatatattccatcacattattaaaatctaactgatcgtaccgtccagggacacatcgtgtccctcgaagacttgactctattctaacccgttattgttaaaattaactttcaaagggcaattagcatttgtaatttcatgaggaatagtcaaatagcctgaaagtaatatcaacaggctctctctatttagaggggcctcactgagaaaaggtaaagaatttcccgttttaacccatgatggtgtttgtaacctagaatgccatttttacagcattcaaaatggccagtttcaaggtggctgacgtggtttcggtgattcatattatcaaaaaatgtctgtcttactagatttttttaaccagaagttgatgtagttttaaattttttaaactgccatttactatgaattttaggtaggtgcacaaataacctacagctttgaactttctgaagtaatattttcatactttttacttcaaatgtagaataattttttactggttaaattattttgacagcttaaacccaatgaaagagtatatgtgtatatatttatgagaacattgaaatactgtttgagagtaattatttataacagagacttctggatttgacaaatgttatcattgtcttgagaactgtttctagttgtaaacagtaaatagataatactgtggtcagaaactttcctggaatttagtagtgtttgtatgaactgtataccactgagaaccagagcagggagaactttagtttattatacttgagttctgttttttctgtttgttttttgcttgttggtttggtttggctttcatcttgtaaatagtaaataattatatttcatctagcacatttttatgtatagaagatatacattggagatggaataaaaatataaactgccaatattttacttatacttttgaaaagatgacttgttacagataaatttatcaggaaaaaaaaagcaaacatagactgcaaatccctttgttttatgtgtcttcctaacagatgatgggagtttagtctaaagaatagaaagccatacggacaataaaactcattcacagagatgaatctcgaatatttcaataatattgcatttggattggaaactgtaaacaaaccttcagactgcaattcaaattttacttttattttttttcttacttaaacatatgtacattatattcctatttctcaaaaatatgactaggaaggtaaaaagcaactaacgttatagccttcttataaagaaatttggccctttatgagttcaactaaatagctaaatgtctacttttctatttgtaacatgtttttttcactgttaccagtaaaaagtcatttatttataggcctctttagatatttgtatttttcttcaaccacaatttaaacattcatcttcaaatcttgcctaccattgcatttatttgaaatcgacacttgtgttttagttcatttttaataatctgaaccaaggcttctgaatcatttatccatatggttacatagtctaggttatcaatgcctgtgcatatcatactgtaaagtgctttgaagatgtgttcatctctaggtgaagcttgttggctgatggatttattaaatgatttgtgacatagcatatcccttgttctacccccaaagtcttccattgagacagtatgcttcctccagaggaggagccggtagtctctggctatattctggaaacataggaaaagaggaatttcccttttttcttttgaggggcccttttcctggtgttgccttaaaatatttttgtcacgtcattttcctcagtagcagtgagcgttactgggtcagagtgttactatacactcagtaatttcacacatatttactcagttcatccttgatatgatttggctctgtgtccccacccaaatctcatctcaaattataatccccacaggttgagggaaggacctggtgaaaggtgattggatcatgggggcagtttccccgatgctgttctcatgatagtgagttctcatgagatctgatggttttatcagtggtggttttccttcttgctctctctcacctgccaccatgtaagacgtgtctgcttccccttccaccatgattataagtttcctgaggcctcctcagccatgtggaactgtaagtcaattaaacctctttcctttacaaattacccagtctctggcagttcttcatggctgtatgagaatgaactaatacaatcctcatgatgatattatgaaatagatactattattttctctatttaagagatgatgacaaactgtgagtcacaatttttaagtaactcagtaacacaactggtgtgatttgtgttactgcaaattactgtctgttttacagtaacattggtaattatgccattttcaccccgacacaatttcaaacacacccttccccaccaaaaactgaatccaattgagattcccagttgcagattctctgataattactcttgcaatcttttagggaggaacagaaggttacatggctgccttgagtggtgtagggggccccagccaatctccaagttttatcttctataccttacattctgccgcttttcatgatacattctgcctcttgattttgagcctttctggcattgagtggtgtagctcacctcgcacagatacctctccccacaagtactaaagtagtttttcaccatttccattttcacttctcatggacttcattatctttaaaaacttcattgaaatctctcacccaacagttgtactcatatttcgttgacgtttcagcctttatactttttaaaaatcagttcactcttactttggtgagttttcagaggcagaggaagcagaactataatcaactaatcaagcccctttgagccagcagttcttccaggtttgtgattcacagataccctggaagaattgatgaaggcttctatcatctcccctagaaatgtgaagacacaagatattctgtatgacattggggctgaggatagcttttgtggttgggaagaagtatgataatgtgtggagttttcccacatatatttaggaactttactcttttattaaaaaacaaattaaaagttgcatctgttaaattttctcttacaaaaacatttatggattcatcattaaacatacatgttttggaagcttagtatttatcacgtttgtatgataactcggtagtgagagcacagagggcagtcccagtgttcagagagtttatggcagatagtcgaaggagagaaatgaggaacaaggaagtataactgtgtgacaggagactatcatacaacttatgccctgggtgctactgaagcactgaggggagggacctagcatttggagtaagaaacagtcatcagggaaggtttcatcgaggaagtagggttcatatgttttgaaaatgttatctatttgaacactctgttatcaggtacagacatatttagaatttttctaacttgtagtgaattttaccttttttcattgtatactaaccttccttatctctcagagcgcctttttccttgtgttgtcttaaaatattttttgacacctcatttttctcagtatcagtgagttctctgtgcttcagagtgttattctatgctcaataatttcacgtgtatttactcagttcatcctcataataatactatgagatacaaaccattatttcctctattttagaggtaagaaaaaacatgatgcacaataacttaataacacaactggggcaataaataggatcaaattcagacaccagcaccttgaagcctgaacctctccacacagtaacactactgtatattacaaatgatctcaatacgtttatactatagcactaagattggtatatgattgtaaccatactaattttctttttcttaaaaaagttgtatttgccttagttacctttctcaattcttttactttcaaattttcttagttcctgtgtgttagacatgcttctcagaaatagtattttgctagatttaagaaaaaatcaatagttctgtcttttcagtatagtatttcttaatatatttctaccatcttattttgctttttctttttgattttcctttattccttcttctccccccccttttggttgatcaaatatttttaaaatatcgatttcccctacaattgctttgaaatgtatgtatgtcatatctagtattttagggattatccttattttttttcaaaaatacttattaaattccaacatagcttaagatcttgatctttctcctgaacataatcctaatcacagtatttgaaacttacttctaatcacaccctatcatgctatagtctactttttgtcctgagttttagttctcttttttaactttaatattagtcattatcacttttataattttagtttatgtagtcaatatagttttagattttaccacatttgcatatttcttctgttattatgtcatcttgtatttctctcttttctggacatagttccattctttgacacacatcctttagtttagatggcttttaatgggaatgtgttggtactaaggtgcttctatttttacatttttaatttaaaattttttcattttttgtttttctgaaaatatcttaattttaccatcttccctgtttatttagcttggtatacaagtctatgttgaaagtttagtttctctcagtactttgagtatattatcctactaaattctaccttttgttttcacttttcttaagaagcttcctgactgttttaaaattgttccttagggatactctctcttttctcccttgctacttttatgttccgtggtaatgtgctgttatagcatgctgtgtttagtgctagattacctttataaaaatgtttaattgggatgtattgtcctttctgaatctgaatttttaaatgttctggaaaattcttagatgttacgtattttaattgattctccatcattctcccttttctctcctctgaaattctattaatattgttccaaaagtaattacagtttttgtcattacttttaatggcaaaaaccactattacttttgcaccaacctaatacgttagaactcatttttatactgtatattgtagaatttatatttaatgtttctaagtttttttaaatttctgaatgacattgtcgatattcaatctacctttcagtttacaaactcactctgtagctttgtctcatctgcttaatgcaactaatgagaggtttttttctttaaaaaaatttaacttatattggtatataataggtctatatatttatgggctacataagaatgtctaataattatatcagggtaaatggggtatccatcacctaaagaattcatcgtatacacaacagagtactattcagccatataaaagaatgagatcttgtcatttgcaactacatagatagaactgaaggacattatgttaagtgaagtaaaccaggcacagaaagacaaactatgtgcgttctcactcatttgtgggagctaaaaattaaaataactgaactcctggagatagttgaatgatggttatcaaaggctgggaaggatagtgggtaaggtgggaaatggtgacagttaacggttacaaaaatacagttggatagaatgtgtaagatttaatgtttgatagtacaacaaggtaactaaagccaacaatattttattttacatttaaaaataactgaaagagtccagttagaatgttcataactaatgcgtttttaattccaataatatatttttaattcctggagtatccatttatttccttatcaacaatgactggtaatttttaagtattatttgatatggtttggctgtgttcccacccaaatctcatcttgaattgtagttcccataatccctacatgtcgtgggagggacccagtgagagataattgaatcatggcagcagttccccccatgctattctcacaatagtgagtgagttctcacgacatctgatggttataagggactttccctcacctttgctctgtacttcttgctgcctccatgtgaagaagggtgtgtttgcttccccttccgccatgattataagtttcctgaggcctccccagcactgcagaacagtgagtcaaacctctttcctttataaattaccagtcttgcctatgtctgtattagcagtatgagaacagcctattacagtatatcttattcttttcttgtatatttaattctcattttacttcaaataatttatgaatgttttatttctcaatccccaaatttagctgaaattgaattcatgggggccaaatattccatgcggtgtttctgctgaattctgttcattatacttgttttcttgagttttatatttttggattgtgagtttaaatttttcagggctttgtcattagtaatcctataattccagagtgaatccagagaggggttacactttatttcaaaagataccagcttggaaccattttttctattttaagttcttgatttgggggttatatccaatagtcagtgtaaattcaaaagctgtaatttaattcagcaagtttatggcttatgcattctcaagaatcatcattttttttggaaaaagataaaatacagacaaatttccttgtcatccctctttgctgactagttaatttttctccagtgtctgctttactgtgaatttagcatttttaggttttatgtggtggggctaggggcgtgagggagttcctattctttgcacaggtctattacttgatttctaattctgtttggccttgaaatccaaaattctgcattgtaaagattagtaaataccctctgactactatagcccaccatcagctaacaccctgaatttcagtgttctctttttttcttgatacccaaaagcttctcctattttactggatgctcagatatataacttaaaagatgtatgttacattttatttagcatttctaggtgtttgaaactggaaaattttcaggctcccatgttgcctcgtcctaggaaatgtaatccttagagattattgtttctgtttcctattatgtgatgtgacattacagaatgttaagtattttaaataaattatcttatatcagaaaatttatgttataaacttttggggtgcagttaatattttagaaatgttttcagatacaaaaagccatgttttaaaatatctcagaatagacattataatcttgaaaaaaaaaccctgatttttattgaagggttttgttatgaatgaaatttggaggtgctcttgtagcattctgcatttacattctagcatcacgcttcatcaataaacatgaagacatttgtataacatgtaaaaccatcttatttataccaagtgcagaaaattgaaaagcttctaaagattatatcaagaggaataataataatacaaacaataacaaacaccataacaacaaagaaaagaagaagcaggaggaagaatggcagtcacaggctcctattttaggccaagcacactcctaagcatcaaagccaaaaaaaaggcagaaaaatgttaaggtgacaaaggcaagagcccacgctacacaaagcatttcttggctcgccaatttcaaagcaactcctgagatagagcctcacaatctggctttgctattgatttgaagttaatatcaaattaacagaataccaaaatatatagtcatatatagaagcattccaaagctaaataaaactgtgtttgatttcctactagttgggattgtccctatcatcttaatgcagataattgtgagtctagtttatatccatattttacttttccatctgcaatgatactaatttttttaatagcagagccatcccccatatgaaagtatttggaaaatatatagactttcaaaatgacaatatagacgagactaagaaattattttctgggtttttttttgttttttaaatagagtgaaaaacgaatctctcaaatacaaaatatttttaaacgtgagaaacttgcacgctactccctcaaagctgtctaattcaagcaaacactaaatgacactggcagagctgattgagcagctgctgggtgtcagtcactgtactaggggcttttaatacagtgttttatttaacagtttacaaaaaccataggaattgggtattattaattcctgccttacaaatgaaaacactggcgttaagacaggatgagtgagttagtcagggtcacacaaatacatcttaaaccagttctggctattctgcagcccaagcttccaaccaccggcattgtatttttcagaatattgtataatttcatagtaattaagcaaatgtttacacttataagaaaaaatcagtaagacaatattattttatgttatgactgtatctgccgatgttttagatatactagcagtttgtggatataaggaattaaagttatctgatgtaaaaattatttattttatatttgcattttctctatttatcaatacacaactaggtcatgaaaaagactatgtaaaaaatatatgaaagtgtcaaattattcagtttgttcatccttttattgtggcccctaggcaacgatggctttttaaatcattttgtataatttgatttgcaaattgctaagtatcctagtttgtcaacatactagtctgcttctctaatttcttttcaattttacgttcttgtaaatctctttacgcttattaaaagatactcaaaaatatcactatcttttaatgttaaaccaactttagtataaacatattttatatataatgagtattatatgaaaataagatgggaaacccacaaatactattaaaaaacagttgctacaactaacacaatatagttattataaatatccatgtataaaaataacattctaaaccttaaatattatgaaatattctagctaaagtataatttaaaataatatggctactctaaatggtccaataaattataccaaattaattttcattaaatcaattaatctaataaacatcacttttaaaaataagtattttcttgtttatatatggcataataatttgtaaatcactacaaacatattttgcatttggaaaaccagatcattagagggaaaaaaaagatcctgggcattttcaaaattcctgagtttgttttattaaataaataaaaggctcttgaacaggagcataacaggatcagattaatatttttgatagagacacctcaaacttcaagccagaaacaaattggaagtggacagtagaaaatctgtggtagtctgggctcaggtgggaacgaagagaaagagggctattcaacaggtagaattaatatgatatgattgtgcattttgcagagtgaggatggaagtgccaggatcaactcttgattgattaatatgcacaaacttattgataaactgaagctaagactttttgagtgaccagtgatatagagacaatgacagaataccagcaatatcttgagttttgaacatgagtgcaatattaaaatggaggagtcaaactaaactttggatatattagtgttgagttcagaggagagagctgagacagagatatgattagagacatcctcccatagttggtagttgaagcaatggctttggataaggtctttattaaggagaatctgccaagaaaacagaagtagcctaggacaagctttaggaactctctcacttacagacgaggtaagagacaagaagtcagtacaggaggttgaaatgtgattgtcagaaaagtagaaggaaaacctcgaatgatgtagtacattgtcagccaaagaaagataaattatcaagaagagagtggcaccttctcaaactttttaatactgccagtttatctactcatatgaatgggcagtaacattgtttttaatcctattatattactctttctgtagtttatcttcctaatgagattatagcattcctgaggacaaaagcaatatagtttaggtgcttaataaatataaacaggattgaaattgccaacactatttttatcctagaaaaaaagtgatacttaatattacatcttcacttcctttaggtcttggtgtcagttctcttatcagaaaggtctctgaccggcagtttaatatctttcctctctcctggctctgtatccgccttactcaatacatttttcttcataaaaattaatgcattcattcaagtgatcattcacctaacaaatacagagcggtctataagtctggaaaccaatatatattatgttttaaagaagatatttttatcactattttcagacttaataaataccttgtatcttgatcttctctctgatatcatatggattgttttagataagtaaggtggtgatttttaaggtttgtgaattttgtgtcaacaaatatttttaaaaagatacatagtgctgcaataaacgtacatgtgcatatgtctttatagtaggaacagaaacccaaacaccacacgttctcactcataagtgggagttgaacaatgagaacacatggacacagggaggggaacaccacgcaccggggcctgtcggggtggggagcaaggggaggggagagcattaagacaaatacctaatacatgtggggcttaaaacctagatgatggattgattggtgcagcaaaccaccatggcacatgtgtacctatatagcaaacctgcatgttctgcacatgtatcccagaacttaaagtaaaaaaataaaaatcgtttatgaatcattgattcataaaatgaatatactagaaaaagaaaataccatattcagaagtgcatacacacaaacacagcccccccaacacacacatatgtaactaaataaaccaatgcagataattataaattgtgacaaattctgtaagaagaaattagtagttgaagatctaaaatgaaaaaaatttatagaaaaattttaaattgactggtctgggagggcctcttggaaggtgacatttgaactgacctgaatcatatggataactcagccatgaaaagtacaagtgagaaaaataggaagaaagggtttggttttcctgagatgcatagagaagagtatggctgaaacatggtgaccaaggatagacatcttaagtattcactctgaaaactagcaaagtagccacacaataacatggcagaactattgctaaatatgatagatttccttgaagagtaaagtatatattacagaaaaagtgaaactcatgtataattttcttacacatatttaatggtttaattcatattgttttaatttgtaaatttcagaagagggatgctctaagtgggtgaatgtatcctacgatttttagggttagggatctctctatgcctaaatctgcctaaaagagatgtgaatttaccttgcagtgagagtcaggagtcagaatattcagagtctttgaaagccacagaagtcaccctggtttgatcatatagaatacatatatgaggatcaagtgtaaaatgctactgacaggtctagtaagagaaagactgaaaatgttctttagtggcctgaaaattatcagacactatgaagagcaatctcatcaataatccatagaggttgaatgcataacaaggtggaataaatgtaatccaaattagagctcttggatgacagaatttttagcgttaagtgccatttcagttggaacataacattttatacaaatagtttttattttgaaacaatttaaaacttaccaaaaaaattgcaagaaggataaaaaggccactactgtacccttcacccagagacctccttcaacgtttgttacttgtttgaaaatgtccttgtattagtctcttttcacactgctgataaagacatattcatgactgagcaatttacaaaagaaagaggtttaatggacttacagttccacatggctggggaagtctcacaatcatggtggaaggaaaggaggagcaagtcacatcttacatggatggtggcaggaaaagagagagaacttgtgcagggaaactcccatttttaaaaccatcagatctcatgagacttattcactatcatgagaacagcacaggaaagacccatgcccaagattcaattacctcccaccagattccttccctgactcgtgggaagtgtgggagttacaattcaaagtgagagttgggtggggacacagccaaaccatatcattccttgtctggccccttccaaatctcatgacatcacatttcaaaaccaatcatgccttcccaacagtcccccaaagtcttaactcatttcagcattaactcaaaagtccatagtccaacgtctcatctgagacaaggcaagtcctttctgctcatgagcctgtaaaatcaaaagcaagttagttacttcctagacacaatgggcgtacaggcattgggttactagagctgttccaaataagagaaattgtcaaaataaaggggctaaagtccccatgcaagtccaaaatccagcaaggcagtcaaatcttaaagctccaaaatgtgtcctttgacttcatgtctcatatccaggtcatgcagatgcaagaggtgggcccccatggccttgggcagctctgcccctgtggctttgcaaggtatagcccccttcctggctgctttcaagagctggtgttgagtctgtggcctttccaggcacacagtgcaagctgtaggtggatctaccattctggagtctggaggatggtggccctcctctcacagctccactaggcagtgccccagtagagactctgtgtggggcctctgaccccacatttcccttctgcactgccctagcagaggctcttcatgagggtcccatctctgcagcaaacatctgcctgggcatccatgcatttccatacatcctctgaaatccaggtggaggttcccaaacctcaattattgacttatgtgcacccacaggctcaataccacatggaagctgccaagacttggggcttctgttctctaaagcagcagtccaagctgtatcttgcccccttttagtcacagctgaagggactgggacacagggcaccaagtctctagactgcacatagcagagggaccctgagcccgacccatgaaatgattttttcctccctaaacctccaggcctgtgatgggaggggctgccgcaaagttctgacatgccctggagacattttccccattgtcttgatgattaacatttggatccttgttacttatgcaaatttctgtagcaggcttgagtatctcctaagaaaatgggattttcttttctatcacattgtcaggttgtaaattttccaaacttttatgctccgtttccctttaaaagctgaatgcctttaacagcacgcattcacccctcaaatgcttttctgcttagaaattgcttctgccagataccctaaatcacctatctgaagttcgaagtttcacaaatctctagggcaggggcaaaatgccacccgtctctgctaaaacataacaagagtcacctttgctccagttcccagcaagttcctcatctccatctgagaccacctcagcctggatttcattgtccatatcattatcaacattttggtcaaagccattcaacaagtctctaaggagttccgaactttcccacattttcctatcttcttctgagccctccaaactgttccaacctctgccgtcaccagttccaatgttgcttccacattttcaggattcttttcagcagcacctcactctactggtaccagtttactgtattagtctattttcatgctgctgataaaaacatactcgagactgggcaatttaccaaagaaagaggtttaatggacttacagttccatgtggctaggtaagtctcacaatcatggtggaaggcaaggaggagcaagtcacatcttatgtggatggtggcaggcaaagagagagaacttgtgcagggaaactcccatttttaaaaccatcagatctcgtgagacgtattcaccatcacgggaatagcacaggaaagacccacccccatgactcaattacctcccactcggtttgtcccatgacacatggaaattgtgggagttacaattcaagatgagagttggatgggcacacagccaaaccatatcagtcctttacagcaaaaggacccactctgggatcacatgtcacaccctgtttttctgattctccagtctctaacaatcataattatatcttcactttagtaatttcttcactttcacaaccttctcattcttgaatattctatcccagtcatttgtcgcttgtcctgaaattggattagtttgatgttatacccagccttgtatttttgacaggtgtcttacacaccatgctttattcttctcattgaatctcatcaggtggccccccagtatcaattggtcctgttactcatggtgataacattgatcacttgattataaaggtatctgcctggtttctccaatgtaaagtgactgctctcccctttgaaattaataaacatatatatttttaaaattggggtacttggtgtatatatttatgaggtacataagaggttttgatacaagcattcaataatggggattggggtatccatctcaaacatttatcctgtgagttacaaacaatccaattacattgtttgttattttaaaatatacgattattattgactgtatttaccctattgtgctatcatatagtaggtctcgttcattagatgggggtggtttatgagttttttaaaaaactatatttttaaggagatagtttgaggctatgttctgcttccaactttcacccacttatttgagcacctattgatatgccttgcctgaattaattattaacatgatggtttccaaatggtgactttcttcttcctacattcctgttacatgtattacttagtgtagtgctattggaggagctttctattttccctgtgtatttattcacttttagacaggcagactcttggattcctactttattcagtaggatatgatctgtagcttcctctttttttctcctcccttttttattttgatattcaaaatctctttttgatactcaaattatttattttgtatgcaaattgcccttaatttgaggagcagatgccatttcaggctggctcctgtgtcattctgacatgaccccatcattctttgggcacttcattactttttggtgtggcaaaatgttccagattcttactgtactttccctaacacagcttagaatcagtcatttctccaaggagtcttggttttgcccagcatagaaaccaggatctgggaaacagaactattcattgctttgagagtgaccctgtacgtaggctgtcttcagtggatgataggaaccatctgtatattgaccaaatatacaatttcattcatacttatttctgtatctatctacatatagtgaaaaccacaaatttacactaattgattaaatcctaatgcaaacccactgggttcattctgtctttttttttcttttcttttttgagatggagtctcgccctgtaacccaggctggagtgcaatggcgcaatcttggctcactgcaacctccacctcccaagttcaagcgtttctcctgcctcagtctcccaagtagctgggattacaggtgcacaccaccacacttggctaagtttttgtatctttagtagagatggagtttcaccatgttggcgaagctggtctcaaactcctaacttcgtgatctgcccacctcagcatcccaaagtgctgagattacaggcgtgaacattctttcttatgtttcatatgtgtaccctctttctttgacgttgggaatttgactctcactatcctccatgtatttacttatttgcccaatcaacctgtactgtaaccaatctcccagccacatggggtggagatcctgtgtggacatcctctgtgcacaggtcctggacaccactagactctcttcccctggactactctatcttcctgcctgctgggaccctagtttttatgaggctgttttcctgcccctgctcaatgggtttttgactaagttattcaggaaggttgagtaaacagtagagattagtagacattttgttattcaggaaggttgagtaaacagtagagactagtagatattttgtgcaatctgccaagatcaaattgaaaggaagacagtaggtggttttaaacatccttaaagcattccaccagcctcccttggacctcccaaccttcccaactttaaaaaaggcagagagaagctttatatgcacttggttttaaacatgtcaatttttcaaccttgttgtccaccgtttgctttttctgtcccatcagatgaacattataacttacaacaatttaggttgccattttaatgtcaaaacaaatatcagcaagtttttcactgatgtatttctgaattaaaattttaaaaccttgaaaatgcttgtgttttctttgtcagcaagaatagcaatatactgagtggacttcaaatcaagtatgaagtttttatatgcaagtcttgaaacagaaatttcagacatgccagtgaagtaatataattacaatgttcctggaaagaagaaaggtttccagtgcatggaaagtaagatgcaattgagactgacaagattacaattcactgtgggtgttttaacacattgtcagattgtagaaaccagttacaatgacccatgtatagacattgtattttttattccaaattcatagaaattcaaagatataacaaaaatacgcaaaaattttaactttatatttttactaacttgacaattcgttacattcactttatttccattttatagctattcatttctgaccctcaaaatgccagctgcaaatttatattaccaaaaaatcccactgttaatctaagtaggttaaatcctgagctttggagtagtcactgaaggtatcacaaacactaatacactagtatttttactgaaatttcatttgttcataaagagaacaaacacagaaaataaataataggttctcctctgtttctaagggagttaaaacagcaggaggttcagtatcagagatccaacatctttagctcattgttgactaagggaactgtcaatattccaccagttacataatgtttcacaggtgtgagtaatcttcaggttctaattattaaaactgatttgagattataatagcaggatgtgtttgttatactttgtattagttatatattgctgcatagtgcattgcctcaaaactcagtggctcaatgtagtaataatttattatctcttacttttctgtaagaggccagtaatttaggagcagcttggctgggcagttctgacttgatatttcttataaggctgcagatacatgtttcctagagccacaatcagctgatgacttgactaggattagaggctccatttcaagatagcagactcacatggctagcaagctgctgctggaacttggtaataggctttagttctcctcctaggtgcctctccatcttactacttgagggtttccatggcttttaggctggcttccctggagtaagggatcaaaagaccaaggtgcagcctctaatgcctttatacttaaccttggaaatcatatcaccttgttactactgcaacattctgtgtcacacggagcagcactgattgtgtgggagggaactatacaggccgtaaatattaggaggtatttaaaataacataattataatgtgaagatttatggccatcttggagattgattgccggtgttcaccctacagcccacagagatacatatctttttccacacacgaagtacacccaacctcctctaaaagccatccaaagtctcattccactaggccatctgctcaaattccaggacctcattgtctaagtcaagtcaatccaaaatgaatctcagagagtccaagagaaaatgaagctgtttaggtatagtcactcaagtaccacttcccaagtacagttgtcaatcttaagacctgtaaacaagttttgtgccatcctcacaccacatatacaatggtagattatgcacagagaaaccaaattagactctctggttcaaaagtggagaaaataagagagacaagtcactggtccacagcagttttgcaatccagtcaggcacatgctggtcattcttgattagaactcagtcatgctgtttcccggacatgattctccatggctcttggctctgccctctgtgttagttctgccactgtaagtcatcctttttttatgtatatagaggttgtctatgtttacagctgcatagactcctgaccataaagtttggaagtcaaaggcctgtttctattttgtcccaactctgtccctttcagtacaagctggtggtgttacctccaatatagttatcttaaaaatgaatgggttttctatgaattttattcaggtttactccacttaataaaaggcacatccacaattatataaagataagctcccccttaccccttgagcttctgtagatctacagaaggaaaatgcttttaagataattagaatccctattgtttaactgaaaagacctgtaaagcataaaaataagctctttagagggtcttctgtctcatggagtgtctccctgaggaatacctaataattttcttgggtctttatgtagattttatagtcacgcttccttgtcatccttagatcatgttttcctggaatttgatctttgcttagaaatgtgatttcttaatgtttgcattgttcaccatctggagagattggaattgaaagagcattttactttaaaattcagtaatgcctggcttcttcatttgtaatagttcttctttagctttttctctcccattttctttttcttttactataaacagaagatgcccgatggctccttcaatactctacctggaaatgtccttagctagattatacaatttcatttaactgtatctttttcttttccatattatcacaagaaacaatgttgctaaactttccaccagaacatagcaaagatctaattttctctaatttctgatgacacttttctcaccttcctttaagtcattacagctcctcaagagccatcacgcttcttttaaggcctgtcccgctaacttgcatattcctgtccctaaattactgccacattttcaggtttctgttataattctctgccagtatcaaattctttttttttttggtactaaagtattttattctattttattttatttttaatttttatttccataggtttttgggggaacaggtggtatttggctacatgagtaagttctttcgtggtgatttatgagattttggtgcacccatcaccttagcggtatacactgaacccaatttgtcttttatccttcacccctctcccacctttcttccctgagtccgcaaagtccattgtatcatttttatgcctttgcattctcatagcttaactcccacttatgagtgagaacatacgatgtttggttttctattcctgagttacttcacttaggataatagtctctagtcccatctggattgctgtgaatgccattaattcatttaattttatgactgagtagtattccattgtgtatatgtataaaaaagccacatattcatggcagcacaattcacaattgcaaaaatgtggaaccagctcaaatgctcatcaatcaacgagtggataaactatggtatatatacaatggaatactactcagccataaaaagtagtgaattaatggcatttacagcaacctggatggcatgtccagacatcacattctttatttgatatctattgttgcattatgtgtcaccttaaaattaatttcaaacaatgatgaatattcattacctctcctgggccactccagaagacagtgtatgacatggtgatgacttgccacgaagtaagtgatctcagagaccaagttgcagagttttctattgttcacagaagtcaggcctaattgattatagaaggggacaacaaaagggtgtgaagtcaggagccaaagattaacgatgtccatcttggaatattatggagagaaaaaaattaatgaatatgtagtattttgtcctataattatcttctcctagaatatatctcctattggaaaataaaaggacttaaccacttcaaacttcaaaattaccaagatcaaacagaacattgttataagcgaatgatgaattcttgttttacaaccttaattatacccaatttgtagtaatcggtatttatgcagctgctgtgcttcagagcagcttttattttcacacatacatccattcattttgaaatctttcaaagctagtgtggatatggtgagactcccaattattcaaaaaaaaaaaaaaaacagaaacaaatgacagtcttcttaagagtggtcagtaagttacaactgggtgttttctctctgctaagtttagacattacactctattcaattttatcttgattaaacaattgaaaatcatgtgtgcacgcaactggtataaacagatcatttacctaatatcagcatttttctgaagggactaagtcaatgcgaatgaaaaaaatgtggttgactagaaaatacacatacacacacacacgagccatatattaacattaaagtagagccttacatggattttttttaagtcaagaagttaattcaaatacaatcttatttttatacagtactgtgttaataggaaataatatatacctttgtgattaatccttataggagattcaaatgacagttattggactttaaatattgtaatccattaatgaagagaaaaagaagatttctgctctactaaaatactatccttggtcaaaaagaataggatattttgaaaatgtcacttaataactggtatggtttggctgtgtctccacccaaatctcatcttgaattgtagttcccataatccctgtatgtcatgggagagacccactgggaggtaattctatcatttcataatagtgagtgagttctcatgagatctgatggttttataagagtctttttccccactttgcctgacacttctccttgctgctgccctgtgaagaaggatgtgcttgctttcctttctaccctgattataagtttcctgagccctccccagatattctcaactgtgagtcaattaaacctcttttctttataaattacccagtcttggcatgtcttttttaacaacatgagaacagactaatataatggccattttttgtttttattgaaaattcacttttatccatttaatggaactttggttccatcccattttatataaattgtttgttgttacagatataatattagatgaagtgaatgtgtcaataacttcagatttgcaagcagacaaattagtacagtttaaatttgcccagtaggcagatttggtatggtgaaccatatgaaaagtagaagctctggggactttctggagatacttaatgggattgaaaaatatcattttcttatggcctacaaattttccatccataatgggtgtttctatccaattatgcatgtttctcttaaaaagatataatagtaattgattggtggtgatctcttaaagttatttagcaataaactcttaatgtctgatttcaaggttggtgtgggcattctatttcctaatagaatcaacagtattgtgtgtgtgtgtgtgtgtgtgtgtgtgtgtgtgtgtgtgtttactcttgttatttactcttttaattttagttctatctgttattatttactagtatatataccatattatggtattttatatataccatattatggtattttatttataccatattagatagtttgtagaagatgtatattcaaagtagggtggctgacccttatgcctaaatttatttgcttctaatgttcccttagattttataaattaaaaaaaggcatctataatgcaaatatctctttgtaatgagttacacactaatctactttatttcataatagtaagtttggcttatttgacatctgaataacaggcaatagggaattaagaaaatagaaataaatatcaaagaaacaagaagaagaaagttggatagttgggaaagttctaaagttttgtgtcctaatctctgagggctggctcagcagagaaagaataacagtgagtctttgacagcagagggacagaaagatgtgacagtgagaaagatgatgtcaaaagagaaaatttgagtgacagtagaccccagaggcaaacatttacctggtaacccattacaattcaaccctgacttcttcctctgtaataatctcactttctcaaaaaacttcctttttctacactgaatataacatcagcaaggattaaagaaacagtagttggatgtgatggctgtggccaggtagaatacccacaagaattttagtgaaggttatactgtacaccagatttacattcccatttcttctgtttcacaggttttctgaaccagatgaataactcaagtcactctgtccttcagccttcattccaaggatgcatgcagctcattcaagtggacgatcaacttgtaaatttatacgaagtggcacaaaggaagccgggaagtttcgcgaatgtcagcattgacatgtgtgcgatcatagacaggtaaatgatcttttcatcctacctcacgttgtccaaactttccaaacctgtgtttctgttgtgagaccagtgaaacatcccaaaagaaaattaaagttaaaaacaggtaaggtggaaattaccattcaaagtacgtattgtagtatacttgtgatattagcagtgattatgtttatgtttttatgtggatatatatatcatatatctatcatgtatatcatatatagcatatatatgctatatatgagatatatcctatatgtgctatatgagatatatcatatataacatatatacatatatatgtagcatatatatgtatatatagcatatatgagatatattgtatatatagcatatatatgataaatatatatgagatatatcatatatatatatagcatatatatatatatatgtgataaaacacactgtggtgttatatttgttcaacagtctccaatcagagaatctgagccttcaataagtagttttgcaagcaacagcagtgtggcagagaaactctgacagttgatttttagtttacagcagaaatgtgccttctctttctgtctcaatcatgacttggcctcagcatgtgccttccaaaacccgcttctgaaagaaaaggaatattacaaaagtgtcagtgtgcaagatgggtatttatgaagcagaatatttagagtaactggttcagcttacaaaatacacctattaaaatatgacaaaaatcaaatctttattggttttgcaaacctggggagaaatttttaataaaaactttaattgtattctcacacagtgggaagatgcaacttttctgtgaaatattatgattatactgcatacactaccttaatatacttctagatagggcctgtcattccactatgaacaagtttcattttgagatgctttgtctgtaaacaaattatatatgatttgaagttaacctagtgaatttatatgattttctaagatatattgaagtcttttgaggaagaactgtcttatcctaaaagctcattttattaattttgtgtttagggaagatgaaagttctttaaatttttttaaaattttgaactaagatattaatcctatctcagtctacccacaacaaaatgtagaccataagtctttaacaaatgtattttattcaagaggaaatactttaagaagtcactcaaaaatgaattttacaaacatataaaataatctattttgaagtaagtttgctttcataaaatctgaataagatggcgttcgtgtgaatggtaagttacagtttgtggtggctgtaagatagaacttctataaagccttcacatgtttataagaagactttatgacatagtatactgcttatttctattcatgtatgcaagtactgatcttagtagcctaaacagtttatatttaaatagaatagtgaacaattttaatggaaatatactcctaattattgagccattaataatgtatcagctattatttctgcctagagcaagtagcagcaataatcagaaaagctgagatgaatgttttaaagatcatttgttctgattttagataattatctacatattgttttgtacagaaaaaaatattttcttcataatagttatggagttttttagtatctactctttttttcaggtcagtaattgtgatgatacaataatttcattacctctttcagcttggtaaaagggctaggtaatatgttgctgtttctctctaaacatcgtgtttctaggcattatatataaattgtttgctactaaagaaagaggggtgatatgttgagatattaatgttttactctgatagagacaggagttaaattggtcccaaaagaatgaatgggattttggtaaattaataaaatggaaggtgatactcctggtggggagaccaacacaagggaaggtatagaaaagaaaatacaagtttcaatttttcacagatacagagatacacaaaatttttttttttttttgccaaaataggtcaggcccaatattcatcttgccaagtttcctgcagctaaaagaacaaagttcacacctttcttattctttaggatgacaaatgaaaagattagctgcagggaagtagccacctgtgacacatctccacgcattttctaaacccattatgggacctatttttagcttacactttttttttaaggcaacaacatctgtacattaaataccaatgtgtgaaacagcagattcctttagtcacctaaaatgttcccagttcaaaatcttaagcatgaagtgttgtactttcataggtatgagacaggactattttacttaaaccactgaagagtgtattgatgatatcacccttaatctgtgtctttccaggtaaaagtaccagtggttttagtctgtcctcatagagcagtgatgtatccagataatcctttaatgatacacccctagcacatctctgcttctttctcctcgctgagactttgcaactgccccgtatctacaactttcttttcagattacccaaattctcccaaaggaagcctacagtggcttttcttttctccttcccagttccagcttgatcgatttgagagttatttttgagagggagaaaaaaaaaagtataaatgagaacatagggtaaaaaaaataaaagagctacacaagcctgacttttatagaatgtttggagataatagtcacagctgcaatgatttgatgagtagaacttagggaaacaatttgtctgaaggtgtttttctgtgtgttgtattggaataccctacgatttgaactttttttttttttttttttgctttgtgtgtagatttgcatgtggcttattttgttcacgtgcttattttctgaacgcagctttgaatcaaggaaaaagcaagcttgccaagctacagaattatgcattcagtatttattttctgagtgcatactagatgtcatgctattctaggcacttggaataaatccttgaacaggacagataaagattattgaaaattctaagctgacatggtagagggaggggaggaaggagagatgacaaactctaattaaaaagtaaataatctagcaagtgagaaggaataaattttatgggtaaaaatactagaacaaaacaaggaagcctggcatgtcagtagatcaaggtgttgagttgtagtttaaataggttgaccaggataagcctccgttgaaaagataatattactgcaagacttgaaagaggtaactgaatgtactaatgcagggaaagaacatttgacccagagagcacaggcaacgaaagaggcacttgcatgatccaggatcagtatggaagccatggtggcaagtttcgggaggtcaagaatagttgaaggaatagacgccagaacaagccctccagacttgtaggttattgtcagggtgtggcttttactttgaatgaatacaggagccatttgcagcgttctaaatagagcaacatgatgtactcacgtcttaaaaggatgaatctgggctgtgggagcaagaaaggtagaagcaggaggctaactaaaattatgccattataatccaggtgagagacgcgtgtaccctagaccagggtgctagcacaagaagtagtgagatgtggccaattctgaatatattttggaggcagagtcagtagggtttctttacaaattagatgtggggtatgagagaaatggaggaaatagggataaatccaaatgatttgctaagaacagcaggaagaaaggagatgccatctcttcagactgggaagactagttgtagagaaaattagtcaaaggggctaaagaaaaagtcagaaattcaaggttggacatgaattgaaatgtctactggacgtctaagtagaaatgtcaggaagagagttggatatatgtatgtaacaagcctgtgtctgcaggtttacacaataaacctttgtgattgacagaatcccttttgtttaactcttgagggtctttggtgtctttagttacattttataagcaatcatagaactggaaggggaggtggtggataatgggcagaaattgctctctaacaatggaagctgctagcttgattcccttagtgataatctgctcttagagaggaggattgtcatcaaccttcagtttccaaaacattctctgagaaaggtaaaatacccagagataacatttttgtttcttcttgcattgttactctcttttactcatttctagaacccttgcattattgactgcttgtggcaaacatcttaagatgcctgactcaactcttattctcaatctttttctctccagcctctttccaggtgtgaaaacctgagagcccaaaccttcagaaacactcctttagccacagttaggtccactcacttcttccttcaagagagaatcacaaggagaaccatagggcatctcaaagttggggagagggggtgcttggggagggacggacattgagggagagtcagggagggtattaggggatggagtgagtcagtccttgttggtattggctagaattcctaaactcggagactcgctacaacagatctgatagttggcctcagaacttgtgaattgttgtagaattattgtttgacctgtttttctgtggttgtagccaggacacatggttaggaagaagctgatgttaacatattttgagcttaattaagtggtgatcatgcttggtttgacaatttttttttctgttttgtgagtaatagtgaagtccattttgcaactgtggtttctgtttcagtcctaagagcactcttcacagctcagctgccagaggaatgttttttactttatgctaggcagaagcagagatgagacacagttctggctgctaagagctaagcagaagttagctgtggtgttcttgggaaagcttttgttctcctgatacagttgcccctcttgctctccaccatccttggtaaaatgtagaactgatgtctagagctgtagggtcaagaaaaccatagatcgagcagccactgatactaacttgtatgtgaaaaatatcaactatcacttatctaagtaattatgaattaagttttatttttcttggagccaaaagcacctgccctttccctagtccccacttctaaaattaaccagtaccatcattttaccagaatacagaagaacaaattcctaaatatggaaatgactttgaaagaaaagataatactttttggagtgtattaagttgcattttagtgatgtcccctagaggttgaaatctggggactaaatagctgtttagaggccaaagcaaattcatattgttagagccagcactagtaaaaagtgactcattagaattagaatctcctctgctctttcctgtctaactccattgaaaatatattaaaaaatacatttagaaacaaaatcagtaaacatcccagataacacagagagcggaaaaggaaatgcaaattgcccaacttaaacatagcctacaaaattaccacttgagaaattatgaatagactagatcctattccagagttagtaattaagtcttcattatatttttggatgaagtacataatcacagacccagtttttttttaattcaatgctttattttcaagaatatccagtttgatttttttctttcaaagaaaagaataagtaaatgaattttcataagaacatttaaatgaggattaggtagatacatgaaaaatatctcaaaactaaattgactctgttggaaaggcgaatgaaagcagtcaagaaggatgatatggtttggctctgtatccccacccaaatctcaagttgatttgtaatcaccatgtatcagggaaggggactggtgggaggtgattggatcatgggggtggatttcccccttaccgttctcatgatagtgagtgagttctcatgagatctgatagtttaaaagtatggcactttccccttcactcactctctctcctgctgccatgtaagatgtgccttgcttcccctttgccttctgccatgattataagtttcctgaagcctctccagctgtgtgggactgtgagtcaattaaaactcttttctttataaattatccagtctcaagcagttcgttatagcaacgtgaaaatggactaaaacaaaagaggtcatgagtttctacaaaagcaggcttaaattttgcgttcataacttagatgaagaaaacatgtaacatttatcattttctaaaatttgtcttcattcgctaattccctatttctagtcagtagcagaaaagataaatacttgaacacatacattttggtactgtaatcactcctcctttccgtgtatattcggtcaacatgggagttgatctcagtcaaaggtaaacttccttttgtggttgtactaccatttcaagagttctagatgccctagcatggcttgggtcagagtcagcttatgcaatacgttatcaccacaggggtgggatctgtcccacctgctccaccaaggttccctctgagctccctgagagtccccagcctggtcggccttcagggtcccacttctgtccctgccacccactgtcatgacaactgctccttctggccttcagatatgtcatgggtattgctggacttaggttctgggatctgtgtttaaggtgacagctattcccagcatgtctgagtcccatttggttttagcattgagagtcctgcttctggagaaacccctcagttctgggtaaattaggatggttggtgactatacacactaggtcttctttctcctaataccttcgtctgatctaccagccatctaagcattttataggccctatagggacacacagtgatttctatatcttttggagactacataaagctgaaataaatcatggcatatgtgttgttggggagaggttaggcattagggacagcttccttaggctacgccccctttacttcagcatgccatccctccctatctgctctacacagccactcaggctgacatgaggccctctacacattagaccctcaaaggccatcataggattcctaagtctctgctgtataaaccaaatataaaattctaagccatcatactgactgatgaaccctccccttagccaaagacattccaaataatcctgaaaaaaaaaaaaaaaaaaactagtttaggtcagacatgcctcacaaacatcaacacagagaccttaagactgatagaatagtctctttaagtctgataagaaacatctacaatccattctctctgaagactgctacctggaggcttcatctggatgatcaaagttgggtccccatgactgcttatcctaacccagacattcctttctattaattccatgtctttaaataataactctttcaaccaattgccaatcggaaaatatttaaatctacctatcacctgggagcccctgctttgagttgtcccacctttccagatggaaccaacatacatcttacatatattgactgttgtctcatgtctccctaaaatgtataaaaccaagtcacaccccaaccaccttggccacatgtcctcagatcttcctgaggatgtgtcatgggaatgtccttaacctcagcaaaataaactaaattgattgagacttctctcagattcttttttggcttagggttgagatttattcagtcaacaaatacttcttgaagatcacaccaaccagcagacagtacctcctgggactgaatgctgaggtgacgaagggagggtgattgatcagactctacactgttttaatggttgtttggcttttatgtcttaacacttacaatgcctctgttttgctctcaaaaatatagctttttccaatcaaaagctacttggttttagactacttttccaaaattaaatccacatgtttcttaattttctgtttcagtccagactctagaggtgaattatcccagaacctactttatatgataattgtataaccattgatccactggtaagacagccatagagtaagaaaaaaaaaattttattagtgtttctttagtgatggtttttatgacagatttcctttctctttcacctgaatcttgctgactccaaactgctaccctctaggtcggacacctccttttttcatacatttccaggttgaccatctccttctctttttttctttagaaatgttaatgtcatcatttaagctggcgtcaaactgtgcaggcatttctcttactttgggaaatattttgtcttttaccattaggtgcttatttcattacgcatactgtaggcttctggaaataccttactttcattcatgataattattgataagaggtaaagggggcagaaagtctcccagataaattcacgttattcaaaactctacatttgctcaatcctgacatcgttgtgactgtgatcccatcaaactacaaataatcaaagaacaggttggctgaagctaattctgaaagaacttgagccaacaagcaatttttcataagtgaaactggatttccttttagagactgtgcttcggacaaaagctcttgcgtcctaaaacctaatccccaacttaaacatatagaaaaacgtcagttttctcatggggtcatcctattgtgattctttcaggtagatacgttcatcttgtcccttcaccttaactcggtttatttcccatattggattccactgatttttatgttgcaaatcgctatgctctatcttagtttctgataaatgaaactactggcaatttctgagaagtcccatttcatcatgctaaatctgacttattcataatattagatgtgtgactctttatttaaactttattggccttccatgctaactccagtctttcatttgatctttagcttcctttggtttcttttagaagggaggagcttcctgtttatacataaacatttaagccatgggcatctttctagcacaaaaacatcagctcaatgacctaaaagtatcacatacccaggcgaacccatgttcaagtcagttgcctctctgaagtgatttcaaagtgattttattttaagtacaaatagaatactagagtgacaaaaacatattcttttttaaaaaaaggtagtgaaatgccagaggagataactctcctaagaaataaaggaaaagaaaaaagttgaattagccattttaagattcaacagcagctgtattcttctttgatgcattgcatgtattaggacaaaagaaaactatatttgcttttggcatggcatatagctgtgctttgacatttaaatcccaaggaaggcttagtgcattaaagtaatgtcagaaaaacagttatatgtttgaagataagcagaaaggaaatagataaatagttttaacatgtagctaaatcaactacggagagatttaaataagccaatcgattttatttcttgcttttgatatcatattacctgcaaaataaaaataagagcaattgattttaaaacatttaaaatatctttcttaacaagtgctttcttcttaaaataattgtttttgtcaattacttgaatacattgcagttacgatttcacactaagaattcatttaactgctctcccctaaaccaagattacagactcatggacatgtaccattctttttgtaaaatattgggactgatacaacttaatgaaggggaagttggagcttgtaggacactatccttcatttgctatatgctccctaacatgctgtgtgggagtcagttgttcattcctgaaaatgcatatgcaagtcatacttgttactgtaataacatggtttaattaagtactaagtacattttcaaatgagcagagacagaaaaaagtttctggtaaaatcaaatgtaaaagttttagaaagacaagtggctcaaaacaaacacaaaaccataagtttatgtgtgggcctagacaactgtaaacatttgcagagattcataaagcccaaggtgaactcactgaaattcattggcgattttagttttcgctgcacttgaaaccaaaactgaaaaatgaaggtgatactatatggaaatggtttgataaaaaggccggtggattgaactacagacttcaaataagtcttcaaaaaagtctttgggtgaactcacacccaaaggccccagagtaattccctctaacaacgagtcattgaggtgacataatgtaggttttcagttaaattaaaatggttaaggtgtgtatctttttaatgacatttctttactggatttcattaaacccaacatattgaagacttgtatcattccccaatctgaataaaaggagagttcattatttctttttgctttctctttttgaggagtctttgcattccaaatacagagaaaaaagaaaaggaaaggagaggagaggaggggaggaaggacaatctgttacatcacattgttatctggtttattagtataagactcttttactttcattaaatgtcaggagtaaaaatttacaatggtatttattatagcatttgaaaataacattttgtttgaatttttttctttggtatttaaatgatctataagctgaaaagaagaggagtcatagatttttctatgccaagaaaaaaacagttttaaaaagatgaagttgtcattttcattttgtttgattaaaaacacatatttccatttcctctttgtattgttgtatctatactgcccaaaaactagttttaagagggcaacaagcttagtttttcagatagcattgtctaaaattctcatggcacccattgctatattagagataagtactttgttgtctttgcctatgaattcattgaggaatattagagtctgaatcttgttttgtttaccaaatcctgcttacatcaaaaagaatgttacatgagtaagaaaggaatgcagatggaaggggtgaggagtatgtgtgtgtttatttgaaatggttttgaaaaatgagtctgtaataaattttaacaaattacggtatctgaaaagggtgtcttaatcagtaaacaggttgatttaaatagaccattatctacaattgtgatcagggtaaaaccactaagtaccatacaacatttgtgtatagcattaactttgtttgccttcaacgagtcgcagctgttatacttttactgtgatagtttcatgatttttgcttctttggcatagtcccagacaggcttcatcaacaagaaacttatcttcatgaacacacttcagtgaagacccccccctctgggaaattagacatgacataaaagtgcattgcttttttaaaacacttcaggcatttgaaaattacaagagaaattttcaagtggcacttcctaagttagaaataccatacacataaggccgggtgcagtggctcacgcctgtgatcccagcactttgggaggccgaggcgggcagatcacgaggtcaggagatcgagaccatcctggctaacatggtgaaaccccgtctctcctaaaaatacaaaaaattagccgggcgtggtggcgggcgcctgtagtcccagctactcgggaggctgaggcagaagaatggcgtgaacccgggaggtggaggttgcagtgagccgagatcatgccactgcactccagcctgggcaacagagcgagactccctctcaaaaaaaaaaaaaaaaaaaaaaaaaaaaaaaaaaaaagaaataccatacacatgaaggcaagtttctctcacatagttattataggacacttgttaatctcctatgaaggtcaaggccactggtactaaactacacaatgagaaaaccaaaagttacaggataggatctcttctcccagaacaggtactgatgtagcctagagacagtaaacattcacaagaaatgttaaaactatgttaagaagcatgtaagcatttgcttcttaattgttacagataatgatttctatagaaaattaataagaggaataaaaccactatcagctgcgtggttaatgaaaaccgcataaaagaagtaggttgaacttcagaggagcattagcctcggatgatgagaaagaaaggcaggaacatgccaggcaaaatcagaggcatgagcagaagtgtggaggcacagataaccatgtcccatttctgaaacagtcaagagatcatttaaactacagcaacatgtttgtataggagagtcatggaaaagttgaaaagatctatttttcatttattcatttatccattcattctacaatgtttcattgattgcataccatgtgtccaaggacagttttagccttgaagaataatttgtaaacttatggattctactttcttactgatttatgaaagagttagacatcagaaaaagcacacacacacacataccccatggaattgttggaaaaaaacacacaaacgccaaaatcaaagtatgcacaagggatcttgtgcctaattctccctgggatctaggttgggatggagatggcagaggagcagttcaaggcacatgctataggcattccagggagctggaaagtacatgggtgtgaatgacttgagtacgtgcagtaaactcaaggatttacagtaggttctttcacagactggcagctactagtgagggaagatttgaagctaggaatttagggggatcctaatgaaagaggaccttgcggccgggtgtggtggctcacgcctctaatcccggcactttgggaggctgacgcgggcggatcacgaggtcaggagatcgagaccatcctggctaacacggtgaaaccctgtctctaaaaaatataaaaaattagccaggcgtggtggcgggcgcctgtagtcccagctactcgggaggctgaggcaggagaatggtgtgaacccgggaggcggagcttgcagtgagcgaagattgtgccactgcactccagcctgggcgacagagcgagactccatctcaataataataaaaaaaagaggacgttgcattactagaaagactgtaatttatcctttgagcaatacgcagccattgagggattttcaggaaaatcaagttttgcatgactaacacttgttctgattacctgggcagaggtgatgagaaatgaattactgcagtagaaccaggtgaaaaaggaaatatccaaggtatttaggagttggactgaggagagagggctcattagatgtggaaaccggaaaaggtattggctagaaagagaaactggtttcagagtaagaaaaggctttaatgaaagattgttatattcactagtctccccaaacaatgtcttaactgactatttgtttagtagtgggtctaccggttagggtaagattttactgggatctggaagatggtgaaaaccagtagcagcaattgagcaatagagagtggtaaaagagaaaattaaaatagaggcagaattgagatagaagtgcaggtacacttagaacgatctgatctttgacaaagctgacaaatataagcaatggaaaaaggaatccctattcaataaatggtgctgggataactggctagccatatgcagaaaattaaaactggaccccttccttacacaatatacaaaaattaactcaagatagattaaagaattaaatgtaaaacccaaaactataaacactttgcaatacaacatatgcagtaccattcaggacataggcatgggcaaaggtttcatgacgaagacacaaaagcaattgcaacacaagcaaaatttgacaaacatgatgaaattaaactaaggatcctctgcacagcaaaagaaactatcatcagagtgaacagacaagctacagaatgggagaaaatttttgcaaactatgcatctgacaaaagtctaatatccagcatctaataggaactgaaacaaatttacaagaagaaacacaatcccactaaaaagtgggcaaaggacgtgaacagacacttttcacaagaagacatacttgagatgaaccatcatgaaaaaaaaaaaaacctcaacatcactgatcattagagaaatgcaaatcaaaaccacaataagataccatctcaggctagtcaaaatggctattattaaaacgtcagaaaataacaaatactggcaatgctttgggaaaaaaaggaatgcttatacactaccggtggaaatgtaaattagttcaaccattgtggaatacaatgtggtaattcctcaaagatctaaagacagaaataccgtttgattcagccatcccattactgggtatgtaaccaaagaatataaatcattctattagaaagacaatccatgcagacattcattgcagccctattcacaatagcaaagacatggaatcaacctaaatgcccatcagtgataaaatgtggtacatatacaccatggaatactatgcagccataacaaataataagattatatctcttgtgggaacatgaatggagctggaggccattatccttagcaaactaacacaggaacagaaaaccaaatgtcacatgttctcacttataagtgggagctaactaatgagaacacatggacacatagaggggaaaaccacacactggggcctgtcagagagtgaaggatgggaggagggagaggatcaggaaaaataactaatgggtactaggctcattacctaggtgatgaaataatctgtacaacaaacacccatgacactagtttacctgtgtaacaaacctgcacatgagcacctgaacttaaagttaaaacaaaacaaaaacaaccacaaagaaatgcaggtagtgagatactggattaaaaaggaaagcagaagatgtgcagagctatactctctaatactgcagccactagccatatgtggctatttcacacttaaaaagcagctgttctaactgagacgtgatgttagtgtaaaatgcacaacagattgtgaatacttcatacacacacaggaatataagacagctcattgatcatttttgtattcattttattttgtgttaaataaaatattaatattattgtcacctccataagattttaagctacatatggcatgtggctcacaagttattaatattagtgctgttctggaatctttctctaggtagttccagctggatgctgtattgcaagaatgagtgccctagcttctttgttggtcttgtccacagatgagtaaagagatcctcgcaacttctgataggactcaacaagttgtcctttataactgttttatctcagagacaatgcagatccccagaatgtctgtgaaactggcatcattctgaaatcacagtcccttttcattagttagaagttttcttaagcctaagtgtatttgcaataccatctccagagaatatctttacagacttagaagccagatgtgttggttttctcccagaatattaattccctgttcattaaaaataaaataagaagtattcaatgggaaaaaaaatgtggcctaaattaagatggtattttaattgagcacaagttagaactttcctggctcaaagattaattttttctagtaaagtatctgtcagttacacaactgtgtataattcatcatccttgaagtgaaagtttgggtctcagtaagaaagtgctttcagctgttaggaacagagacccaatcagttttccaggcaaatctgaagtttatttctgcacatgtaagatgtctgaaatagacaattcaggctttgtataatatatctagaaagcgatccgagacccagactcaaacattctgctccagtttccttagctcatggtttctattttcccagtgattaagattgctgctagaactccagaaatttcatctgattttcataaagaaagtaggagggtccaccttccgttttaaaaagccattccagaagttccgtgcaacattttcaatcatatctcattagccagatttaatcacaaccacagagttgcaagatagactgagaattacagtttcattctaggtggtaatatgcctgctaaaactttgaggattatcactaggaaggaagaggaaaatctgtaatgagatagatagcactctctgcccagttgatgtttcgaaagattataaaatataaatagtaaaaaagtgcatgcttccagaaaaaaatatttgatgcagcatttatcttattcaaaccatatattttatatttttcctccaaaaatttaaaatatagttatcaaacttcaggcttagacaatcgacattttagggtattcaagagtgaagatgatccagcctcccttcaaggatttcataagagagtggcagaggtatctagttcttattctgacctcctactcgaaattcatcagtaacttcttattgcccttaagaaaaagacccagatccttaaaagcagtgtattagcctcttgtggtctggcctttgtcttcctttgcagcttcatctcacatcactctcctccatcccctctagccacgctggcctgtgctcagtgcctcagatgttctttcagtggggcccctgcctgtactgatctctgggtctagaattgcttcaccccaccacccatctctgtctctgtctcttgctttcttatccttcatatctcaattcatagataaactccattaggggagccatctcaggatctgtaagactgggttaggcactttttaacctgtttataatcacacattcaagactgtaattacatcttttcttcttctagactttgagcttcccaagaatgggaaacaggcctgagctcatgccccactgtgtctctgtgcctaacacagtgcttgatacgcaatatgttctaaatacattttttatagaatgaatggaaaaatataatagtagcataaaaaaggactatgaaattataaagaaggaaaagaacaattctaaatggagggatttagcaatgctttatgagtgaaatagaattaaaactggtccttccaggacagaaaggctcatatcagataatatagggcaaggctgtcttggaaaaatggactatataaactaaggcatgtgacacagctgaaataagaagttgcccaaaattctcagaatgcctgagaaaacattctaagaatttatgctttagtctgtagtccaaggaattcataaacttttggaatgtgcatacatgtttgtggttaagtgtacacattccagagacactgtcatcacattttgcctgttagaatggaaactcgtgtcaactcattcattcttaaaactctcctaccagtgtcttcccacctatcctcttcgagtcaatggtcagaaaattctagaagtgcatacatcggaaaagagtttactggaaatagttttaaaataatggcttagagtcaaggaatgctctacacccttctactttgccagtgaattgagtaagaaaacagctggtttctatcgaaaaatttactgtagagtgttttcttcatggagaaactagattttggatgtcacgagggaatggaagcgttggagaaaagtattcaaggtaaaacagtagcttgttccaacacaacaggctttcccctaagacaacactctctaaagaagtcctggaaaggaaaatgagaatgtggtagggcggttgatacagatcagtaaggaaatgaaagtccaaaagttatttacatggtaaacatctgtgccaagaggagtactctcaataacagggattagtgagagagcagttggctggagatggaagctcaggcaggtgagcgtggggtgcagagaaaaaaaaatgtatgaagaataaatcaatatttttttgagaatgagtattttagttcagtacttctcaatattttaggtgcatacagatcatctgggatcttgtcaaaacaggtttggctcagtgtgattgaagagaacactgggattctgcttttctaacaagcttcaaaatgctgttgctgcagctgcttgtgggccacatcttgaacacagcagagctccagcctctgcatctgggcccccagatacatgaaaaatgcagctcaggtagtgacaaaaaagatcagtgatgtgggcctttggtgtgttatggtttataaaacagaaaagcctattttcttttcccttaccatttccagggaaaataaagtaatggggatgatgtagaaatcacctgaaatagtctggcacagtgcttgcaaggctgtaggaaccaactgaagtttgctcaaagctttatgtacttctgtttctcacttgtatcacctgttatctttggagtgtcatgttttacgttacatattagcaatggaaacagaaaatggtttttcaatcactcactgtgtctatgcatagaaaggctgggcgcagtggctcacacctgtaatcccagcactttgggaggccaaggcaggccgatcgcttgcgatcaggagttcgagaccagcttggccaacatgctgaaacccgtgtctgctaaaaatataaagattagctgggctctgtggcaggtgactgtgatcccagctactcaggaggctgaggcaggagaattgcttgtacctgggaggcaggggctgcaatgagctgagactgtggtattgcactccagtctgggcaacagagcaagagtctgtctcaaaaacattaaaaaaaaaaaaaaaaaaaggatgccaacaatataatataacaaaatatctaaatgtgtagttgtttgatacttattgactgacttattttttgattcactatcagcagctttttcttaatttggctctttcattgcaaggaactgtaagtcagagttcttagttatgaataaacaaactaaaaagacagatgcaataaaattcaaatgaatttaagaaatggattctcccaggtgcggtggctcacgcctgtaatcccagcactttgggaggccaaggtgggcggatcacgaggtcaggagatcgagactatcctggctaacaaggtgaaaccccgtctctactaaaaatacaaaaaattagctgggcgaggtggtgggcgcctgtagtcccagctacgcgggaggctgaggcaggagaatggcgtgaaccttggggggtggagcctgcagtgagccgagatcgcgccactgcactccagcctgggtgaaagagagagactccttctcaaaaaaaaaaaaaaaaaaaaaagaaaagaaaaaaaagaaatggattctctatctgagaactgatagaaaacagaacccaaagagggcaagacaaagtcaaggctctatcacctgtcaccagaacacaatgttctagactcccctcagccatacagaataatccctaaagccctacacctttgtatacctccctcaaaatgtggtttcaggtgggagcatacaattgcttatgctgacacctctttcagagctctcacccttattctcccaccttggtctgtcttattaaagggtgctgccctgccttccacttaatttgaaatttctttctaatagacatgtcttctacagagatcagttcaagctagtccaattgataaggttaggctttgtgtccctacccaaatctcatcttgaattgtcatccccataatccccacgtgtcaagggagagaccaggtggaggtaattgaatcatgggcatggtttcccccatgctgttcttgatagtgagctctcacgagatctgatgactttttaagcggctcttcttctttcactcatcacttctccttcctgccgccttctgaagaaagtgccttgcttccccttcaccttcggccatgattgtgtttcctgaggtctccctagccatgctgaactgtgagtcaattacacctctttcctttataaattacccagtctcaggtagttttttatagcagtaaaaaaatggaccaatacaccaagtaagaacaacttgtaaagctacacatggaatgattaggaaaaaaaatgtgaaaattcataacaagggagcataaccattgaatgaccatatcatttgccgttaaaccgggccttttttaatcatggaaggagtgtaacaagtgtgaactgattctacaccggacaggccaaggtgcatggtcaccttacctaataagtgtgagccctcctgtggcttatactagagaaacttcttgattcaatagagctttaaaggtatgcattcatggatctccacccaaacgccctgcattaaaatatctgagctgtattgcacttatctgtttcctttaatcccaaaccaactgaatttctctgcttatagtttttgcagtcttataaattctgtgatgggcatatgttgcttactttctcagcaatgacttcctgtgggtgattcacaccctatttctttccatcagcctctgttttctgtttgggttcagagaagttgatttgtcttcaattacaatcagtttctcaacctgtggccacagggactatttcaagaacattcccatgattaaggccacacagcctgaaactcatgcgtgatcatgagcagcttggccttggactgaagacaaagtggagaacacaatcagaaagagaaataaaccacaatcttggtggctgtcaagccactggatcaagtctacacccaactccacattgagccaataaagttcctttttttgtgagtgcagacttagttgggtttttggtttacagccgaaaccatcagaaccaatacaactccagtgttcacagtgccccatattttgtcctgagatccctccacagtcccctttgtttcagaatggccaactgttttcatatcttatttcaaatttaagaaaggaaattcgttggctcgatttatcttttatctccagaatctagtaatatgttgctcatcaacatatggttcggctgctaggtcaagtgcccagccataaaccagcctctggggctggatgggagggctgctgttcttctctgaagacctgtatccattttcctgccttgcagataccagtaggaccagtattaggacatctgcataagatttaattttagaggccgtgtgcagtggctcagtaatcctagcactttgggaggccaaggcaggcagatcacctgagttcaggagtttgagaccagactggccaacatggtgaaaccccatctctactaaaaatacaaaaattagcctggcatagtggtgtgcacctataatcccagctactcaggaggctgaggcagcagaattgcttgaacccaagaggcagaggttgcagtgagccgagattgcgccactgcactccagcctaagcgacagagcaagactctggtctcaaaaaaaaaaaaaaaaagattcaattttatgctgcatattcattatcatctttgccttttgactgtatcatctcaaccacggttatgtatcacagaggcttagaatattataactcattgttttagtttatccaggctgctataacagaataccatagactagctcataaacgatagaaatttatttctcgcagttgtggaggctgggaagcctgagttgaaagcgctggcagatctggcatctggtgaaggcttgcttcccaggtcatggatggccatcttcttgcagtgttctcacatgctaggcaggcaaaggagctctctggaatttctttttttaaataacagcattaatcctattcgtgaaagtggggccctcctaaaagccccatctcctaataccatcacactggggattgggtttcaatatatgaattttggcggggacataaacattcagtctctaacattcaccttttgcacattagagaacgtctacaaagaaaacgttaaattttagttttggaaaacttcctttccttttctcatttttattctttcctttagcaatgtaattattattgtatggaacccgtatctgatgatggtgagtttaaatggatcaaaattattgttccttaaaagcaacaccaaaattttataagatatgctgcatactaattaaagctcaaggagccccaggcaagaaagaaagataagccattgcttaagttatgcaaaagtgtattaaatatttgagattaattaaaatctagagaaagttttttaagagttccatttaaagtttgcataaaagttcacgcaattattataaaacatttgctatcaaactggtttgatgaataagggaagtcaattagtaacatagtgaaataagagttaattcatgtttctctaggtaatttctttcctttgttctgtaaaagtcatttataactacataatagtacaatcatacaataacaattatatgccaatacccactgttttacaaagcgatggaaagcatagttctatggtacttacttattttctaagtgaataatattcttcttaaacccatcctgaaaatttctacaataaaagattcattgatggaaagtcaaaaagtttgatttctggtggtttttgttgttcataaaggaaatgaaagcacagcttttactgagcaggtggttcctggtgtgtgagcccttaatggaagaatgatctgtgtcaacaggactgggaaagttctgattctgacttctgaaattgacctttattctccatttcagaacacataagccacggtatcccttttattatatagacatcgatatgaagagaacaaataaagtcacaccaagaatgtctgggcttgttcatcttacacaatttattatttttgaggctatcacttagtggggaaaaattttcctgcaccctaatgtaaaattgcaaatgtgtttccccagagtaatgatagtctaaaaatgagggacagtgagtcgtaattaggattaggcttgggaaacaagttcacttatattatagcatgttgctatggcaaaaggaaaaatatggtctgattttcaaacaattgactggcaaatgggcttatcccatgccatctattaataatcaatacagcttattcaaaggacaaaagtcactttctctataaaagaaagtgggacaaatttaacaacggtctactttactgcaagttaggatagaatctagaggtaagtaaaaagctttaggtaatgtcttcaagcctcgaagcaccagctttattctcaccggggaacaaagtctaaagaaactttcatgaccactgtgtctgataaagaatgaaaattctgctgaactcagtggtgaacgtactcattattaaacggactcagaaatactgtggttcaaagcatgcttcctaaaaataaaaccaatataatctatgaagaaagatttccaatgccaaaaaaatttcaatgagcattcaaaggttgaatccatagccaccacatgaaatatgatataagcaagtcagtaagagccactgaagtgtacggtttcagagtgaatgtttgtttcccagggaggagaatccaggccttcctctcttctctctatgccctgcctgccctgctgtcttccagcctgcaggcaagttccctgttgctttcaagctggagcttggcaccacaggagtccctgcttgccctctcattcccaccaccaaagcctcctggcagcatttttagctgtgtgggccttatattcaacaacaaagatgaagatatatggctaggagtataggagaaattatgttcttgatatttatttggaatattaaaaagaacaaaaaaatgagctctatgttctacatcacatcatactgtctagcaagatgccttatttttatttaataatttcatttataaattgcctctttacaattatgattgaagactgagaccaagggaaaaagaaggcagaagttacaatatttcctgtgcctgagcttaaattttggcttccagtttcttggaagctttcttacagggttagcatacatctcagctggagtttcccatttagattatctaccagtgtttttgtaggtgttggcttagtatattaccaacattactgcatcaaatttgaaaataattcttcttgatctggtcccagatttgatccaagaagcacatgagtctgcaggatgtattcagactcaaagttctagaatagttatagattgtgatctctccaaaactctctaatctgggtgtcattaggtatttcttgagtctttgctatgccacttgctgtgctgggtggatcactagcagcagtcaaatttccttcccgacccagacatcttatcaaataaagcttagaggcagagattccactagacacacagggccacgagttaatctttgtgaataatttcattgttaactattgggacaaggtacaaaaaacaaaaacagaaacttgctaatggaatacactttctaagattataaattgcaccatttgccaaatgtatactgttagaaatgagagcaataatttgcacttactgtaagtccagcatacggagagggtcatatgttgaaatgccatctctattgaggtgtcataaaaaatatttcctccagcagcacccagtcattctaaggtattaggtataatttttaaagtattatttggtgttctgaataccaaaaaagtacatcttgagtaccacaattggtgacattaaagttaattattttcattaaatattgcagtgctgtcatgaggaatgaaacagaagagcaaaatgaggttagagatgggatgtgttcaacattgctccccaagtatttccaaataattaatgtattcattgaatgatatttattgagggtcagaaaaagtgccatggtatttgatacagcaaaagatcacatttatgatttcattctgtcactttctgcaacaggtagcatccccttgccagcaccaaggcagggttgcatatttgaaagttactccctcaaaaaattcatttaaataaatagatttttttaaagaaattatgaaatactaacgttgcattcagttagtgattttatatggtgtaggattgacattaaaaaatacttgtcattaattttactctgtattaatgttatattaataatttctgaaagtaaccaaccattctaactgcagaacccagctgtggacatgagtttctaggggaggactctgaaattgtgtcaatgtttgtaatctagtcctcggagaatacaaaatttttgacaaagaaggaggttaaggagtgttttctttttgatgttcacctccaaaggaggatcataaagaagtaattcttgaaaagtattgcaatgcagtcttcacaaaaaaagcttatccctgaagtacagaaacacacttaaaaggaacatagatgaaatctctattcaaagagtttgggtttgacctttatgcattacatattatcactgttttgaattaagctattactgtctcattgttattttagcagctaacaaatgagtaggtgttctgaaaagcagtgtttagcatcatgtaaaatgttattttaaaagttcatttccactgagaggattttctaataaccacgtttctgctagtaactcagccatatatatataaaaatattgaaattagagaaatagaaactactgctgtgatataatttgatagaaaaatattaatagatggtagacattgtagagtttctttccatgtagaaatgttacattggaggattaacagcacttttattcattcaaaatagtcacagcatccattctattttaaaatgttaaaatacaaatacaattaactaatgtatttatccacattatctaaattacacaaataaaatatatatttaatattattaaaatatctagggatctgatatgtcctggtatgtctatctaatctgtgtgtgtgtgtgtgtgtgtgtgtgtgtatgctgagatatatatacataaagatatatacatctatagatattgatatagtttggatatttttccccacccaaatctcatgttaaaatgttatcaatggggcctggtaggaggtgtttgggtcacgggggtggatcccttgtcaatggctagggccattcccttggtaatgaatgagctctcactctgtgttcacttgagacctggtcatttagaggtgtgtggcactgccccctcaactctctctcctgctcccattcttgccctgtgagatgcttgctccctcttggcctttttccataagtaaagctccttgaaacctccccagaagttgagcagatgccgtcaacatgtttcttgtacagcctatagaccgtgagccaattaaatctcttttctgaataaattaccaagtcttaggcatttctttatagcaattcgagaatggcctaatagtgtgtgtgtgtgtaactacagtatatatacagtatatatatatatagtatgtatatatacagtatatatatatagtatgtatatatacagtatatatatagtatgtatatatacactatatagtatgtatatatacacaatatatatactgtatatatagtgtgtatatagtatactcatacacacaatatatactgtatatatacacacacactgagcatatattcatccacacatccagtcctctcagccatggctctaccctgaatttatacactatgtatgtgtatatatacggtatatacattgtgtatgtatatatacatactatatatgtaatctgatatatgtgtaactactgattatataattcataatatttaaattcccttatgcaattttttactctgctattatcctaaatttataatcattccataatgaagcaaataagcctatgcctcattcctggggtgtttagaccctgtttagatcctgacagatgcaatgtcttcaattaagttcttttacacactgaagggatagttcaggaggatcattaatactgataccatctaagcagaaaatagtcacagataattaactaaacttaatcgtactttagtatggataccttctttacatcgaggatcaattttaagttcactgaaatggatgtggtaaacatatcagagttacctcctgtggcattatatttgtagtaaatgtagtttttcaaaaccctttaaatacttgaacatatttttaagctcacaaaatactttgttattattgctttggagccaaattttccaattgcaaatatctaatgataattttttatatataactttactgcatacaagttggcaaaagaaaaaaacaacaacaaaattttaacttctttgtaagaaatcaattgtagataatgaatgatcgagctacttttctgaccagtcaagaagtgtgaacagatgctggaactgaatagcagttgctaagactttgcaggccgaccaccaccaggctctaagtgtcctatacaacaggtggagatataaggacttcttttaattgcaagacacatgatgaaaaataaaaggcacattctgtccacccttaaagttctttccctaattccctaaattaggttcttgtgaaatacctgtagttgttatgaaagtcatagaatttaatttataggtgtctcttaattaagttaggttagctagctgatgtttgtttcaaggatcatggaatcggccatgcagtaatttatatgcccaaagaaaaacctgattaaaatgcttaatatgatgaacagaccttgaataatcttcataattatagagtacacactacttacatttttgaagtggttccaaaaccatttgtccactgtgtgtatcttcaaggaataaacaattcactaaacctcctctctatggaaatgtatagacccttggcccatcacctcctcatccttgcagattttaatgcctggttcactgctccatgatccaataaccctcttgtagtattctttggagttttcaatatccatgtagaccattctttcaatgaacctatctctgaaatattggccctcctccattgataccatcctccagcatgtcttaatcactcagttccaagatcatctcctggaactcaacataatcattaactacaactactccataattgtgcttctcatttcctgcagctctctaaattcactgttaacaaaagttacatctatgtcttgttcactcatgtgctcacttcccttccacttagctttagtcccacattctatcattatgactcccttgcaatcacctttgatttctttgctcctctctctttcctaacacttgctcagaaaaacagcaatgctgattaagtgaaacttgtgcttcagcatctccctggggggaagaatggaagaatgtggctggggaaaaccacacacctatgctgattggtctcactttaaattcatagctcctaaccttcagtgggaccctggtgttgcaatcctacttcattccgctgctccatttcctcctctcccccaataccttcaatctacccatttcttcttcagccaattacatttcctagttgtttaaaatacctacttattttcttgttctcttttaaagtaacaatcatcattgctttcactttcttttgcctcattctttttgaacctatttcaaaaagactttcatccccaccatatcagtccctgtcaagtcatcagcaatctgcatgctgctaaatctagtggaaaattcccaatccttaccttcagcagcatttgatacaaatcattccgtctttcttgaaacattttcttgtagttttcttagtatttctctctctctcttgcttctcctcctactaaacctactgttccttctcatttagatgtctcctcgattttctcatttccaaacagtggagagccccaggtttcagtccttggacttatactgcttcctgtctacacctactccctaggagatctcattcaagttccatattccatctgtatgttgacttatctctctagctatatcctctattgagttttagaccttacacacaactgcctgctcccagtcagcacagtctaacaaacatctcaaactctttgtttctaataccaaactaccattaaaaataaatgtttctctctcagttttctccatgcaagtaaatgtcaactccattcatctattcactcaaaccaaaaaccttagcttcatctttcactcttccttttgaccttcacatccagtccaacctatcaggaatggctctaccctcaatttatacccagaatccagtcatttatcttcatctccattgtatccacttctaggccacctgttggatggactgctgcaataaccttccagttgatcttcctgctttcacccatgccctgtccccatggtctaattttagcacagcagccagagtgatacatttcaatgagatgttttcatccccatcccattcaatgtaaaagccaaaggttttgcaagtggaattttttttttttttagaaattgttttcgttttcagatgatgagaataatgcatgttcaatagaagtgtttctaaacgacaaaaaaaaaaaattgttattctccttcttgttccacacaatgaccattgcctttaaaaaaaaaaaaatcactgttcaggattggaattagctaggtaggtatgaaaaatagagaggatttaagttgtatttgcaatattaccatggtgctttacttacagcctctctcattgtggtaaagaaagactgctccttcatgttacagctggtttatatgtaattattttttttaaatcctgtaagaaaactcactcaactctcctgaaaaaccccaaagtgcagagacaaaatattccataaatatctttagaaactccctgatctagcatccagcccaacctcacaatcatctatttgctctccaccccattgtcaaaccaagccatgtggaatttaatatggctacctaacttctggatctttctctgataacaattctcatttttgtatctgttgataaagaatgcttctactgaatccttcgtccatatacccaaggaagggtaaatggaaaatatcgaagagatgaatttttttgaacttcttgtcagcattgttaattgaagatgtattttcctattgatttgatcatgtgttacttgattttgttctgattctcagtttaacacggtatttccatctgaagcttctgatgcatacttcatttattctaacgttaaacagaattttaaagctcaaaaacttcaatgttaattgactgaaaatgctaatctataaattcattttattgtagaaatcttataaggatatgttgtatagttctatgtcatttcccatgaatttaagatttagagattaaaaaatcagtaatttgtaaatggtaattttatcttgagcagaattctatgcctgtaaaccaagattctgtatcagtcagtaatagggctgaatatgtgacgatgtgtacacagggagggtgtactttacctttaagctggccaaatgtgcttttttatttttttaaataaaaaagagcctaaatagaaatcttatctgtaaatattcattggtcctaattatcttttatagagttgcttttaccttactcagttgtgatttcattattaaaacttcaagtcacagaccaactaagtgcttctttggtgtgtgtgtttgtttgtatcatggatatccagaacatttgtcattggatatgatcattataaaactcttgaacatgacttctctgaccgtggatctcaggagctgtacttgaagtttcaaatcagctggcagtcaaaatgtttaataattcctttccaccgagcaaagatttctttcaatttctattctaggagtttgtactttttctaatgtatcctgcacaactaggtccatcaagataaatttctgtgcttaatgtcatgaatagaacagaaaatatgttaaaaagtgatggctccaaaggcatagcattttaatctaaaacatctgtgatttttcttgttcacagaatgtctgcctccctcattaatctgtcaggttttaaaagatctgggaatgaatctgctttgtttaccactatgtcttcagtgtctcacctggggaaaagtttgtgatagatttttagggaataaattagtttttgttggatggatggatggatggatggatgaatactcttatactcatcctgtaaatataagtgacataaaaatcatcacaaatagatgtattgccaggtggtttttgataatcaactgtctcagtccatttgtgttgttataacaaaataccacagactaggtaatttataaacaatagaaatatatttatcatggttctggaggatgggaagtccaaaatcgaggcaccagcaggattggtgtctgatggggattgctcttcttccaagatggtgcctcattgctacatccttcagaggagaagaatgcagtctcctcacatggtgaaaaggatggcctggagaaagagagtgttccatgtattcttgaacccttttataaggatgttagtcccattcagggccctcatgctgtaatcacttcccaaaagtcacacttcttaatacagttgcattggggattaagtttcaacatgaattttggagaagccaccatcattcaaaccactgcaaaacagaaatcagtcttacctggaagtatgtggaatggctttattgaatatgggttctttcaacagatagagataagataaggtcattgaacaatatgattcttatcagagcaaacagaggcaacggtgactgagcatggagatatgtgagaaagtttaacaatagtttggataaaatgtagaaataaaaccaggaggcccccgtcatggagagtttttgaatgttaagtcagagattgggtgttttagtgggtagataaccaatagggaacacaacaaggagtacataaactacatcatattcacattgaaaactgagagaattgaacggcagccacaatgaagtacatgaagagaagtactaactaaaaatagatatttttcagagatgcttttaccatttacaaatgcaggtacatgcactctctgcctgttattcattttccaagagggctccaggcaatcaacctttatcttttttgggacttcaaaagaggacaatgttaaagctgcattagacataccccaactgtttgtttatgatggcttttactgtttatatgcaaacctaaatatgtaaatcttagaaaagaatgctaaaagaaagggtataaggcaaggaaaatctggcaaatttttaaattttaggtttcagttaaattaaaaaaatagtaacattatctttcaaacgtgaaaatttcagttgcaaagaatagtacaaataaatcaaagtaaatgtagatttagttggctcatattaaaagaaatactaatcagtaacagtacagcttgatttgtcattggatgaatgatgaactggggaaattgaggcaatcacaaatagtctagcttcagtttacctcctcatgaagacttctcagaatactcaaacctacaatgaatcctcagcactttgcctaaggcttgagccttataacctactcaataaatatttgctaaatgactttgcccttactaactttgcagccttttttttcagttagtaataaaactactttgtattgttatttgatatcttcatttttcatctagacagtgtaagatgaaggccctctctcacacttttctttcatctcatacttctcatttaatgattaaaattggcaatacaattagcgttacataaattgcattgaattagattgctactgtcttctaccctagaatggaggattcaatttatagttgacctttcttctgaagcttaattgttgtttattattcagtttgttctacggaagttaccactttcttttacataggatttagagtgtatttataagttggattctctgcttttggaacttccattattcacttaaaacagattcatgctttagaaagataaggagacaagaggaagaatccccctgtgttttatgtcctacttttgtaatacctgctcttctaaggttgtgattttgttgctgttgttttatttcagtagttttttgggaacaggtggtgtttggttacatggaaaagatatttaggggtaatttctgacatttatgtgcacctatcacctgagcagagtacagtacacccagtgtgtagttttttctctctcatccccctcccactctttcccgattctccaaagcccattataatattcttaagtctttgcatcctcatagcttagctcctgtttataagtgagaatatacaatgtttgatttttctattccagaattactttacttagaatgttggcctccatctccatccagatttctgtgaatgccattatttcattcatttgtatgtctgagtagtattccatggtgtgtgtttgtgtatatatatatatatatatacaccacattttgtttatccacttgttggtcaatggatatttagtcttccttatttttgcaattgcagattgtcattttttgatttttttaaattatggccattcttgcaggagtaaggtggtatattattgtggttttggtatgcatttccctgataattagtgatattgagcaagttttcatatatttgttggccatttgtatatcttcttttgagaattgtgtattcatgtccttagtccactttttgatgagattatttgtttttttcttgttgatttgagttccttgtaggttctgtcagatgcattgtttgtgaagcttttctcccactctgtgggttgtctatttactctgctgataatttcttttgctgtgcaaaagctttttagtttaattagatcccatttgtttatctttgtttttgttgcatttgcttttggttcttggtcatgatctttttgcctaagctatgtctagaagagttttttctgatgttatcttctagaatttttatcgtttcacatcttaaagtctttgatccatcttgagttgatttttgtataaagtgagagatgaggatccagtttcatttttctatatatggcttaccaatttttccagcaccatttgtttaataaggtatcctctccccactttatgtttttgtcagcttggtcaaagatcagttggctgtaaatatttggctttttttctgggttctctattctgttccattggtgtacatccttgtttttataccagtaccttgctgttttggtaactatagccttgtagtatagtttgaagttgggtaatgtgatgcttccatatttgttctttttgcttagtcttgctttggctatgtggggtcttttttggtttcatattaattttaggattgtttgacttagttgtatatgctagatgtcaaagcaggaaatagatatttggtgtcagaaacatgaatctatttattcttgtgttctcatcccattttccctctcaactcaccatgagccaaatacaattattttctaagtaaacattttgacaaatgcattatatatttagctagaagaagtttctgccttctatgaggtcacagcctaggaagaaagagatttgataatgacccagttaattggcttgattacaaaattttggcttttagttagcagaattcctatttaactggtttttctaaccatctcaggattaacccatctgttcagtgaagatacttagagaaacctgtattctaagaggttattcaaaagtattctcagaggtacatgtgcatatatcttttgccagtacaagctagcaatccaatgggaagatgtttacctgaaaaataaagaggaaaactaatcccctcagcaagtgtttatcaactgtctttgccaggcaccacccaccagtgctctacatgtgatgtgagcatgccctgaaggagatcatagtctagtgcagcaattaaacagtaaagaaataattacagtacattatgatgagtccaactaggacacagaggaggagggagcattatagggtgcagagaaacattcccagagaactcagagtaggtaagatacatgggttgaaggagccgggcacagtggctcacacctgtaaccgcagcactttgggaggccaaagtgggtggatcacgaggtcaggagatcgagaccatcctggctaacacagtgagacaccgtctctactgaaaatacaaaaaattagccgggcctagtctcagctactcgggaggctgaggcaggagaatggcgtgaacctgagaggcggagcttgcagtaagccgagatcacgcccctcctgcactccaggctgggcgacagagtgagactccatctcaaaaaaaaaaaaaaagatacatgggatgaagggaacagcatgggcaacagaaggttaggagaagcgcaggtcatatggtatgactggcttgttgaattcatgattaggttggtttgagcaattgaaaagtgattaatgtcaaccacttctcatttttcttttatttgataaatatttcttcttacatatctggtcacaaacctttaatgaattccatgtaaaacaatcaataaattttcttattctttccctcctgtgacaatagagatggtgtctctctatctcttttggaacctgtccctttaatagcttctgagaaactttaaactataaacttttccctgtatattgcactgctagcttcaaaccaaatcactgccatcagcctttaaacatacttgagtctgtcccatattaatcttgatttcacacatgtgcccctacaacctctgcttctctttacaataaagacttgtacaagagttgtctctagctccacactgccacttaatcctggaccgctccaatctggctttcacctccatcactcaaccaagacagccctccacaaaggtcactaatgaccgccatgtctcttaataaaatagacttttcagtcctctccttgtttttttctctgggatatgtttggcactgtaaatcagtttatctttcttgaaacaatttcttatgttggtttccatgacatcccactcttgtttttctctatctttttgagttctgcctgcccctgctaatttccttttctaggcttattctcctttacctagttggcaattagaagttcctgaaggctctgcactaagcactttctctttgttctttaacttcttccatggatttgatttctgagtactctaaaaactcccaaatttaattcccagtgaagacttgcctttcagtatatctgggtttgtttaacatgcatctcaaatgcatttcccatttcttatatcctgaaatctgacctgcgccccttgttttctgtgtaggaaaattcacaaatatctatcttgtgcattaggtcaagagaccatggaaaactctttaaattgttaaaacactttagaaccgagtttcttaacctcagccctattgacattttgagctacataatttcctgctgtgggggtctctgtgcattgtgagatgtttggtgagcattcctggcctatacccactagatggcatagcaccccctccagttgtgacaagcaaattgtgtccagacattgccaaatagctcttgggagggataaggaggccaaatcagcccttactgagaatcgcagctttagaaggaagataagagacaaagctgtgttttttaaaaaatagaaatcatgctgaagttttctaccaaggaaattattagttcagttgtatgcccaaagtgtatgacattaagtattatttatcaatatcactacttcccacattagctacatgttgtgagtctcattggttatctaaaatatgcttcacaaaatttgcccagcaaagatttgtccagtgagcaccaagaaaccccatttggaccttgctgatagttccagcatatttccacacaatttctctcctctcatcctcctaatctcccaaccacagtcacagtgttttttgaaatcatatgctcctcctgtcatccagtgtcacccagtgttctttctggaacatcctgcccatttcacttaaccccccttcatcctgcaaacacagcccagacatcacctccctacagaggcctttcctaaaccccaaagccctttaggttttcatgcactcttagagctgtgctgctttccttcactggcacttacctaagtttatgattaaatatgcattcgcatggttatttgaatatttatcacacccaatagcctttaacaaggatgtaacacataagctctaaaacactggtgcctggcagtgacatgtatgattcatttcaaaacagaaaggtagataatcaggcacaaggactgctacctggctcaccagcagcacaggacatttgaaatcagcattgcactaaaaaatgtccttgttatagtggccatccgcagagtgctgaatctttcccctgtgtcgtgacgcctcttttatatcataatttttaaatcttcaaccatcatcctctaaaatactattttttcagagttgttaagttccgtgggcgaataatttgcattcattttaagacaaatttgtttaggcgataaatgcattattatttttctctacctcacaatatgacatggattttcaattgaaaattctgcctgaaactgattggagttgggataaagttgtagacaatctatagtagttcatttggtcacagcgtgtttgctttacttttggatcttgagaagaaaggactgttatctgcagggcactctgggacaacttcttggtgataagagtgaagactcatatttgctttgtaaatcaataaaaaagagacctttcaggcaaaagtgttgatgactgaggaggacaagttgtgaattttatattggaatgtaatgttacctatgaaattttccacctattttaggattttcatattttcagatcaatcaaaatttgttgtgaacaaggtttctcctccgtgtcctacgaactacaaaaaaatgagtgcctgtgggtgttttcaaactgcctgtgggtagacagagctatgttactacctggaactctgtgaatgtctaaaagaaagtcaaaatatcaaaatcgaaaaggaacttattttctttgatatgtcttgttgtatgaccttggtaggaacaatgacaaaattttgacatgttcagatgtcttagaacaatgaaattagtatatattaaaatagcagtgctttgttgtccttttaaataatacatgcattttaaagtattcagaagctttttctactttgtataaataccttatcagtcctctaaaataatccaagcttaataggaaaaaaaatgaaggagctttgttgaggcttactgaatgtcacagagcctgcaaggttagaactgagcatagaaagtgaagaaatatgttcttgatgcctattcaactgggtttcctgttcaaggttatgcactctatttgctaatagttgtagtattctgtaccacaattgctgagattaatatcttgagaaaatattgtaccattccagttaataattatgttgatttctattcttcagtttaaagtagatatatgaaaataggacctagtgtgtgaccactcaaaaaccctattttcctcacgtttgtagtgtatttctaaaggcctctccaggattatttcaaaatcaaaattgaaatattgtctaccaagatattgaattaattatgtatctatttcattttactgtttgaacactcccttctaatttgtatatagagagatagaattgtctagcacttttccgaaggaaaaagaaatcaagaataatatttaaaggctcataatatcttccgtctacatgtattaattgtatatggactttaaacaaatacaattaaggatagtcttgttctgcatataattgatttgcctatgttgatgagatgctgacaaccaggtatgaaagctggttttgcttatctaaaagagtggactaaaagtaagttaagtggtttctttagtgttctgtagctttagttgtacatggagcacctgctcctcttggaagtcacagcactttaagtaagttcgccatggtctgctatgctgcgcagactaagctgtgcagactatgctgcccagactcctcttcctcctctttagactgtggcagtaacctaaaagacttggcctctgtttcaactctcatgccacacatcatcttttgtctttcctgtggttcaggtatttgtgtgtgagggttgaggtgggggtgcaccaaattcatacagatttcctcagtagctttattttctgaatttgaggcaacaggacagtgaaaaatggcgatcgttatattgattcatacaacacagagatctgaaggaagcattttgtacaaaccctgctctgggtaacacaggaaatgccaagattttgaaatgtaactttcttggtcttgaagaccaaattgtgctcagaaaaggcagagtccctataagttttgtcacaataaatgagtagagcccactgcaggttggaaatctacaaatcattgcagggtattattaagataataactgcacgagagccatcacagcagcagaggtaaggatctctgccaagattcaccttagaccggtgattctggaacttgagcaagcctagactcaccaggagggcttgattgctagagtaggagaattttccccgtcttacatataaccaggtgatactgaccacacttggagaatcactgccttaggcattaggatctgagactatatatccatggattgcagcaagaagcagacaaaaacatttcttcatacacaagaatgtttgtgacttagcaaggctgttattggagacctggccattttaggtagttttgtataatttgccttattccatccaatgttctaatttctaatgtttataggctgcaagcctagacgctactgttgtgaaacagttaaacacgttgggtgtggtgccgagctccttcctaggttatcaaatccaagctctgccatttattaattgtgtcattttgaggcaggtatttatattcttagggccatggtgtcttcatctgtagaataggaataatagcacctattgctagtattgctattaggattttcaaaataacacacataatgcattggagaaagtgcctggcaaattataagtatgtaataaaacttatctctctttttactccttatttcttattacagtggttttgtttttcatttcttttattttttggatagttaaaccttataaggatttaaaagtttcatgtgaccattcaaatatcccaatttatcatttaaacgtaaacaacaatggtgccagagtagtcatggggccctctccagcttcatcctacagaggagccccacctgggcaactgaaataagattataagctactagaagaataaagaggtcttatttcattatttaattaagccgctgaatagtttattcttcctaaagcaacatcacatataccaattaggttagatacccttattaactagccagggaaccttctctcttgaaaaacatcaacaagaagtttttgttgttatttttgtcattcttgtttggttcaagaaatataattaaataaatttattccagaaattttaaatttcagttaaaaatttttaatttgatgttatatcagagttatgaaaatcatggctaactataatatggcctgagaaaatccacttatttcaaaagggaataaacagactaaaaaacaataagaaaacaaaaagcagatgagtgtgaaaattacaagataaactcagaatacacctggtcaaagcaaacattacactgggcaaagttacataggcaagagaggctttattcaaaactattgtaacagaagagagaggctgtaactcagcctgagctcaactccactgaaacaaagggatgaagagtttttaagagctgggatgggagaatctgtgtaggccatttgtgcttgctaattggctttacccacagatgaagtaaattttctcctatcttcatgacaggaggtagttttacaacttagagcaaggctctttgaagttaggctcccacccacactcaggtgtagactgtatccctttaatgcttttatttcaaagtgatggctcctgggtgcttaaggaaaacattccagggttttaaaactgacaagaagctttaaaaaaaggtttacatctcaatcgggcaaagaaagagtttcaattacttgttttctaaagtaaatgctttaagaaagggaagttagggacctagagtcaggaggaagcctgtataaagtttagtccagctgagggaactgctaaggccatcttggtctcggtgaacacttggttttcacatagttttaatcacggaactagtatgtggcctggacacacttggaaagaagccaacaccagagggattgctgatatactgtgaatatctaattcctacatttatgataatgaggtggaatgaaataaagaggagacagtgtgaaattggaaagtatgtagtttgatgttacttgcaagtatactgtgaggcccaatttatgacactgggctgcatagagctttttctgaaagtccatctagctaaaccctgtcctttaaccatatgggccaaatgacttttgctttattttattttagggaattttctttatttgtaacattcctttcagctctttttagattctaatattccagaatgtcttttttccagtgtaggttcttggcatctttgtccaacatttcatagtaggtgtataaatttgtttttggtttctgaattctattccattgatctgtttgtccacttgaatgccagtaccaggccattttggttactatagctctgtagtataatttaaagtcaggtgattcctccaattttgttatcttgctcaggatagctctggctattctgggtatttttgtggttccatacaaatgttaagatatttttctatttctgtaaagaatgccattgatgttttgataagaattgcattgaatctgtagattgctttgggtagtatggacattttaacaatattgattcttccaatccataaaaattgaatactttccattttatggtgtcctattcaatttctttcgtgttttatacttttcattatagagatctttcatttccttaagattgatcattgttggcatatagaaatggtactaatttttaatgttgattttgtttcctgcaactttacataatttatcagttctaatagtttttttgtgtgcagtctttaggtttttccaaatataagatcatactatctgaaaacaaggataatttgacttcttccattccaatttgaatgccgtttatctctttcttttgtctgattgttttatctaggacttccattactacattaaataatagtggtgaaaatgagcaacttcgtcatgttacagatctcagaggaaaggctttcagtttttccccattcaatatgatgctagctgtgggtttgtcatatatggctttcattatgctgagatatgttccttctatccccagtttttgagagtttttatcataaaaggaatgctgaattgtatcagataatttttcagcatcagttgaaatgattatacggttttggccttcattctgttgatatgatgtatcacattgatttgcatatgttgaatcatccctgcatctcagggataaatcccccttagtcatggtgaattattttttttttggtttgctattattcaggatttttgcatcaatttttatgagtgatattggcctgtagttttatttttttcatgtgtctttgtctggttttggaatcagggtaatactggcatgatacagtgattttggaactatttctctcttcctctattttttagaatagtttgagtaggactgctactagttcttcattacatatttggtagaattcagcagtgaagccatcaagtcccgggctttttttactgggagactttttattatgcttcagtttcattacttgttactagtctgttcaggttttgaatttatttgtggttcaatctcagtaggttgtatgtgtctgggaatttgtccatttttttccctagatttttccaatttattgacatatagttgctcatagtagccactgataatcctttgaatttctgtggtattagttataatgtctcctttttcatcctgattttatttatttgcatcttctctctttttctgtagtctggctaaaagtttgccaattttgtttaacttttcaaaaaaccaactttttatttcattggtcttttgtattgttttcttcatttcaatcttatttatttctgctttgatttttaccattgattttctactactaatcttgtgtttggtttgttcctgcttttccagttctttaagatgcattgttaggttgtttatttgaagtttttcttattttttgatgtaggcacttatagctatgaactttcctcttagtactgcttttgtcatataccataggttttggtatgttgtgtttccatcatcatttgcttcagaaaaattccaattttcttaatttttttattgacccactggttattcaggagcatattgtttaaccatgcatttgtatagtttccaaaattgctcttgtcattaatttctagttttattccattgtggttagaaaagatgctggatattatttcaatttttttaatgttgtgagccttgttttgtgacctaacatatggtcaatccttgagaattattcatggtctgaaaaaaagaatgtacattctgtagccgttggatgaaatgttctgtaaatatttattagatccatttggtctatagtatatattaagtctgatgttcctttgttgattttctctctgaaagatctgtccaattctgaacgtggggtgttgaaatctccagctgttattgtactggggactacctctctctttagctctaataatatttgctttatatatctgggtgctccaatgttgggtgcatatatatttaaaattgttatatcctcttgctgaattgacccctttatcattatagaatgacctttgtttcttatagttttaatcttgaaatctatgttgtctggtataagaatcgtaactcctacttttgttttggtttccagtggcgtggaatatctttttccatcccttcattttcagtctacatgtgtctttataggtgaaatgtggcaacagatcattgggtcctcttttttcatccattcagccacttcttttcattggagagtttagtacatttatattcaatgttattattggtaagtaaagacttactcctgccattttgttctttcttttttgttgttgttttgtggtcttctcttccttgtttccttcctgtcttccttttagtgagggtgattttctctgattatataatttagtttcttgttttttattttctgtgtatctgttgtgtgtttttttacttctggttataatgagacttgcaaatactatcttatagcccattattttaagctgataacaacttaacatcatttgcataaacaagcaagcaaaaggaaaactaataaaagctctacaccctaatttcgtcccctggtttttaactatttgttgtttctatttatatcacactgtaccatatgtcttcaaaagtagttgtagttattatttttgattggtttatcatttagtctttctagttaagataaaagtagtttatacatcatggttaccatgttatattctatttttctgtgtacttactagtgagttttgtacctcttggtgatttcttattgctcattaacattcttttctttctgattgaagaactccctttagcatttcttgcaggacagatctggtattgatgaaatccctcagcttttgtttgtctgggaaaaatctttatttcttcttcacgttcgaaggatattttcaccagatataccattctagagtgaaggttttttcctttagcacttcaaatatgtcatacgactctcttctggcctgtaagttttccaataaaatgtctgctctcaaaggtattggagctccgttgcatgttatttgtttcttttctcttgctgcttttaggatcctttctttatccttgagcttttggagtttgattattaaaagccttgaagtagtcttctttaggttaaatctgcttgttgttcgataatcttcttgtacttggatattaatatctttctttaggcttggaaatttttcttttattgtgtctttgaataaaccctctacccctgtctatttctctaccttgtatttaaggccaataagtcttagatttgcccttttgaggctactttctagattctatatgcatgctttattctttttgttttcttttgtctcctccgtgtattttcaaacagcctgtttttaagctcattctttcttctgcttgatcaattcagctattaaaggactctgatgcattcttcagtatgtcagttgcatttttcagctccagaatttctgcttaactttttaattatctcaatcttgttgttaaatttatctgatagaattctgaattccttctctgtgttatcttgaatttctttgagtttcctcaaaacggctatttgtgaattatctgtctgaaaggtcacatatctctgtttctccagggttggttcctgattccttgtttagttcatttggtgaggtcatctttttctggattgtcttgatacctgtagatgttcatttgtgtctgggcattgaggaattaggtatttattgtagtttttgcagtattggcttgtttgtacccgtccttcttgggaaggctttccaggtatttgaaattacttgggtgctgtgatctaagctgttccttatttagggagcaccccagtaacactatggttcttgcagactcatacagattcatcttgatcgtcttaaagaagacctgggcgaattctctggattatcagatggacactcttgttctcttcccttactttcttccaaccaaatgtagtctctttctctctctctctctctctctctctctctctctctctccctccctccctccctccctccctccctccgtctctctctgttctgagccacgtggagctgggagtggaatgacgtaagcacccctatggcaaccaccactaggtggacctgaagccagcacagcactgggtcctacgcagcatctgttgtaatcactctctggctactgcctatgtttcctcaaggccctgggactcagcagggggcaaaaccatctaggactgtgtccttcacttcagggttgcaagttcccctaggccctgggtgggttcagatgtgctgtctgtgagccagggactagagtcaacaaacttaaatgtctactttgtcctcttttgtcctgcagctgagctggcactcaaaccacaagatacagtccttcccactcttctctcccctttccaaaggcaaaggagcctcagctcatggccactgccactacaggtcctcagtgaatacttccagcctaccaaaaatgttccattgaggtccaaggactcttaagtcagcttgtggtgaatgctgcctggtttgggactcatccttcagggaagtgggctcccctctgaccctggaaatgtttagaaatttcatccaggagccaagtgctggaattagggactccaagagcccattttgtgccctactctcctgtggctgagctggtacctaagatgcaagatgaaatcccctttgcttttccctctgcctttcttaagcagaagtctcaccccatagccatcatagctggaaaagtgctgagtctcacctgaagccagcaagtgtgaatctcacccaaggccctcagtgtagtaccaggtattgctgctggttatttgagcccaaggacacttcagttaccagggtgaataaatcctgtcaggactgggtcatttccttcgaatgagaaggttgctctctggcccagggtatgtctagaaatgttatcttgcaggtagggcctggaaagggggcctcatgactctgactgctgccctatcctgctatagaagagctgctatccaagaggcaaaacgaaatcttctccagtcttctgtctcctgtcctcaagcagagaaaaggggtctcttttggagcagttagttgtacagcctggaattaggggagaggtggtgcaagcactcctttagccaccctggatagcatctcaggaggttgtgtgccccaccctcacccccagtcagctgggtttgggcccagttcagcactaggacttaggagttgcggtcttcatggcctatactgcctttcaagattatttagggccgggcctcagggcactttagccagcagtagtgaggcttgtgggaactcaagcactgaccactgggatcagtgattcccctctggctaatgctggtttaaatggtccctccatgggtgggtgtcagcggagtttgatctggttttcctttctgctataacaggacaccactgagtccaatgactgaaattgctgcacgctgtctctctcctcagcacatggaaatgctctcctcacccatgctgccactgcctgcaggtggtggaggggtgtcgtcatggcaattagtggcaatagtcctgaataggcaagtaaggactatttttttttctccttctgagtgactctttcaataataggaagttaaaatccagcactgcgagtgttcatttggtttttggtccttaggaaagtgcttctctctgtagatagttgttaaatcggtgtcctagtagggggatgatcggtagaggcttcttgctctgccctctaatttgtaacatttttttagctctttttagattctagcattccagcatatggcaacattttaagcattaaatttctgtataggccttccagacatgggtaagtgtgtgtagagatatgtttgtgactttatgtttcctttaatatgcaatttcacatttaccaatcctaaaacattaaaaagagcataatccaaatacagtgttcaaataaacactgcagttatttgttagcaaagcaactggctgtgattctatttcaggaagattatctcctccaagacgtagaaatttgccagctacatttgtttgctactgattcctgagtttggtttgctttcattcttctttggatctcagtctcctatgcaccattcacattttctattcccagtaaaaaggtttttgtatggtcttggttttgttcctatcagtcacttaaaagaacagacacccaaaggcaagggcattaatcatctgtttgaaggtccctgggaaattattatttatatgttgatagtgaatctattttaccctttaaggggcaaaattgctagattaggaacatggttaggaaaacatagcagtcattaaccttatcgcttttccaacaaagaaaaactgtgtaacaactggccaaagcccgtggcaatttgagaacacaagagatcaacaaaatgaagcccaagatgagataaaacaagttgccagccttttggcataggtttaaaataattttctgtaaacacctatcctcaaaaatggaaatcagtgaaaatatttcataaaatggctagagaattctaaagcttacattatattctttagtattttatataagaaaaattttgtttgctttagaaatttcataacgtatttcttttagtctaattaaattttctttttttttttttttttactagcatcattccccttagtcactaagagtgaaattaaaaccactaaattttatttttttaggttgttggaattacaggttctctgaaggggttgctctgcatagattattgacaataaatatgttccaaaaaactccatgccaatgagatgagaggaattattgggcaagagccaaagaggaaccagggagatagcaagtgcaggaggaaagcacaggtatggaaagtgagtgaaagtaaaggatgatgtattagtccgttatcacactgctataaagaactacttgagactgggtaatttatgaagaggtttaattgactcacagttccacaggctgtacaggaagcatagctgggaggcctcaggaaacttataatcatggtggaagggtaaaagggaaacaagcacgtcttcacatggtggaaggagagagaaagagtgaagggggatgtgctacatgctttcaaacaaccagatctcttgagaactctatcaggggaacagcaagagaagaatccgcccccatgatccaatcacctcccaccacatccctcccccaactatgggattaaaattcaacatgagatttgggcaaggacacaaagtcaaaccatatcagatgactagccgaatgttaacctgatctgtcctctcagcagggacaggtgccctcctgctttatggatgatttaaagttattataacagatggtggtgcttcctttcatcttttactttggaattttagcattaatttaaaaaatatttcctatgaaacagtgagacaataatgctagaacattctagtggttcataaagagcctttacaggtaggattcacttggttagggcgccacattacagatttgatcccaaaattgtggatctagaaattttattttcacatggtattttatgtgggttagacatattagaataccctgcctcagtttccttgttggttgttgtggacaaaaataaatgtacttagcactgttttgaggataaaggtgttagaacactgcttgacacaaagtacttaacaaatgttagttgtcattcttagttttattaacattctcaacaggcatatgctgatttattagcttatgaaaaatacatttaagtgggtccagaattattttattctcctttcagaatactctgttcatgataccaaaataactgagaagctgcattagtctatctatgtttctttccttctttctctctttttcttctttctttctctttcttctttctttttggagacggggtcttgctctgtcactcaggctagagtgcagtggcatgaacatggctcagggtagccttgacttcgtgggctcaagtgatcatcctggctcagcctcctcattaattttaagatgattctactatggagaaaatttaaagagtgatcaaaggttctgagtggttgtaggagatgttttatttgggatctgaagactctgataaatcgcctaccaccctacacctgcataccatcacagaacagtccacaagatgtcagttgcacaaggatcagggcaagacacacttgctctttgtttctttcttttttttttttttttttaacctgtgagtctctgtatgtctctctcttgctgttgctctcactgtcggcctcctctctcctccccccacccctcactaacttttgagctatcatgttttgtttcctagattccaaggtggcactcttccttcctaacatcctttttaattccacttatgccattgcttatgttaaggtttcctgcaaatgaaatgaatcgaaatgaaataggatcaatttcttcttgcttttagctgggagagtccttaagtgtatcactgaaagtggttgctggtttgaaacaatatttttgggttatctggggccataagtaatgacatttgatttgtccacatcatcaataatggagttagtagtagactgaggttcaagaagttgaagacctgagacccatatccaagttttccactgtttacaaccacgactgcgagaggacctaactgttgtatcttccttacaattagaagagacacaacttttcccaagaacaccacctcaagagactgtttacattattgaattagactaagctttaacatacagtgagtattcagttaaattatttctcttcacatcagctggtagggacttatggtgagtacaaaatcagctatgggcaaagtttaaaatgttatattttctctggacattaattataatagaagatacatcttatgctttccacataaagaagtagcatgttaggttaaaagaattttagggtgtctgataagaaaatcaaggtcagtgtgactaaagaagagttaaagagaggactaggatggtttatggatgaagagatggcagaggctgcatttcacaaagccttgcagactatggtaatattttccattttattccaagtgcattagaatgccaagaaaaggcattaaagaaggaaagtagtacaatcagatttttattttttttaattactatgacttctatatgaagaagagattcagaagagacagattcagctgtgaactagataaggggcgcttatttcaaccatgatggagctagtagatgcacacaagtggacagatttcagaaagttttagagaatgcatgcgtaaatagcttccacctgcatgctcttgtgtacatgctctacatgtgaatatatagatctacttacatatacatatgtatgtttgtatatagatatgtatttgtttaggaacatacttagaaaagaagatagaaaaacacaccaaaatatttacagtgacttcaatatttaaggttatagtatttggggttatgtttacttgctggtttgttttgagatggagtctccctctgtcacccaggctggagtgcggtggcacaatcgtggctcactgcaacctccgcctcctgggttcaagcaattctcctgtctcagcctccccaagtagctaggactacaggcgcgcgccaccaagcccagctaattttttctgtaattttagtagagacgaggtttcaacatgttggccaggctggcctcaaactctggacctcacgtgatctgcctgccttgggctcccaaagtgctgggattacaggcatgagccactgcacccagcctatttggggtaatttttgctgccttctttacaatttttcttttcttaatattctacaatgaatatatgtaaataaatatatatagtatatatagtatatgtacacacttgtgttaatgaggcattatggaaattaaattataaatatggctagtatcaagaaagtcctaattcaagtttcattacaaaaattgtttcccactactcaaatatgataaagcacttttaacataaacaatttttataggcaaattattgtgttggaggccctctcaattggttcatgatcatgcatagctcctaaaatataagaaggtaacaatttataatacaatggatttcaatcgatgccctttgccattaaatcacactagaattcaatgacacaactgattaacaattaaattaatggtggtgaccttgcaaatgaaaagtgatatatagtatttatattttcctcatcttccctctgtttctgaaaatgtaaaaatattcttttaatgtttgtagtttttaatcttaaaaacacaatgttgaagaggaattatctggagagtgctagattagagtcaattaagatttccaaattaaatttttaaatttataactagagagatttttaaaatgttagcagtattttttccccagattatctatctgcataagattctagagaattctgagacattcttcttgctttagagttgggtgctacataaacattaatcagtgctaagtaaaaacaaaccaaatatgtgtgtgtgtgtatatatatatatatatatatgcacccccattgtttagtatcagtaaattttactagaaatactgaacaagtatatggcaagcaattgacaaaaatattggttcctgatctccttttaaatagtatctatgatgctaaataaaaagtgttctaataatagaggaaatattttcatattttaggtcatatacatatacacaacataatagggacggggagaggcatcatgaaataactcaaggtagtatactatctgaaaatttatacttatgaaaatttatgttataaaaataaagttaaattgcttttttaaaattgctttagggtttagctctctgtctacatagttggcaaccttgggtgacttattttattgtaatctattgttatgttaatttcccctattgctacttgtataatttttatatacataaggcctcaataaataaactctttgaataaaaaagaaccctaagcatctttttgcaaatagttctaaatcatgaaaacactaatattttataatgctctaagaagctaatgaaccagaaatatctttaaccaaaggcacttttcctttggttttcacaaagcagagaatcctaatggacaggcaagataaatcatttactgtgtaaaacactcatatacctattgaaagggtaaccacatcaaatgttctctggctatttaaattacctacaaaaagaaatcttagcaaagtgcaaaatgtgatagacatttgcagtctatctgtaactagcccaattccttcaaagagaaatgtgaacataaaatgcaaaagcatgactgaggagtcatttcatgcattccttgattcctcagaatggctacaagcaacgttctcatctagtgtggggcctcactatgcaaatctgccaaggttatccccgtgggcaacctacaaccaacgtgtctttgccttgggctcagtgagttgactataatggttatcctggcaagacggagctgatcctctctcagaagtagacgataagatattatccagctaaaagttaaaagtggaagacagcttacacttcaaggactggagaaatcaaattcagtaatgccatttctcagaggaagtctcagattaaggacatagacaataaagctttatataaggaaaatatttgtttaaggttgaaaaggctaagatataaacatccagtcagtttgatttaaggtggaaaaaaaagaatctaattcttagaatggagctagggatatcagtggaaactcttcttccctacacaagtgacttgacatgtttcttgtttttgattctaaagttgttttagaaattcagatgtgaaaatacaaacattctctgcttttttctcccttgtagctttgattcctcaatattcaatttgtcagccaatcacattaactctatgtccaattgatttcccatatgcctgctttattttctgtggttaccacttcgggacatccttctcacttcaatccccattcttctgtggtaggcaaaaatttgtaaatcccccaaccaagggtgtcctgtcctgatccccaaaacctgtatttatgacaagatatcactcccatgatcatgttatagtatatggcacaactgactttcagattatccaaatcagccgaatgtaatcacatcactctataaaagcaaagaacgtttttttcccactggtggaagaagagaaagtcatagagattagaaatatgagaagcactcaaatgccattcctgacttgaagttggagatatccatgtgagatgcaatatgaggagcctctaggagagaaagtggccctgtctggctcacattcagccaggaaacattatcctcatgctacagcaataaagaactgaatttttccagcaacctgaattaccttgcaagagagtttttccccagtgccttcaaatgagaacccaccctaaccaaccttgatttcagccttatgagaccctaagctgagaactcagccaagctcacatggactcctgacctatagaaactgtgacataataaatttgtgtggttttaagctgatgagtttgtggcaatttgttatacagcaatagcaaaagaagataccttcccacctagccatattcatcagatcagcctttataaatgactccattcatcttaacatttgactatgtaaaaatctacaagtcttctcaatgtttcagaccaaattcaaaacctttattttgactttaagatgccagtaaattaataagccaaagtttcttatcctaccaaaatttttactattcttgtataaagatgctcctctaatactttgttgcatttgttctcccatttgtcatgttataattttctatgtatttgtctgtcacctccattaaactggacattaattccttatattctcagtacctaggacatcacttggcatcagtagatctgtaatcccactcatggatgaaacaactccacattaaatccaggccagacccttactgttctttgaccaggccatgcagagctcctgcctctttgccttggctaatatgcttccctcagctggaatatctcatttcttccactatctaccaacgtgctgagggaagagtcaatataagacagtcaatatacgggtcctttgttgaggcaaaaaactactctggattaatgtctccttacatgattgcagaacacaactaaaaaatctgcatagaaacaagagcccactagtctggagccatagagtctccttgacactgaaaggatacagcccttcggggatatgtttgtcaatttcttaacaagtctatgaatttcttgagtaaaagaaccacattttctattttttggataccactaataatatctcgttggcatagaatatatgcttaaggaaccaaatttgcacttaagcttcacaaatttcagacaacatagcaactggtgtagttatcttactgctcactttgtcactatttctttaattcaaactccctccctgccttgacttaccaaactgaagctggatgggagaaacagtgggagtaataatacaactagggcccagagaaaactttctcaagatcacgtagctagaaacatactggacccaggattgaaacctgtggtttctgacgccacagctctgcccatcataactcccacaccttcttgcctatccccacccaactcccagtccctaacagtctaggataagaatcctttgtattcctacaaagaggttgctatgatttgaatgtttgtttcttccaaaaaaaaaaaaaaaactcacattgaaatttaattgccattgtaagaatattaaaaggtggaacctttaaaaagtgactgggtcattagagctccaccccgctgggtaggatatgtgctatgacacagggcaagtttggtgacctcttgccgtctcttgctcttccaccatctgcaaggggaagaggcaacaagaaggcccttgccagatgctggccccttgatcttgcacttctcagattccagagctgagagcctatacagttccatctattacaaattaccccgaatcaggtattctgttatagcagcagaaatggactaagatagtgtataattcatgggtagaaaaataatgaaatgacatgagtgttttgagataggctttcgactacaaatattagagacaaaccctaaaaaggattacatagaactatctttatatgaatacacatatcagacagatagacattcaaacttcctctgtccaagtcctatacatgccactccttagtattttcagattgcatcttagagaaatcattattttatatcaaaaagtagctggccttgacagagtataatcaggttcacagtttatggttctactgtgattaaaattagaactttgatgcttgttttatagatgagaaatgaccttcatataatgtacattgttagtaaatgatttctaaaaccacctagggcatttctttaaatctaattaaaagcacaatttcaaaacaagcagatcaaaatgtttcctataaatcagcctggtgtagtactaataaaaagtaataaggagaaaatattttaatatttacatatgaaaagaagttcatgctaaattttacaaaaggcagttgtacctgctaattggatgtgttactaaacataatttatgcaaagaattcaccttttggtgtaacctaatatatatatcagtcattacattacattgatattgctagattatggtggggatcaggtctccctagcttactgcctgatatgtaagtatgcaagaaatgttacagaatggagatagaaggtaaagaaagacaaacgtagagtaatgtggaaaggaaggggacagagtgaagggagaaaataaagaagacagacaaagaatataaaggaatgagaaactagaaaaaatagaatgggagggagggagaagaaagggagggagggggaaggaaaggaggaagggaagaagtagaaacagaaagggagaaaggaagaaaaaagagaaagggaaaaagagagaaagggaaagaaggaagatgtgagaaagtagaaaagggagagaaatggaaggcaggcatactccttgccctctttttccctttctcctgctggcaaagcctgctcctcagccagatgaaagatttgttgtcttaagcatgccatgttctgcaggtctcatagctgcctatttataccaacccttttcctcctggtaaacttctcctcattgttaaacattcaaacagtagtgcctcccctagtccaggtgcttcaggaagaatcagagacaccggccttcctgcttccctatgacttctgctgtctcagagagtcaagtgaagttaccattagatacttttctcattattgtgtacctgttgctgtagtgataggtggtctccccattacggtgtgatctccttgagtcaggaaatggtctcagcactttgtattcctagattcttgcacagggcttggttcacaggaattattcaataattctataaattatcacattcagttctcacaactaaccatgtgaattaggcgttatattctacatttcaaaagagaataaacctcaattcagattatttaagtgacttgtacagtaacactcgtgtaagtgagcctgaaaataattcttttgttttcactgatgagatctagaattgaaataataagttctaagaattaaagtacaacaaactcccatgacacaagtttatccaagtaacaaacctgcacttgtactccaaacttaaaagctaaaaaaaagaaaatgccaccaaaagttctttaatgtatttttaaatgataagtggaaataaggccaaattgtggctgtttcattgtgaatttttgagaattgtattcttcccacgtatctatatgagaaagggaaaatttgtgttaatttatgaaacagaaacctaagatgcgccatgttctcttatttgttatttataggaactggcttataaaactggggcaaaaataaaataaaaattctacaactgaaagcatttgcatttgttttagacatagagttttacatcaactaaagatttgtgaatttttggtgtgttctttcatatattaattcaataaatgtttcctgcccatatatgctaagtaagcactgactctctgtttaatcttactttagtttacacttgttaaaatattttcccatgccatacatttctagttcaaacatggaattaattttctttggtggctttttgttggttttccaatcttatattttgtttattttgcaataggacgtcgagtttaagtaaactatgtgttcagccaaggttatgcattcctcttgttttataaattgtcattattcatacaagactttgctcttttctactgtattatacagtattttgtgattttctttattttgtcttataattacagtttgggatatatattcagtatatcattttatatttgaccaaaatcacaaatctattaatattgctaagacagttttccaacagagctatgatttccgagtatttgccctataacttcaaggatacaataaaatttaacttaagggcttaaaatctaagcagaactggtgctgtttcatcaggcaatgcattgaatggtttataaactgaacatgaaaatgtctaaaagaaggcgtctcccagagcccattaaccttcaagacgccttagcctttctctttttttttttctgacatgagtaaagtgaacaggattttaataaaagtcctgcagcagatattcctgaaaggtcagggctcatgataaagctgccagcactgcaactttaagaaaagagatcccgacgacctttaataacactaggtctgccagtgctcattgtagaggatctgtattttaaaattccatttgagaaactgactcccccatttgacaggatcatggtctttaatcttacttttggtgtgtaagagctggcggtatgccccatggaaacttgcattttgtatgcttctgaggaccttgggaaataattttctctagtgatagaaatgcttccccgtcttcaactttgactttctgatcacccatttcattaatactaagtacaccatatctgaaagtagaaggaatttaatattgaagaagtagacttgattcaccaaagcttctatttcatttattttcattttcgttccttaatctctcttcagctttttatagattgaataactctgaaatcaggaattagtgatatacaacagtaatttccacatctatgttttcactagcagaacaaaggtacaattattactaaaaatatatttgttattataactccaatttaataaggggtaaacaaagactttaaaaacttcagtaagttgctcgagttaacataggtaataaataacaatgccagaatttactgttttcagatcactcagtttcaaaacctcatacaatttccattctctaagatgtacatctacatttctgtcttcatcatctcagtttaaattaaattaacaaataactctttggaagctagaataacattatgagtaaaaagtaaaatcttgatgtaaactattccagagaatagaaatagagggaaactttccccattctttttgtgaagtaatttcatcaatgaaaaatctggcaaagaatttaccaaaagaaagcaaaaacaaaaacaaaacaacaacaataacaacaactcagaccactctcaccagagtgccaatcgaaagtcttcaataaaataacactaaataaaattgaataccacattataaatgatatcacaccatcaagtgaagattcttctagcaagccaaggccgttcaacactaggaagtctaatagtataattcacatcataataatagagccaatgagtaaagcaatatcataatctccagagatgttgaaaaggcatcagacaaaattcaatactagtaatttaacaaaaacaaaaacattctgtaacataagaattgatgaattgatgactcctttgtaaacatgagagtgtacttgtatgtatgtatatgactatatttgtatatatagttttgtttatatcttcatcaaaagccatttatatctccatcaaaagcagtatttagccagcatcttccttaaaggacaaacactagagacctttccactagaacaagatggtgctacccactgtttttactgtgatttaatattatattggagatctatgacaaagaaagcaattagaggcctacaacttggggagacagagctagaactacctctgcttacagatgatattattagttacttgaaaactgaaaagtatcaatgaaacaactagtatatagaaagagagaatttaagaagatggcaagcataactttaacatacagaaatcactagcctacatgtaattacaaacagttttgaagatattatgaaggtgagcagaaaaccttttaaccttaattccaaataatagtttttcaattttttttctttcattggagaggtggggcaagtgtgatgtgtgcctagaacaatgagattttgtgactcagaagaaaggaaagaggaaacatctcagtagagaaccttgcatggggaagagggaaatttgttgctgtgaagcagtactttagaaaaattaatcacagaaaaaaatacaactagatactttagaaaaattaatcacaggaaaaaaaatacaatcaggatgcgatgagaacctgaaaaggtgaagcagcagtgttaatggaatggacgggataataggagacatttaaaaggatcaaccatattaatggctggaatcaaacatttgtagaaagaagtaaatcaattaaggcagggacagaatgttaaccaggaggtctgtataatcatttggtgataagtgtagaaacaccagtaaaaggagtgctatagaaattgtggtcaataactattccactaagagtttctactagttcacatctcttgatgaaaatcatttaaaagttacaaagtagtcaggccttcgatatgaattcaaaactaactggaccagtacttttcctttttttctgatattttcctttgttctcatatgtctattccaaaaagccaaatataaatgcctttcatttcactgtgtcatgctgagaaaggcaagatgaaaagggcgagaacaaagaaaaagaacagatgaaaaagtaatgttggaagttgtaaaggagttctctgggcttttttcccatcacttacaagttggaaggtgaaaattaaagctcaccagacatcaagaatgtcattttccttcgactcaatgtgcttccattttgggttctttgcagttgtaacgctcagccggaaattcttcttccgccatatcctacatcgctgatcacttggtcaaatgccacatcaccagaaaagcccatctcccactgttctgtatcccctgaaccttgctgtatttcccactgtagcgcttactgtatatttagttcataatttatctcctgtcgtgagactacaaagttcaagatatgagaggttttttttcctgtttttcttatattcccttcgctgttgcattctgagagcctgaaactgttatctgccatatgataggcatccacgagatattggttaaataaatgaatgaacaaattaatgaatgagcaagccctagaaacagtattctacaaagttcttacaattatattttattttgtaatcaagacaatttcaagaaagaaaaaacaattagagcattttccctttaaaaaatactaagcaatatctatgctacatagtttattttcaatgaatcaacaaaaaaaaaatctgatctttcttgaattcttgaagttgaccagttttttcaaaagggaggcagtgattagttttgggtggccacatctcctcctgcctgtttccagctctttctctttgtattagggtatttctccttttcattcagactcacatttgttaagcttcaaagcactccatggtttattatggatttttcactctaggaaagaggtcatcactttattaaacattaaataatggtgataatcaataataattgatatattgtctctattggtactatcagaaaaaacaaacataagcatttcaggttactatgtgcatcaagaattctaatgttttgaaaatctgcataatatatcaaatgtgctgtgatttatttatctacctgtttagtgttgaacagtaaattttattccattttttggtgttataaatagaaacgtggatctctcttggcacttgtccttatgtccaatttcatcccaaattcatgcaaaattaatcaaattgcaagctcttgatgcatagactcacaagcaaaagtctacttattgagatactgtgttgataacatgatataactttcatgttgcttctctctaacttatgaacttgttgtcctttcatcagtgaaaatgaaaatgaagaactatcacttaagaaagttctactacagatacaccagggctttgatatcagacttgacctgaagggctcctctagttatgagctgagggatgagaagcggacatgcaggaagatccccttggcatggcaacctttgcaaagcactgcctgatagtctccctcctgctgtgcccagtgtcaagagaatgagcttataatattttgtaaaatatgtagattgagaaatcggaatctcatttatcccagaaaacagatttcctagtatcaatatagcttaactttttcttgaaatgaaggtcattttacgaacataaatttttctccaaaatgaattcaaacagaattttaaaagtatggagctggcataaatattttgtgaactgaatataaacactttgacttcatttctcatatgtatttcacatgcatgaaatcaagagagaaagaaattccattggcattcagccaaggaaattgattttttttttaccactgtgccactatattatggtttattatctccagaatattactctaaatagtgctacccaacagaattttcagcagtgatggagatattctgtatctgcactgtccaatatggtagcctctagccacacatgattgttgaacacttaaaatatggctaatgcaactaactaaggaactacattttaattgtatttaattttagttaattttaattttggttttaatatttgcatttggttagtgggacagcccagccatcgggtaggtcattccatttctgcatttcttttatcctctctccacattctgcttgaaagctgagaaagctgccttgtacctccagttctatgatttcactctggatactgctagaaaagtagccctttacctatgacagaatggtggtttccagaatgtactaatccccaaacctatgaatatgtcacctgacatgacagcagagactttgcagatgtgactaaattaaggatcttgaggtttagagattatcttggaaatgtgggtgagctcaatatgatcacttttcagagggaggcagtaaggttagaaatgaagaggagatgaaaagactaccaggaccaaaacaggatagagaggaaagaagatgctacgttgctggcttgaatatagaggaaatgggccatgagccaaggaatgcagactgcctttcgaggttggaaaggcaaggaaacagtttctctccaacaagaacttccacatttgaaacttctggcctccagaattttaagacaataaaattgtgttgtggtaagccactaagtttgtggaaatttgttacagaaacagtcggaaactagcattctgtcctggaaaatcacttgttcccaggacactgatctgtgatgaaataggtaggtctgaaacaggaaaccaaacaccgcatgttctcattcataagtgggagttgaacgatgagaacacatggacacagggaggggaacatcacacaccagggcctgtcaggggatggtgggctaggggcggaatagcattaggagaaatacctaatgtagatgacaggttgatgggtgtagcaaaccaccatggcatgtgtatacctatgtaacaaacctgcactttctgcacgtgtatcccagaacttaaaaaaaaagaaagaagaggaaaaataggtctgcggtgctgctccacagagagcggccaggaccccatttcatctgccaaaagaaaatgtatacgcagactcgtattgctggagtccattatgccttttaagaactatgcctcttaaacagtacggtgcttgtgggtaaatcatccctgccatttttcctattcaaacatgttctggtatctactaacacaactgtattaggtgtgtaaaaggcatctcttccctgagtctaagcagaagtgctacctcgcccccctacctcccatcaaatctgtggctgcataaattgactttataaagaaatcctgctttgcttaaacagctttggaaagctgtttaatatatttggccgtaattggttttgttttaccatctggtttagacttccccctcagccaactttaattttgaagttaatcatttttaaattgggctttgaatgcacctaggtcagatttgccacatcagaggagagtttatgtttgcattattctcaaaaagattcttcagttttgctttgttttttgcagtttatttccctatgtgagtttcatttaaaggaaattggtgcctatactaatagctgagtattcacatgtgtggaagactttccttggcattaaccattagataccatctgatgcagctgtcagtgacattggatgtgcatggggctgtggaattgaatgttgaccatagtattctgcatctagttagggaagtcaagcagtaattttgatctttctacttagtcaattgtttggccgaatacattgacttatttgggagagtagaactttttttggtggagaagaagttgtgtcgtgatggtatattttgagttaacctcaatcatgacaaaccagaatgatttcctagatgcacagagaaggaaaatgttaaagactctcaattgctttttaatatataatatgcaatatggaaatctgtcacgacacttgaaaagaaaacatttataagtgaggcctgcttcacagtaatgacaaaaacaatagacactaacataaataaataaatacataacaaaatatttgccaataaactcaagtttagatttcagtaattaggtttggaaatgcatctttgctactgagacacaaacccctaaaaacaaacagttcattggttgtatgaaatgctgagaaaaaaaatggtttcaaaaaatgctaatgctgtaataatttgaagagaataaaagtaggatcaagatcctctaaccaggatcaaattattgcctatccatttttctgaagggcaatcagacgatttttatgtaagataataaatctgtagaagtgaactgtttgtaattaaacatggcacatcatttcatgaccatttataaagtcaagtgcttgttaacaaaaccgattttcattgttattactttctttaaaattattttcatgtgagatgaattcttttcttgaaagtagtccagctttgggggcattctgaaatttaattatcctgggcttgaaaaaaagctacgttttgacttaccatgttttttgtttgtttgtttctagtgaactgaagaataattgaataatgagtttatagtaacaattttataatatgcatatctatcatagaacaggaactacagtagaatcattggtgcagtcttgatttcttaacttaaaactaaaattagggattgagtgcctcattcgaaaatagcagcatttaagtgaatgtagagttaacttataagaatgtgaacaatacaatatctttccaatatttaatgttatcatttgtcatatataaaaataattaaaacatctctttcctctcccagttttactttcaaagtttcagcaatagtcgattccctgcatacacaatttaccatgctgctaaaagcctttatacctaattttgcccacactgctctcgtgacccagagttccttttcatattcttaaccctcatccaccctgcaaactcagctcaagcaccacatctaaagagattccagaaggacaagcctccccatcaccaccatagatagcatcatatatatagcaaccctgtatgccccacagtatcctgcccatgcgtctacgaaaacacttcctgcattgcacggaatttgccaaatttgcttagagtccccagtgcttcatacagtgcatgaaacataataggcagccaataaatacccttttcatttataaacaagaatgtaaagtactgcttacttctcactagtggtttcttcaatagaccttaaagataccttctctagaaagcatttcattttccagcccctattaacgttagccaatttacttatacagtcaatttcatgttttgatttgaatgtatgttctcaaatggagccctaaagatatcagtacatttaattccatataaaaacaaataaaacagtgtttagcaattgacgttgggacataaacagatgaaaaaggcagttgtcatataccatagtaaccagaacttccataaacgagttaagacctttaaacgagaatacatttgaaatgatttatttctataaagtcttgcttagttgagtattcacataaatagtgacaatattgtgtaatcaatgggattttttgtttgtttgtttgttggtttttttgagatggagtcttgctctgtcacccaggctggagtgcagtggcgcaatcttggctcactgcaagctccgcctcccgggttcacgtgggatactatattctaacaagtgtatcgagaagtaacagttatgaacacacttgttttgaatgtgctgtaaataacaaaatggtaaaactgttttatttgaattaacacattattaaatgggttatgttccatctttactaaaacaaagcatgagattatgatgaaagagtaagcgtgtaagtcaccagttctatctcccactacttgttgacatttatgagatgagatttgtgccctgggtcctctatcattttttaacagaaaaagaaacaagtgtgaagaaggctagaaggcaaggattaaggatattaatcttagaattgtatggcaatagcaagctgtgagacctttggaaagctgtttaatatatttggccataattaagtgcatctctgaaggaactattaaaaacagatgctttaaaaaaatgttacaaccttgaacttttttgattctttttgggcttgaacatctaaaatagatgaggagaagttccttaaactgttttcttcaactcagtcattaaaacacatttattgagcttctactatatctcacgtgcagacccaggtcttatagcaataaccctcccccagaaatttagaatctaattggagagagagtaaaatagagataaaacaaaaccctgtgtcatgtacctattaatccaatatctcttggccttctgaaggatcagaaaacttaactccctgccttctttcaaacatgttcaaatcctccaactccagtaacatagatctcttttcttcactttttggcaaaatcaacagcctttttgcaaaccgtatctgtcacaaatggcctctcacagagagatttctagctagctcaatttacaacaaacattgccttccaaacggaatagcaggttttccaggaaattaggtaaaatagcaaggaccataacaaaacagtagtaattgtttaaatagtttaccacaatatttattttggatcagctacaaaagtaatgtcagaaacttcatttcagtttcttcagtctacaaatactaaaaatctgcataaacacagtatacctatttggccccactactaaaaaaaaaaaaaaaaaaaaaagagctagagccagacattagagagaatgtgtctggccaaaagacatcccaattgtttaaagacaatacatatgtgtgtgcttgtttgtttattggtgaataagaattatttaagtatatattgtgtgctttccaaggatctctgattggcagctatgattctccactgtaacttatgacaattctgtggcattaaaaagtactagggcagggtgtggtggctcacacttgtaattccagcactttgagaggctgaggctggtggatcactaggtcaggagatcaagaccatccaggctaacatggtgaaaccctgtctctactaaaaatacaaaaaattagctgggcctggtgacgcatgcctgtattcccagctacacgggaggctgaggcaggagaattgcttgaacccgggaggtggaggttacagtgggccaagatcgcgccactgcactccagcctgggtgacagagtgagactccatctaaaaaaaaaaaaaaaaaaaaaaaaagtgcgtgtttgtgcccaagtcctgactgtgtcacaaatgtgctatgtgaccttgagcactcttaatatcatggaattgccacaatttttagtttcttcatctgtaaaataaaggcattaaataaggagttctgtaatttttctagctctaaattttaccactccatttcagtggtttgaattttctttgaacccaggagaagtgaacagatgtggattttacaatttaaaaatttaaagcaacagaaaagcatacacacatgcatcatgacaatttcatagcagtgtgattttaacaggctgttaccttaaggtctgaaacaaaaataaaaagatcttcaaccatattcataggagtgaatataacattagatgtctaagactgtgtaaacaatcttcatggccaagaggctcaattataatgattctctcctgatatgtatttcatttgatgtgatacatatacaccatgaaaaactatgcagccataaaaagagtaaaatcatgtcctttgcagcaacatggatgcagctggaaggtattatcctaagtgaattcatgcagaaacagaaaaatatcacgttctcatttataattggaatctaaacagtgggtatacgtggacacaaagatagaaagagtagacactggggactccaagagtgggaggaggggcagagagacaagaggacatggttgaaaaactacctacggaaaactttatttattatttgggtgatgggttcaatagaagctcaaacctcagcattacacaatatacccatgtaacaatcttcacatgcataacttgaatctaaaattttgcttaaaaaggaaaaaatgtatatttcatttgagatttcccatcatctacagctcttataaattgcagtgatgtcagtggtctttgctgaagattttatgcgcataaattgtgttctcatagggagatttgacttcatatcttggctactgacatagaaacattttttatattatgcgcataaattgtgttctcatagggagatttgacttcatatcttggctactgacatagaaacattttttatatgtctaaatggcaaattgctcaatttaagcataaatcaacaaatgtatcaccaatatttcagcagacgctaattctttttcccgtatcatttaaaaagttattagatccgctggcttgatggggtcaattccagtttttaaaatcttggtccacgtgtctatgtgtctttggacagttctaggcatccagtgccccaaagtcatgggagacttaattcagcaaatcatatgctaattgaatgtcttccctggtgcagttcttccctggttactatttttacctttcctttttaagagttggggcaaaccttatggtatcttctgaatacaagtcaatattcaatggacgttttaaataagttaattgtatctaatgtgtgtgtagctcaatgtaaacattgccatatttatatctactataggagccaagggccctctcaaagctcactgaaaaatcaacttgcaaaaagcatattggagaaaaagcatacaaatgtatttaatgcatatacatgggagcctgtagaataaaggccaaagatacagaggaaattgtccatttttaatgtctacgttcaaccaagtgtggacagccatctagaaacatgattgaaggaaaaaagggcctgatctaatgctaatagatttagtggggaaacccaacaaggcctaagttcttcttggcctctctctacagcattccttctttcagggtatggaaggaccctctctggaatggaggttttatgacctacagtcaaacaatatacaatatatcaattgtatattgataatttcttatggccagtttttacacagaatggtggagggaaaattagagtgatgtttttaggttttatggctggctttggggaaaaggggttctggtttctatgacccactttggggaagagggattctagtttttatgactaaccttgggggataataggatctagacacaggagagcaggaaaagtacagagaaaatcttttgcttctgagactgccactgaggccttcatttgggatattgttttctgatccccaacatctgagcatcctagaaaataaaaatttatgcagtggctcattcctgtaatcccagcactttgggaggccaaggtgggctgatcgcctgaggtcgggagtttgagaccagcctggccaacatggtgatacccccgtctctactaaaaatacaaaaattagctgggcatggtggcgggtgcctgtaatcccagctactggggaggctgaggcaggagaatcacttgaaccccaggaggcagaggttgcagtgagccaagatcatgccattgctctccagcctgggtgacaagagtgaaactccatctcaaaaataataataataataatttactaattacacacttctgccttgggagaatatcttttatttaagttaatgtatcttatataggcttttagaagccatttgtgtctccttatttttcagaatactgattgcagcatgtttgatactttttaagcaaaatcacactgaaaataagacatttcaactgttcttcattagtgaatatttgggagagcagaatgcaatgatgcttatctaaggggatgtttcagtttgatttcagggctgtaaaaaatggtgaagccattaaaagagacatcccacttcaaatgatatagttatatttgtaaattgtcctattttgttaaacttaaaacagttctatatttaagtaactgtaactacttgtaggcattcggaagaataaaccttaaaataatttattgctttcatggtgattttattgaaaacgtcacttcctttaaatcatttcatcaattattctcataagaaaatacaatgtcagtgaaataaacagaaaatcaaataccacatgaactcacttataagttagagctaaatgacgggtacacatggacactcagagtgaaataatagatactagagcctccaaaatgttgcggggaggaagtattgaaaggtcacctgttgcgtacaatgctcaccatttgggcgacggatacattaaaagctcagacttcaccatatatggatgtgagacatctgcacttatacccactaaatacaaataagtaaatgactgacacgatattatattatccaataacaattactcatactagtaatttctttaagaaagaacagctgtggctgggcattgtggctacacctgttacccaatactctgggaggccaaggtgggagaattgctttaggccagaagtttgacaccagcctgggaaacatagtaagaatgtgtctctaaaaaaaattttaaaaatcagccaggcatggtgatgcatgcctgtagtcctagcttctcaggaggctgaagagggaggattgcttgagcccaggtgtttgaggttacagtatgctatgatcacagcactgcactccagcctgagcaacagaactcacatctgtaatcccagaactgtgggaggccaaggcgggaggatttcttgaggccaggagttcaaggccagcctgggcaacatagagaccccatctctacaaaaaaaaaatttaaaaatataattagttgggtgtagtggcacgtgcctatagtttcagctatataagaggctgaggcaggattgcttgaccctaggagtgtaaggcttcagtgagctatgattgaaccactacagtccagtctgagaaagaccctgtctcaaaaaaaagaaaacaaaatagaatacttacaaatttatggtgttttcattcttgtatagctttggtattcttgtatacttttgatattacttgtatattgattaacttgtgaaaatatatctttgcttaactattgggtttctccaagtttggtcttgcttttctaagtgttgtatctatatataaagccttcagtaattttgcaggtaacgggacttatgttaaatattgtcttttcttcatctataaatgaaatagcattctgatagatgagattatgtaaatcctttagtcagacgattagacttactgcataattatattttagacatgagatcatatagtagcctcaaattgtatgacagatttgagagaaaagggataaataatctaaaactcacttgaaagtcagcagcctgagacattctctgtttctgtgtacaaatatgttagaaaaatggttctgaaacactttgacattcctcactacttaaagattatgtaagaaagtagcaggatggaaactgccttattattttcttttttcttcttcttcttcttcttttttttttttccccccagacagagtgtcactctttcacccaggctggaatgcagtgacacaatctgagctcactgcaacctccgcctcctgggttcaagccattcgcaagcctcagcttcccaagtgcgccatcacgccaggctgatttttgtatttttagtagagatggggtttcaccatgttggacagattggtcttgaactcccaggctcaagtgatccacccacctcagcctcccaaagtgctggggttacaggcatgagctgccgtgacagccaaaaactgccctattttcacagtgaatacacaaaagagctataaaattaaaacatgaagctcctttgcagtaatcattaatggagcacaaaaccctcaagccagcctatgaaatgccagttcaattccgtgtccgttctgtaattcaggaaaaactctacaaaagtatcttacaaaggaagtattctgctttactaaatctttcctttaatgaaatactgatctgaaaacccctaattgaagtaggatgaaattcattcaaaaaatatcaagcatgtgccaggcactgtatgccagtgaacaaagatgcatgccttcactgcattttagcagagggagtaaaacaaagaaacggcagggcagagcaccaggatgtcaggctgcaattttttttttttttttttttttttttctgtgagacaaagtctcgctctgccgcccaggctggagtgcagtggcgcgatctcggctcactgcaagctccgcctcccgggttcaagcgattctcctgcctcagcctcccgagtagctgggactacaggcgcccgccaccacgcctggctaattttttgtgtttttagtggagacggggtttcatcgtgttagccaggatgatctcgatctcctgacctcgtgatccgccctcctcggcctcccaaagtgctgggattacaggcgtgagccactgagcccggcccaggctgcaattttaaacagagcgattagagcaggcctcattgggatggcatttgtgcacaaagtcaaaagtgatgaaaaaattatccatgaagttttgtgggagaaaagcattctaggcagacactagcagtcacaaagatcccatggccagctacactggaagaatagcaaagatggccgttgtggacaaggcagagtgagcaggaggaattcaataggaattgaatgaggtggggtggagtgcatgtaatttagggctccatagaccattgtaagctttcttttactcaggtaggaagccatctaaacaagacttagacttttaaaggatcagcctggttgctatgagagtagaataggttgggtgagaagagacacagatgaggcaaaataaacaccagccgggaaaccacagaaataatccaagcatgctatgatagtgtcttggatgagaataatagcagtagagatggtagctatggtagtgtcttggattagggtaatagcagtagagatggtagctatgatcgtgtcttggattagggtaatagcagtagagatggtagctatgatagtgtcttggatgagagtaatagcagtagagatggtagctacaatagcgtcttggattatggtaatagcagtagagatggtagctatgatagcgtcttggattagggtaatagcagtagagatggtagctatgatagtgtcttggattagggtaacagcagtagagatggtagctatgatagtgtcttggattggggtaatagcagtagagatggtaagattttaggtaagattagatgaaggatgtgaggagtccaagatcatttctgcctgaaaagccagaagaatggagtggccattaagtgattgaggacgactgagaagaaaaatttcagaggcaaaaatatgctttatttatttattttgaggtgtctagtagatacctaactgcagatgaggtggggtggagggcaggtaatttagaggttaatataatctgatgtccttataatgagatgagatcaccaagatgagtactaagagaggaggcaagcagcccaaggtcgagctcgggggcacaccgatgttttatcaaaattcagggaaatgaagattgagccggcagcaaaagacagactgagaaggagcagccagtaaaggagaaatgtcaagcaagtgtagaaatttgcaagccaactgaagagtgcttcaaggttaaatgctggctgctgattagatttaacaatgtggaaatctttggtgagttttactaggagtagaggagtggagacaaagcctaatcacctgtcagatgacctaaccaagtgtccaaacttaacagcctgaaaaagccataactgtatgatgcaatatggagaccatagcatcaccttgcactcttgcatacaaagtttaacctgaaacttaaaaaatttagacctttcagtttacaggaagttcaaagggatattagaagttaaattaatgacactacaaaggaaaactctacaagacaacaggcctagtatttccagaaagtgagaatcttaaatgaatcctgtttgggggatgagggtagctatttacaaaagagacacatggaaaaatctgaaataagaacttgatgttaaattagggaagtattttaagtggggcagtggtattgagaatattatatagaatcatgttcttagcagatgtatgtttaagtattgtcgtgtctacgactttccttgaaatatttcatgtaaagcaaatatgccaaaatattttaaaaaaagaaaagtggttctgacagccatttccaactattcaaactaattgatattcacttactcagaacttcttcaaccattacttcttgagaacctactcaatgccagacagtattctaggcaagggataaagtgtgttgaggaaacagacatgttccctactctcatggaaattacaggtcagtgaataagactgacaatgaacccgagaggtatagaactaaaaagtttgataaattaaagagaacaacaaatggtaatgtagatgaaggtggtgactacctcagattgggaagacagaggagaaacgtttgggaaattgcatttaagggaagaaccaaaaaatacagatctttttgtaaagattgaggaaaagagtgtatttgaaaaaaagaagcatgtgtgcaaaggcagcctcacacttttctgctcagtgttcagttgacacctgcccttgttttgcttcttcgtgggttatgctatagaagaggagcatgaggcagcagtggagaagcaggtagcagatcatgcaaaaacatacaagagctcatttcttcctaaatgaaaggagaatccattgaagtttttctttttttccttttttttttttttttttttttttttgagactgagtctcactcagttgcccaggctggagtgcagtggcatgatctcggctcactgcaacctttgcctcccaggttcatgcgattctcctgcgtaagcctcctgtgtagctgggattacaggcatgccccaccacgcctggctaatttttgtatttttagtagagatggggtttcacaacattggccaggctggtctcaaactcctgacttcaagtgattcaccgacctccacctcccaaagttctgggattacaggcgtgagccaccacactcagcccaacaacgatttttaaagtagcgtgacatgtgaaagatcagtctgccattttattgagaatgaattaaagcaaggcaagatttggaaggggcagtctagtcaagaagctgcaaaatggggtgggtggggttaggaggttgaactggagtggcagagacacagaaaagtggacagattggagccagtttccaaacttctgtttacaaagctttgttaatgattgatgcagaagtgaaaggaatgtgaagaatgacttctggtttcatggtgccatgaactgtgatgagggtgagcagaggagtagcaaaattagagaataacatccaaagatatgtttgatcatattcacccagcaatgcctctgatacctctaagtgattatatcaagaagcaggtggagtgtccaagtttcaggctctcaaagtctcaactagagatacaagtttagagccttcttagagaaagctaagggctgagccctaaggatgccagaactcagagttgaggcagttaaggaggggccaggaagaaacagggatcaactcagggcaataatgtgagttcaaatacgttcatagactgagaaaacggaggttgtgaatgcctgtgagaaaaggagcttttgtggacagatgagagtggatttcaggttggagttgactgaagtgttaagagcttgcttcagtgaatctttcaaggagtttgtctatgaaagggattagggaaattaggaactggagagggttatggggccgaaagggagagttttgtcatttgttttaggtaacattaatgaccacatattgagagaagtaatgcagaagaaaagttgataattctggaaaagtgtaagttgaatgggttgacaaagccagaggagataggacacagagctcatgcccacagagacgctcctttcaaatagcggcagcaccgggagagtttcctctgttctggttgtgtaattgtgtcgagggtccaattaccttcctgaatttttttttaatgtaagtaatttgttttaattgacaagataatgaatacctttggtttaatttatttttaataatacgaaagggaatatggtcaaatataagttttccctgcacctcaggtcctctccaaggaaaccactgtaacagcatccagtgtcttcctttcagaaatattctattcacagataagaatatttatgcctatgtagatagatagatatggatataggtgattctacatttctgtggtatcagtcacattctgaagaggacagaactgatccacttaaattcgggtgcggtggttcacacctgtaatcccagcactttgggaggccaaggcgggcagatcacctgaggtcaggagtttgagaccagcctgacaaacatggagaaaccctgtctctactaaaaattcaaaatcagccgggcgtggtggcacatgcctgtaatcccagctactagggaggctgaggcaggagaattacttgaaccttggaggcggaggttgtggtgagccgagatcgcaccactgcactgcagcctgggagacaagtacgaaactccgtctctaaaaaaaaataaataaaaataaaaaataaaaaataaagttttgtttttacaaatggttgaattacaagggataaagggacctacacagataatgcaggaatccagggctggcagctatagagctcacaccaccctgggcccaaggatatgatggggttgcagagattagagagctcagatgtgtttgagaactgaaatgagccacagttttttaaaaagtgtgacattcttggccgggcacggtggctcacgcctgtaatcccaacactttgggaggccaaggtgggcagatcacctgaggtcaaggagttcaagaccagcctggccaacatggtgaaaccccgtctctacttaaaatataaaaattagttgggcatctgtaatcccagctactcaggaggctgaggcaggagaactgcttgaacccaggaggtggaggttgcagtgagctgagatcgcaccattgcactccagcctggggaacaagagtgagattttgtctgaaaaaaaaaacaagaaaaacaagtgacattcttgtgacaaccaaaaacactgaaaataaaaacaaatcattataatatagtgtagcacagagcagacaagagaagtgactttcttactgaaggctgactgaggcagtctcacaagaaagaaccaggaaaatgcataacctgacctaaatcttctccccactctaatctgctgatagggtaagctcaatcaaggagaagtttaggatctctcagtgtactctgccttatggagctgagggcagggaggggaaagctgaagagtgattcttggaggggaaaatggagatttctgaccttcatgcatcaccacaatcaattcactattcacacaacagctagaacaatcgtcatttaaaacaaatggaagcatattataaacgctgttctgtccctcttgctttcttcccctggcaatatatttttgagattgtgtcttatcagtacacatagatctgcgttgtctttttaatggctgtcaggggttacattgtacagactcccttaatttattactaagtttctaaccaataaatatttttccctagattttttggctgacacaaacaatgatgcaataaacatttttaaatatgatttggggaaagtacactagtgcgtgtataagataaattcttagacatgaaatgactaggtctcaatatatgcacatttgaaattaatagactttatcaaattgttctccagtgtgcactctgatcaaaagtgcatgagaaggcttttcccattaaatatcagagagatgttcaatgaatctcattgaaatttaatttgggctgctttgattatgaatgatgttgaacattttctatatgtttaaaagttatgtgtttttttttctgtgaactgccctgttcaaaccctttactcatatttcaattatattgtttcttattagttcctgagtattcttcataggataaagaaaatggtcctttgtctaccatattaaaatatgcttaccaatttgtctttgtatttggctatgtttggtcactcaagatttaaaaaaaaaatatgtagtcaaatttattaatggttcctggatttgtgtcttcattagaaaggccctctatattagttgtttataaaaagtattccaccataccttattatgttttattgccacatacgtttaaatctttcatctatctggaatttattttggcaaaggaagaaggaggtctcactctttttctcacatgatagctgattgtcttacatcatttactaagtaaagcactttctccactgacttaacactgttaacctaatttgtataagtctttgtatttatttctggatttttaattctattctattgatctatctatattttaatacaccaatattagtttatatttactgtgggtctagtaaatattttatctactatcgataatcttacctgttaagctttaatttcagaatataatatccccgcctctgtttatttttattttttatttttatttatttatttatttattttgagacggagtctcgctctgtcacccaggctggagtgcagtggcacgatctcggctcactgcaatctcctcctcctgggttcacaccattctcctgcctcagcctcccgagtagctgggactacaggcgcccgccaccatgcccagctacttttttgtatttttagtagagatggggtttcaccgtgttaaccaggatggtctcaatctgctgacctcatgatccgcccacctcagcctcccaaagtgctgggattacaggtgtgagccaccgcgcccacctctgtttattttttatatcaattttagatttcatcatgactttttaagtttcccgttagtagtgtttgtggttatattctcccaacatctaggtaccttggatgtctttctcgcttcctctctctatctctcatcttccttctacctacatctcactatatactctctctcctagttcatggctacccataaacttttcctagtctgcccctgcagtgtgtaatcaaagatacaccaggttggtcaggcgcggtggctcacgcctgtaatcccagcactttgggaggccaaggctggtggatcacttgaagtcaggagttcgagaccagcctggccaacatggcaaaaatctgttttctactaaaaatacaaaaattagccaggtgtggtggcaggcacctgtaatcccagctactcaggaggctgagacaggagaatcacttgaacctaggaggcggaggttgcggtgagctgagatcatcccactgctctccggcctgggtgacagagcgagactctgtcatttaaaaaaaaaaaaaaaaaaaagatacagcaggttgtggtgaaataaaatgtatctatggacgtgaagcagataactcaaacttgatacttaaaacaagtatgttacatattcctgtgcatttcagaaaatttactttggggcacaatatttcttgtatctttttgttatcgtcatcttttttcctccagtaaaagagatgagatggaaataaggctaaatatttttttggggagaaatatagtttacaattattctaaatttaacccattttgagaaaacaaattatgaatttaaatttaaaatttacttttttaagagtttctatcaaaacctatcaggtttgaaacttccttgttatataagaaaaagtataacctcaaactgaaaatgccactgattatcactggtttctacacacagaatatctgaggcatcttaattaatttacctccaagtaatcaattaataatgtaacccctttaatccttttgggtttcttgtggtctcattctactccaggtttttaagattttctacttggagcattaaaatagctgttgagtttattttgcctttagtttttccctttcctgtctatcctgcacctattactaccttaatattttaaatatgtagttatcaagtaagttcatttttgaagactttcagtgctttccatgcctagtaaaaaatgttctaaatgccaaagctagttaaaaccattcaattaggggtgaagagaatatatctccgtggtgcatctcttgatggctggctttattttgcctctggataaagttcaaaaatcccttgaacagtgaatggactgtatatcatcacacaatctcccagaaatattgtttcctgctatttaacttcttgataagaaaccataatcaaatggcagagtttacaccgtaggtactcaataaatataagtcgaatgaacaaacaaagctacattctccaagaaaatccctaatgtaataattaatacattttgcaatctgaacccaacctatggttgtacatttaacatctatcagttcagttttttcagctgcatataacgcaacacataaatgacttaaataatagcagccaccaaatgtattatgtcataataagaaggcaagatataggtccacatcaaagtagaggaactgcagtcctattttagttaggatatgtatatttgttgtttttttctttttctttctttctttttttttgggtggtgggggagggagtttcgctctgttgcccaggctggggttcaatgacatgatctcggctcactgcaacctctgcctcccgggttcaagtgattctcctgcctcaccctcccaagtagctgggactacaggcacccaccaccacagccagctaatttttgtatttttattagagacgaggtttcaccatgttggtcaggctggtcttgaactcctgacctcaggtgatccatctgcctcggcctcccaaagtgctgtgattacaggtgtgagccacagtgcctggcctatttgttgttataataaagacccaaaataacagtggcttaaaacatccagaattatatttctctgtcatgaaaacctttgggtaggtggcccggggctagtatgctacccaaagctcagattacttagatattttcctttcattcactgaatgaaagttctcactatcacaggttcatttctggaagaagattgggaaggacaaaaaaggagaaatagttcatatccttcccctttaggagcttcatccagacattgcacatggcacttccattgccttcaacttagccacagggccatgtaacttaaagaaagcctggaaaatattgtctgtaactggtggggttctatgtcaagacataaattctattgctatagaagaggactgtaaattttgcataacaatgtgcaacagcttaatgactttgttaggatgcctgactctttccttcttgatccttggagactgaaatagtatccccttctaaaaggcacaggccacgtgaaggaggctagatacttgagcaagagcagggtgacgacaggaagaaaggggaaagggctgtggcatgggcatccacaactgtctgctgtgatcctcattcctgtgtgcagactttcttctctagctaaactcactgatttattacttcacaaccacattctgtgcttaactaaacatgcaggcccttgtcttccctccacgtagaaggggattcctcctccttccaggctactcaagtctaaactttctttcaaagatttgttattccataaaacttccatacacgcataaaacaatggcctatgatcttcattctgtaccagtttttctaatatctggcatatgtatatagaactcatttgctaattatgtttgcatgaataaagacaatttctttagaatgaaactttctttattctttgtttctcagagtttgttttagagtgtcttatgtggaacaggcgactgactgatttgaaagaacttagggttgtttatttaggtttaatacagttcaacctggagacagatgaatagacagatggttttgcaggttcttttcctgtgggccagcaatctttcaaaagacattttatttacaaaacagtgagaaatatattgtaaaagtataactctaagtaaattagcaaaatgagataaagtgaactctagttcattataataaaaaagatttaaaaggcagaaaacccaagttaagttgcttatctcatcatagcaaaattaatgattaatagatgtagaccaaatatgcttgctttttttttaatgaaaagtttgggcataatgtcagaggtacagtaaatatcttagcatttaaacatttctataaataaatgcttgttgaaggagctccatcaatattacaatagtgtttctagttttaccactataatgttatgtaataacaacattttaaattagttactggaattgtgattatttttctaaataatttctatttgaataaaataaatagaaggcaggataaaataaatagaagacactccatagagaatatcctttcaactgaaatcaaaatctagttagtatagaaataaaagtactcaaatattgttgagatcaacatagaaggtaatgcagaagaaaatactatgattatggaaacagctctgagagtcacgagtatgaaaaacagtattcaaggaagcaagaattctaaatatatttcttgtcttaataagcaaaaataaaatttcatgctgagatgaagggaacaactcataaattaaggaggcaatttatactggaataataacttataaattgttttaaataatgggccaatcatttacaaaaataagctatcagtaacctagaagcagtcttttctaaagtttagaacaaggcatatttaatgtccaggtgtaaagttggcattagtctaaaagcaaattaaatatcctagcactgttatatgtatgtggtctaagcatggggaaagtcttagctgaccctgagattgagaatgctgaacttgattttatgaagaagtgaaactgcctttatagtcagtgatcactttctatgaattatatgaagtctacagtcaggtgcagaaatgatttaacttgctaaatgagattacaaagattattatatgtcactctgagtagatcagattaaaacatggcaggaggacctatggaaaagcagtcttaggagaaatgactgaacagatcgtgttagccctggctgcaggctgtcttctctccttgtgctcccttcctgggctgtttctcctcctactcagcaactgcattctcctttgagcccccgctgcagagaagtgcgatgcgctagagccttgctattccaaccgtggttctctgcccgaccacatgagcatcacctgggaccttgttaggatctcagaatcccagactccaatcctgaccgcaagaatcagaatctttaagattttcaagagattcctatgcacacaaaggtttgagaaacactacttttgagtgccaaggattcggtttatacagaacagcagttattctgatacacacggcactgttcattgcgcttggtaccaccagaacatatttccatgtggatttctggagtcatggtgctatgactatggttttcatttcaggttttacaagaccaaatatggttttaaaggtaacacaaagacattttattttaaaatgtctattttaactttaagcactgtagataaaaagccttcaacgtgcgttgatgattaccaaggcatacagttatgctgtcaggctaacattttttagatttgaaataaaagttcttccactatccctgcttaattaaacaatgtccataaactaccaagtaagctactacaaacaaacaaatctggtaccatttgcagcttcttctatttgtgattcccaaaattcccaatgctttgcaattaaaatcaagttcagaaataaaagagatgctatgggtaaaataaaagtgcaactgtcatccacagccctggattgaattgcaacatccatctaaccagccactctgtccatgttgatttattttgctttaagtaattgcagcccatttgaccttccaaaatatagctttcatttgtcttatgtattggagtctaaatgaattttatttgaataaaatgcatttgattctaaagcattttgaaagctggaactaagtatgagttcgatggagaaggcagggctgtctggagcccgagttaattggatgcatcacttcttctggagtcacttgatcacaacaaattgacacctgccaacttctcccctgtaccttcctgatcccggtcaagtcattctcaagtagaagcagtcgagtcatttttattcatttttgatgtgaaccaaactttcaagctaggacttgccatgaaacaaattacacattccttgtggctactaaaaaaattagtttattagcgcaagagtctggatttgagaataaaatcatagatacaaataatctatatttctcacagtaaaagagatatttcttctgaaattacttgtttcttggtggtgtaacattctagcattgcattcatccattctttcagtcaatgtgtcaataggcagttactgagcatgcacctagttatgtaaagaattataagataaaaacccctaattgtaggaatctcagttcagaagagacaggtgctcaacaaaccattgctaagcaatgtaataatggtgtattggacataggttactagttctgtggaaatacagaagaaataataggaaaggggtagctaggttaattagtattttgttttgcttggtaactggtcctaacttttaaaatatatatatatggcgatagggtttgcaattatatttgaacaagttggttaggaaataaaacattttccaccattaagaattagaatacctataatcatcacagggagaatgtcaattttcaaaataagaatcaggcccgtgtggtggctcacgcctgtaatcccagcactttgggagtccgaggcaggtggatcacgaggtcaggagatcgagaccatgctggctaacacagtgaaaccccgtccctacaaaaaatacaaaaaaatattagccgggcgtggtggcgggtgcctgtggtcccagctgctcgggaggctgaggcaggagaatggcgtgaacccaggaggcagagcttgcagtgagccgagatcgcgccactgcactccagcctgggcgactgagcgagattccgtctcaataaataaataaataaataaataaataaataaataaataatcggccgggggctgtggctcatgcctgtaatcccagcactctgggaggctgaggtgggtgaatcacttgaggtccggagttcggcaccagcctgaccaacatggtgaaaccctgtctctaataaaaatacacaaattagctggatgtcgtggtacacacctgtaatcccagctacttgggtggctgaggcaggggaatcatttgaacccaggaggcggaggttgcagtgagccgagatggtgccactgcactccagcctgggtgactctgtctcaaaaataaatcagtaaataaattaataaataataaaaataagaattataagaaagaaaaatattaaaattgtatctaaataaaaaatacttttaaagaaatccttaatactgaatttttgaagtacagttggacctctgtatttgtgaatccatcagtggatccaaccaatggcaaatagaaaaaaattaaaaataatacgatgataaatctaagtaatctagagatgatttaaattatgtgggaggctgtgcataggttatatgcaaatactacaccattttataacagggacttgaaaatgcgtggatttgggtatctatggggtgggtggggattggtgtggaacaatcccctcacagatagagagggatgacttgtattcattaatctcacttgatggatatatcctttttgcatgcgtgtaagaacacagtaatcttttctatcatcgagatgattttctactctgcccattatttacaccacatttagattccagcctggttttcctctgctacttagtacccttctgcactacttcccccgaattaattgatataatgagctgatgtaaattactttcaatattaggctgagctaatattaacccgcaataatttagaaagtaaatataccatacaacaccatatacgtactgaattccaaaattaagtatcaaggatgttttagtttcatgtaattttgaagtgtctagcccattgcttccttccatcatatgcagaaccacctgctctggatgtaaacaccttctgctgtgtgtgttcccacgcctcagggcctgtacagaatagtggctataggaaaggaccctcacaaccctgcacctcccactgctttcactcttccacctccttatcagtgcttttctcgcctattctgctaggaatgattttcaacattttaatcataaacatacaactcttcttttcaggcccgggtgaaatgttctgaactttatgaagcctttgtttatcatccacttgtaactcctctagtatccaaatttctatagcatttcgtgtatcttttatgactcatcaaattcttctgggtttgcatttttcatgaatcagatccccaccccacctccactcaaatttggagatgaaacatctttgtagccttgataacactgagcccaaattttataaaaaagtaagtgtctattaaatttagggtgaattttccatccctcatgataattcaacaagatgcttttgtttatattgtatttttccccaatgttcttcctctcattttcttctcttgtagtcctgtccattcattgagtctcaacctaaaagcttttaattgtgcccaaaatgtacatgattcctcatgtgaaatcccgtagtactttatttgtccctgaattatgctgtttttcatttcttccttgcactgtagttttcatacatactgtatctacttctatatgaactatgagctcttctgcaaggctgtgaatacagtcgtagtcatcttctattttccgtagtgctgtgcatatagcaggtgctcaatcaatgtttgtttcaggagtaaaagtttgtaaaaagttgtggaagaacagcaagctactcagagccaggggctccatgccaaactgagccaagcccagctacaggtggttttaggcatggctagtggtaaattgagaacaggagttggagaatgctatttctgaggccagctctatcagattttgtagcagggagctgctagggcattatgataaaggggtggctctttatctgtcctttgccagtgacccatgattatagattctgctattttaatctgggaaagttttcctgtttttgagagttccctactaaagtctagatgtcctttgtgaatactggtacatcacaatgaatacctttgttatctgtgagcatcttcagcaggattataacaaaaatcaggttgtggggtagatggagacaggaattgatgggagggatgagtggatggaaccaggagaaagggtttgtgccattgaaacaggggtgtttcaggacaaatttcagcctcacaatttctgaggtacagtaaagctgtgccctggaggctgtgtttcagaaatctaaagcttccgtttattggcccactatttcctgcctattagttgtctgttaatacttcatgaacattatcctcaaaccttaaaattatttgtaagatagaattatcctatttttcaaaggtgaaaactaaggttcagaaaggttcagttaagtagctacaattagtcatcttaataaaaagatatagatttgaacacaaaacctgtatctttccttctgtattatgcttgctgcctctttcagcaggctgctttagttatccagtgggaaataggtgtttgggagacttagaaatcttttctttctaagttagtatattttcattgctgttatcatgacgttatttcaaaaactcaaattgctatgaaaaacttgatgatacccctctttacgtcagtttttggcttgacaaagaatagaataaaacaagaaataagacagcttatcttcgatctttcaccaggagggaacttagctgctgtctttgttttggggtaaaagaaaaataaaatgaatctgtgatattcaagtaaatccctcagttgtttgttagtgtctactgtttactcaaaaatgggaagctccaggtcggtgatacatcatctttgttgcgcttggcaccttctttcatgaatcatattaatctgcttaaactaacaaggattaattgccttggtaaggcaacctggcattgaaatgatatattgcccagacagcttggaatttggccactcataaatctcatttgtttgttggtttatttctgtttgtctctctctctgacagatgtgtgcccaatcactgtgagcatggtggaaagtgctcgcaaacatgggacagcttcaaatgcacttgtgatgagacaggatacagtggggccacctgccacaactgtgagtgccaatttatctcactttaatcttgtaattgcatgagaatctcaagtcttgagctgtgctttgaagctcagcaacctgaataatccacataatacatcactcgaatctgaaaaaccaagattccaattgtcatttctccaaaaaaaaaaaaataaaatacactattctacttgttaaaatatgttctctggtggcaaaggactcaaaaagaaggaccagcatttcctctgttccataaacacatagttgagattggaagtccaaacttggattcgcctctctgtgtctaacccacatctgttgggtcgattgtttgggaaatcgtgttagtgtgatgtctctgactggaccctcatttattaattaatccgagagggagacacagggtaattggaacatttagtttctggatgatggctgcctcatgctttagcccaactatttgactacctttttttagatcaaagaaatgagtccgaaatggaatatctaaaagccaatagataaaatacataagaaggtaataaaatgaagacataagagggtaaaaatattttaaaatggcaaaaataaaaagtaacatgcaaaaatgactaggaaaacacatatgtgccttggtttatataaatagctttattccaaaaggttaaataaaaaataaatttctgtacttaaaaaatttaatgctaactcttataattataatattaattttccaataatgcatcgccatttgcagaacgcttttgaaaacaaagcacttttgaaaacatatttggcatgaatcacataattacaagaagagagtcaactgttggttagtgtgtgcatacgtatgtgcctgtgtgtgtgtgtgtgtgtgtgtgtgtagggaaggaagagcaagagaaaaagagagattcaaccttctctcaatatgcccaaacactgaaactctaatatctaaatcctccgattatacaaacagatttcactttacttttaggaaatggtgacaagcaaactatctcagagtagagccctgtgtacagtaaaaatgtcatacagctctctaagcctttccattgtgttatttgtagtaatgtgcaagaagaaatcgtgttttgaatatattgtaaaatgttgacttacaaagttgcacacatttatttgtttaggtagatattcaaaaacaagaggcaaaggaaatcttgacaaaactaacaatagaaagatgtcaagaaggtcaaaattgatactagattcattatctgtgtttacatatatgaaagtattttaatgaataaagaacaaaaatgattgatactgaaattaattcaaagagttataactaaaattgttccttaccaatcacatcaaaatattaacctccagtatgtgacatttattaaatataacgtgatgctagaattacattgatgaaactcagtgccttcactccactagcataatttttatcgtgtgttataaataccatatttaattacacgggatcttgttcctgaaatacgataatgctaaccaatggtcaagagcaagaaatcggtggtggttgcaaggattttctatctcagtgatggcttttacattgaactgaaaagcaacttattctttttttataactgtttccatccttaaaatacacagcaaaaaggcaaaaaaaaaaattaaaatgtatgctactggttgagtagctgaggtttgttttgttttttaagggtaatgactccaaggattagaaatgtcctaagtgtgtttaggtttggtgctagtggccagctccaaaggtaaaagacaaaaattgtcttttgttctgctgctccttcctacttgttccttgctccattttgttggatctttaaaagcagaatcattctttttaataataaaagcctgatcttttgttgtcttctccaaatgaagccaaaattttgaatatccaacgtgtgcataaatagaggtgaaaagaccatactacataattcaagagagggttggctggtgactttttctttcgaaaaatatacattgtagcttattgaaggccatttgcctcctaataacctgaaagacttgatacagtcttacttatccaaatggattagttaaaaatttcacacagcacaaatgtaagaagatacaatgtatgccattcagtttgacacagaatgaacaattttacatttttgcgaaatcaatgaccacattcaaagcaagaagaacgaagtgcgaaggccccagtttctgatgtgtctgacgctagctataaaaccatcaggccgtgtgcctttgtggtcaatcatttgacttttcttgcactttgttcgactgaagtctcttggtattctacaagccagtgagctgagatttgcagttgcttattctgtattctgtgggtttgaactgtgtaagtaacataaaatattttgcttcattatttcctgcagaagaccaagcattcatcttgaaaagaaatcatgctaattattttaaatagtatttttttttaaaaaaagcagctaactaagagctaaagtttaatataatagaacatttgttagagtttcaaacattacaggctacaatattttagcacaccttctacactagcccgggcttggtcaggatgagacagcagtgctatgagtgacctgtgatcatccaggctagaagctctagttcaagatggaacagagaggcctttttgcttggtcactctgccttgtgttgactttgactttaccattttcttacttgtaccctaggccatttaaattatttgagcttcagttttctcctgtaggaatagataattaacagtgctcacctcttcaagccattgtgagattaaatgaaatgatgtacggaagatgctgagaaaaactttggcttatgtggtactcaataaatttttgtcatttcatcactttcagagcaattgtccttttcctttgaacttctataccaataattgcccaaatcacacaatgtgtctcttaatttaatgtcaccatacattgtttgctatcacttttatggcagatttggactgcagtgaatgactggtttccatagtatttttctccagaagaattgaagagtatgcctcctaaacctatgtctcctgttttcatttgttagtttgtgtgtacatggggactttgtttttacgtaaattatatgtagggcttagaggactgtcatttgtgaactgctcccctgaggagccaggatgtctccctttgggatgagtagacaactcaatcccacagacaaagccaaagatcacagaagatagtcagatcacaggaaagggaaagccagtttttgtcgtttaagaacaaaagaggcaagtttgttacaaaatgcaaatacattaaattgttgaagttttaaacttgaaaaaattttctcatacaggcattccactctccataaatcctttaagatctgaatagtagcatatctgaacaccaaaccatgacaaagggactaaaatgatcatgttgaacagtttgtgtttattgtattgacttatccctgcttcagtctcccaaaagcactgtaagaatgtatcttttgcttggagatggagtcttgctctgtcacccaggcttgagtgcagtggcatgatctcggttcactgcaacctccacctcccaggttcaagcgattctgctgcctcagcctcccaagtagctgggactacaggcacgtgccaccatgcccagctaattttttgtattttcagtataaatggggattcactgcgttagccaggatggtctggatctcctgacctcatgatctgcccgccttggcctcccaaagtgctgggattacaggcatgagccaccatgcctggccaaacattcttatatatactactagttccttgtgtggaactgctctaaaaattccttagaatatcctcaataatatgaaaacttttggctaatttaatgaatgcaagaggttaaaggatagtattttagtgttcgacaaaaataagcaatgttagccttggaaatttattaaatgtcagatgtgcattctgacagaaaatatttttgcagatctttttattaaaggagagattttcatgttgcccaaatatatagacgtaatgtttccaggggaaacaggaggaataaactagatgacctatataattctcttttaattttaaaatcacgagatttaaaaattctgaaatactagtaaggaacaggtcctgacattgccaaataaagcaaaagtaaaattttttctagccaatgttagagaaaaatttaaatgtaaacggtaacaattgtacattccgtatgctggagcatttcctctgggttcataaatgtgtaaactgtaaattgtgttgcaccttattacagcacacgtgagaggcgcagtggatttcaacagcccataccatgttgttgataatccatttcacctataattgatataattcaaagaataattttcaaaataaattgaattctatttgctgtagtcatactaacatagagcataaagacctagatttattggcacgaagaaacttggtgtctctgtccatttggagtttctacaacttaggcatcaatgataacttggagtttgagcattgctacaaaaacaagcagcattgggtagaattgcgttggatatggtattagtctgttctcacactgctataaagtaataccagagactggataatttagaaagaaaaggggtttgactcacagttccatgtagccggggaggcctcaggaaacttaccatcatggtggaaggcgaaggggaagcaaggcccttcttgacatggtggcaggagagagaattgcaagcgaagggggaagaaccccttataaaaccatcatctcgtgagaactcacccgctgtcatgagaatagcatggaggaacttcgcccatgatccaatcacctccctcccttggcatgtgggaattacaggtccctccctcaacacgtggggattacagttcaaggtgagatttgggtggggacacagagccaaaccatagcaggtatctaaaataaaatttagatatttagccttagggaattggaatccatcctttggggcaagttcacctggcttgccaggtcctacgtaatatggccatgtctttaacctgatttcctcccctacatctcctcccattctccccttcaatgcactggcctcctttcagtttttgatgcatgccctgcactctcatacccttgcccctcctataccacgaccccccaccacaggacatttgcacatctacctctctgctttgtctagtacatttctactcctccctcagatttcagctcagcagtcatctcagaaaagctttccatggccctgtagttagatcaaatcctcttattctaaaacacacatatgtcttttagcactagcaatggttatgattttgcacttattattcataatgatttaataatatctttctcctccactggtctctgcatctctggcaggaggtggtgccacatttcatccaccagtttaaatctgaggctcgcccagcacagactatgcacgcagtgaatatgcactgcctccaagcattcttgaatgtcaaagagtatccagagcaacagtgttttctttaaattttattcaatgccctctttacagtaaatttatgaagatagtgaagctataaggagagagtacacttacagggcaaaaagaaaaatagaatcaagtccaataacaaaatatgggtaaatggaaggcagggtactaaaaataataccaaaaactaccacaagacattaaacattattctaagaaattatatggaggaatttaggatattagcaaaaaaaatctacatatttcaaattatctttaaggaaaatattgtgccatgttaagatgccccattcattactgaaatttgtgagaactatgacattatagtaacaatagcaaaggaagttgcaacaaagataatatcttagatcagcactctccaacgtttttggcaccaggggccaggttcataggagacagtttttctacagaccagggtgggggaagtgggtaaggggatggttccagatgaaactgttccacctcagatcaccaggcattagttgaattctcataaggagtgcacaacctcgatccctcacatgcacagttcacaataggtttcaggatcctatgagaatctattgctgccgctgatctgacagaagacggagctcaggcgggaatgcctgcctcctgctgtgaggcccagttactaacgggttggggaccccttacatcatagagtgtggtcaattactatactggctaactataggagttattctaaaatagatacagatatgtttaaatattgactagtacatgacaagaagtttattttaaactctataaaatttgaataacatgaacataaaaatcttttgatttatcatgtaatattatatgtgtatccttgctacagggaagttatggagaggggaaaacactcagggtttgaaattagatgtcctgatgtcaaaccatcagatccttaggctatgtggccaaacttacttccccatcagttggacatgtctaagttccagaaaaatgactgtctccatactttataaattctctgtttcctcaaacacgcttgctgcattaagtgtggatttcactcatacttatagaaggtgaagtcagcttttccagtccatgccacaggttactgacagcaataaaataggaatgattcagatttaatcactttcctccccatctctccgcccccgctcctctgtgctatcttggttttgtgtttttagacacgtcatttaatgtctctaaacttaagtttccttttgaaaattcaatgagatattgtttattaaagtactttttaatgtaccccagaacttaaagtataataaaaaaaagtgctttttaaattcagaaaatgtcctacttttaaagaacttatgccactaagtttcgaaaaacagctagtcaaattttactttgagtgtaagtcgcatctactgatccgtatactcttcattcggtacacaggccatattttcatatcagtgattctcaatgaaaagaccataggatatctcagtatttcaataaatgctctttgaaaagataaaggtttttattagcaagtataatagccacactagctgatttatatgcatggagtacatctactctttctaatcgagatatggtattatctagtcaggttgtgcttctgtgttatcaagtgagcaactaccaaattccttcaatttactttccatcccattcccacaccatgatctgtgtcagatgctcagtgtgtccctgttattaaggagtgactatgggatccaactgcaggaccacaggacactaaggacccatagtgctaccatcacttattcattcatcaatatattgagagctgactccattccatacatggaatagatactggagtgtgaagtagagagggcaggaatactaggatgtagccccctccaaaaatgtgtatagtttcattaaaaataaaagttcttatcaccttatttccacatctctggttcaccaggattgtgatctaggaataaattctatgtattcttacctcttagaatctagcttggcatttttcacgcttacaaaatatggatacatgtagacacataggggaaaaaaatgatttaatactttgtcacaaattatttgttttaagcaattattttaacttttcagattgtatattcagaggatttgtttgctttatttctgggtttgtttttctaaccatatggacagggagaaatcagggtgaggtgatgcaacttcagcatggtgcttggtagagaatatggttttcaatagaatatatgcaagtcaaatgttaataagcccttgctcagctgtatgtattctctagaggaaaagctcgcattctcaccaggactaaagcattgggagctaagggaaataatggcaagtgatgtcacttcctgaaatcactttttgcacaaggaaacaatcatcccagcagctcctttactctcatattcatctggcacctacacagaaaataagatggaaagagctgtgaaagtactacctgggtagaaatgttggaaggggatttaaaggccattctatcttttggccacaaccaaataaattacactggattaaaatagtacaggtcatttggagaaacacagcccaaggacctctacatttctaaggcagaccaaattttgaattaatcccttcttgcttcggaatgatgaccaagattaaatatagaaagaaaggatttaatttcaattttgcaaagactctttcaatagtttcaaaaatatgtctttctctttgagtcttggcaaaaaaaaaaaaaaaaaagttgatctgcaaatgcatattgaaaagcagtgtgctgtaaagacatgctgtgatcctatgaacttctccgaagctataaaatgccagtgctaggtcttgagggaactggcattattcattaaactccctgtagtttgaatcccagtgtatgttttatccaaggttcagagtgaagagaaaaaggaatagaaaacacccattttaacacttttgtcaggttgaattaaggaaaaaaatgatatagggaaagagtctactttaatttgaagataaggaacggagcttcaggaaggttaatatctgctcagaaaacaggaaagagaattagagtaaaaaataatatgtgtctctcctttgatactttttaacttctctgaaaccaaactgtgtttggtttccattttgacattagttaataagtttctatgacaagtctttagcttttgaaacttggtgtacaggattatctttaaatcacagtttcaactcattcaacaatattatgcatctcttttgtatgtggcacactatgtgaatacaaaagcatagacgagagccattttccttatgaagtagacaaggtagttttaaaggaaagcaggataagtaataaaagcattaatacattataagaaggtaacatgtatttatgtgtccaactagtatcaaggcaagtgtgtatgatatgagagaaaaacaatatgaaccaagatatttgggaagacgttcaagcaggaacggaactctgagctaagttcctttcagagttctgtagagaaacagaactaattgttaaatattcaaaaaattttgaattgattgtttaaccttggtaaaccttggtagcttgaagcagaactttggtgtaaaccttggtagcttgaaccagaccacagtggaagaatttatgctagggaaattgacaaaccctgtaaagcaagatacttttaatagagctggtttactagcacaccactgccctgtttcattattaataaaacaagaataatagtatgtgcctgccaatattattgtgaagggttcagatgatttgtaaaatgtctaacatgttgtctactatgtagtcaattctcaacagatgacagccatggttataaatgtaatactgtgaagagactggtcttgttaaaggagcagcagggtgcagatttgaatcatgggtgaagctggcccagaagacagtggtttttcagcaccgctgtaacaaagcataacttcagatgctattcttcataagtcatttttttaaatcgtgaaacaacttatatccattagaacaggagtccccaatccccacaataccagtttgtggccttttaggaactgggccacatagcagaaggtgagcagtggtggagtgaagcttcacctctatttacagccactccccattgctcacatttccacctgagctccacttcctgtcagatcacgggcagcatcagattctcagaggagcacgaatgctattgtgaactgtgcatgcgagggatgtaggttgcatgttccttatgagaatctaatgcctgatgatctgccactgtttcccatcacccccatatgggaccacctagttgcaggaaaacaagctcagggctcccactgattttacattatggtgagttgtatgattatttcattattcatcacaatgtcataataatagaaataaattgcaaaataaatgtatgtacttgaatcatcctgaaaccatcccctacctcctgatccatggaaaaactgtcttccatgaaaccagtctctggtgccaaaaaggttggagaatgctgctttagaagaaagaaaggtcactgaatgatatttaagttttcccataacaggttatgggctctcagttatttctgaagtaaggagaactggtaaggctgctgaaaatgcttacagtgcatttttgaaaaccatttggatgatttgatatcacttctttaactattaacatttctttactgaaagtgatacagacgcttttattttactaaattacttctcaattatttagcttatagtatgatcttaggtaacaaagctaattttatattctcttgtgattattaacctaaatctggtataatgagatgcttcctcccctcaggagcggtccagctgtgactcagctgcatcaaatttatgtcttctgaaattaagacacctggatttgtttgctaaactctatttaaaaactactcagtgaggattctcttgattttgcaccattcacaggaagaaattctgaaagttgaattattggttcccgtattttttattttttatttttttttataaaatcatgataaacagaactcttacttcatccattttgttgttgctgttgccgcattttgctttttcttcctcctttcctctccctcttggcaaaagaatgctacaaaaatataaagattgttgtaatctggggcgaaattatccatccacctaaataatctcctcctgttatctttgatgaatatgtctaacaccattaataagcaatagtttcttataaaaaatgcagccgtttccaagaaaattttgatgcttgacttttggggtattctctcatctgacttctttcaaatgtttgtgaaatcgctgatttggaaatctttagacttagccaataaaagtgaaataatgtaaatggatatggatttgaataaagaatatggttttatttttaagtaaaatgagaaaaacattcaagggctcgtagtcccttagtttcatcacccagtttcatcccaaagctgccatagaagctcctgtctgaaaaatatgcctactctactcttgaaagcccattcttggcatcacggatgccaccaccaaatgccagacaatgttggcaactacagaattgctgtcatttctcattagcaggcatcaaaatgtcctaatactctctgccactatctgggcctgttgagatattaattaaacatgtctttcttgccaagtcatgtgatcaactttcactaggctaggtagagccaagtgagcccatccaactacactggataaagaaatacctctaagaatttgtctgtgaagaggaaaatgcctcccatttgtattactgcaaaggaattcagagctctagaaaagcctgtgtgtgttttctaccatatggctatctgttgctgagttatcccacttagagaatattcaagcatttgatggaaacatatccctactcagaaaatgagctcctctagagtttgaatgacatagatagagatttcctgagataataaaacctgcattggggcaggccagactgattgtcctacaggttcctaaattacctgaagctaggtggacagcacaaactttgttaatttattgtccaaaagcactatttttcttttgtatagttctttaaattaagctgacttaattaagctctgtgtaagagcaaaataacattttctggacttccacaagggagagattctcaataataaggattcctgccttcccacagcatagcagttccaggagagaagtactgggattgcatgcgtattagatgcccttgagtaaggcaagtaggaaactccagacagcagtacttgctgcttggttgttagtataggtgtctactcctgtgtgttacagcacctgatgggaaagcccaagctatgataaaaaaaaaaaaaaaaaaaatctcctctcttctcagctgaccatgtggctgattagccacaaggccagtcatcccaaagggtgctgaagagaagtgggctgggaggggaagcccagtgatggatgatgaaagtgcagtcattgcaaaacaagtccttctcttattgttgctagatccactgcttatgacctattttccgcttttaccagataaaatgtaccatcaactctgtcttgaaacttttgctttcctgcagtgtgattgccacagttccactgaacagaggtcattttcgctaagcttcctttctacagtctaaactaggtttttgagctaacacgtattttagaagtaaaaataatactacagaatgatgcatagggcaaaaatagtatagaggagaaatttattgagaagcatttggattgctattagtaatcaagaaaaatgtttattaataagtaacatttctcctcttcctttatacatatagatgagatattgaaagaagttgaacatagcagaagcatgttagtctaaagcccaagtaatctctttgctatttaaaaattctaaaggatttgaattaggatttcagttcacattcaaagtggtagttttttttcccatttgtcatcaccctatgcttctcatgcactacctaccttaagatgaaataaatgaatatcaggtagtaaattctaccacatgtggttattatccaaggaatgggctcacattgacacttgattaacatcagtttcacatgtggtaataaaaaaaaaattaatctgtgcaaactgtaattgtcatgctgggatcatttagattccagcagtctctctgttgagcagtttaagaaaactgtgttttcattgtactttttaaatgaggaagcccagtggaaaaatcatatttgaatcttgagaaatcttttgctttctaaaagtgcagtaaatgaatataactttgatggttgggaagatgagcttgttatccacagacttaaaaaattaagaataaatatacaagttttttggaggggtaatttagtagatattttaaaatacttaccagccaggcatggtggctctcgcctgtaatcccagcactttgggaggccgaggtgggtagatcatgaggtcaggagatcaagaccatcctgtctaacacatggtgaaaccccgtctctactaaaaataaaaaaaatagctgggcgtggtggcaggcgcctgtagtcccagctactcgggaggctgaggcaagagaatggcctgaacccgggaggcagagcttgcagtgagccaagatagtgccaccgcactccagcctgggcaacagtgcaaaactctgtctcaaaaaaaaaataccgatataatgatgtattaaggttagcaactatgcctaaaaaatgagtcctctgaaatgctaccttcttacacaggtctgcaaccaccccaatttcccaaattttaccctagttctctcccccaagcatgtggctacctactagttttaaccaaagaaggaaggctttaagcaggagggagaaagaatatggagacgttaggagagtgggtggggagaaaaggaggagagagctgcactcttcatctgtatataagatcatgttacttgcaaacagagacaagttacctctgaatggcaaggctgagaacactagtgtttctagctctgtgctttctacagtgtgatttgtggacaaatagagggctttatatgcattgcaagtgaccctgaagataatataaatgcagcttagaagaagtagaaatgtatctatttttaaagtaatcttacttcttaccttagatttaaatatatacttaaggtcaaaaagtatttttaaaatcaaaagaacagtatttttttccatgtaaaaccagagcaagatttttttttaaaaaaactggtagtaagcagaagtgatttcattaatgcctctttggaaacagtttatggataaaattagcaatatgatctatcactgacatttactcttttatcctttatgcagaagggcttttcatttataacaatgagagagattataaatcagttattaaaaccttatcaaagacaaaggcatagacatttttacattaaaattatgaatgcaaaaacagaccagcctggtctcttacaaaccatgaacagtataaacacattgacagttcttatactagatagatcctaaataaaaatgaaatcaaataatactcattcctggaggtatacctcatataagtccctttatgtcatcagcaaccctattgtattgacataagctctctatccactgttcttcttaatgccaccgaccaggtgcttttcatctttgaacacaaatgcctatcccactgcttagtgcttggtaagtattaaatacaatttggggcaactaaactgtaactgtgtctgaatgcacaaacacacacacatacccccaaatatatacacatacctctcaaatgactgtaaagataggttcatcagactcggaacatacaaagcccttgctacataagagaagctttctctgtgggatacagcatcttaaattcttttcaattctcaataagagagaagaactttattttcatttggtaatgttcctgatatatagtacatgatattctttatgccaagttttgttctatcaaaaaatatctgacacttccaaactcattttatgagtccagcattaccctgatactgaatccagactaggagactacaattaaaattacaagtcagtatccctgatgagcatacatgcaaaaatcttcaagaaaatagcagcaaaccaagttctacagcatattccaagaattatacaccaagatcaactgggatttatccctggatgcaaggatggtttgatatatctaaattagcaaatgtgattacaccgtataaacaaaatgaaggataagaatcatatgatcatttcaacagacacagaagaagcatttgacaaaattcaacatcctttcataataaaaactctcagcaaactagatacagaaggaacatacctcaattcaataaaggctgtatgtgaggagcccacagctatcatcatcctcaatggtgaaaaactgaacgctttccctcaaggatcaggaaaaagacaaggatccccactcctgtcacttctattcaacaatgcactgaaagtcgtaagcagagcaattgggtaagaagaagaaaaaaacacatccaaatccaaaaggaagaagttagattttctctgtttgcagatgacatgctcttatagagagatgtccctgacttcaggtggtttgacttacaactttttcaattttatagtggtgtgaagccaatgcaatttggtgtacttcaaattttagatcttttcctgaactagcaatatgtggttcatgagataattcacactgtattaaaaaatagactttctattagatgattttgcccaactatagggtaatgtaagtgttctgagcacatttaagtttggctaggttaagctatgatgtttgctatgttagatgtattagatacattttttacttttggtattttcaacttatcagtttatcagtatgtgaccccatggtaaatccaggagcatctacatatagaaaaccctacagactccaccaaaaaactattagaattaacaagcaaattcagtaaagtggcagtatacaaaatcatacaaaaatcagttttgtttctatacactaccaatgaactatctgaaagaaaaattgaaatcttcccacttgtaatagtatcaaaaagcataaattacttaggcatatatttaaccaaagaggtgagtgaaggatccatacattgataccatgaacatggatgaaaaaaagtgaagacgacacaaatagatggaaagataacccatgttctcagattggaagagtttaacagttagtcccactaaaatatccttatcaatgcaagctatacaatcaaggaatctctatcaaatttccaatcagatgttttatagaaatagaaaaaaaaatcctaaaattcatgtggaatcacaaaagaccccaaatggacaaagcaatagcaaaagaaagctggaggaatcacatactaagtgtgagggaaatgcatatcaaagtcatttgtgacaacatggctaaacctagacagcataatgctaagtgaaataagccagacagagaaaaacaaatgctgtatctatcacttatatagggaacctaaaaaaaaatgaaatgtcaaactcacagaaacagggagtaaaataatagtaaatgcagaagctgagggtagggacaatggagaaatgttgatcaaaaggtacaaactttcaattacaagatgaataagttctggggagctaatatacaacatggtgactacagttaattatactgtattgtatacttgaaatttgctaaaagagtagatctgaagtgttctcacacaaaaaagaatatctgagttgatgggtgtgttaattaacccgattgtggtaatcatttcacaatgtgtgtgtgtgtgtgtgtgtgtgtatatatatatatatataaaacaaatcatcatgttgtacattttaaatatatacaattttatttgtcatgtgtacctccatgagactgaaattaaaaaaagaaagtagcaggaaaagtaggcttcaatatcaacacaatggatttttggacattttgaggcaaggactctattatacacatcagaagagtgtagaaaagcaatagttgagcgagaagtaccctctgtgcttttcctgacagatgattccaaggcataggatgctaagggtgtttgatttctagggctgccattaataaataaccacattcttgctggtcaaaacaacagaaatttattctctcacagatttgcagtttagaagtccataatcaaggtgctggcaagcccacgctccccttgaaatttctaggaaagacttttctttgcctttcactggcttctattgattgccagtaatttttggcataccttgacttgtacatgcctcaatctattctctgcctccttcttcacacagccacgttccctgggtgtttctgtctctgtccctgtgtcagaatctttctctcctttctcttgtaaagacaccagccattggattgagtgtccacattgatccagtacaaattaatcttgacaaattacatctgcaaagactgtattcccaaatacgatcccatcatgagtttgggtggaagtgagcttttgcaggactctctacaccccgctttgccacacctgctcctgtccagcacggagctccctgtgtcccctgtgctttcccagctccgttatgccatcccctaacctgcaccccagattactcttctccccacttttaccacactcaaaatttactttctgtaggctccagtcacattctctttttattttgtgaaatcttgtttgctcactaaaacttaaacggatttctcttttgtaaaaaaaaaaaaatatttttgacagcaattagttctgtgtaatgtctctggtatttatacactcagttaattttttttccaagtgttttacccacagttttttctcccagaaaataaattgtgtaggcctaagttaactattctgtctctctttttgcaaaacctaatagtctttgttgattaaatttttcattttgaacacactctgtgggtttaaagaaccctgaggagaagggagaggagagtatgttaggtattgaattttcattcttcaaaattgcatgtaaggaagatattttatttttcagatgaaaaagctgaggttcaaagttcatggcagagccacaatttcaaaccatttcctgttgattttgtgaaatctgtgcttgtccatactccctcccttctgccatggcatttccaactctcagagcaccaattccaaacagcctggagactgggaagtggttctgagaagttggttttctattggcagctctagtagagaagccctgtcctgtagctcctgacatgagtccccagtgcatcagcctgagagcagctgctgtgggagtaagttcagggtacctctgagaaaagagggggccctcactgacctagaggcatgtatgaaaacctagggctcccaaggggtcttggcaatcatttattctagctacctcattttatggagacagtatataatcattaaaaatgttttagtccgggcacagtggctcacttcggtaatcccagcactttgggaggccgaggcgggaggatcacttgagcccaggacttcaagaccagcctcgccaacatggtgaaacctcatctctactaaaaatacaaaaattagctgggcgtggtgttacgtgcctgtaatcccaaatactcgggaggctaaggcaggagaatcacttgaacccgggaggcagaggttgcagtgacccgagattgcaccacggcttggggtcctgggcgacagaatgagattctgtcttaaaaaaaaaaaaacaaaaaacctctgagaaagaccatatttaaattacattaaattttggagttataatcacattaatataaattatatcgagattgtattttttgtttaaaaatataatttaaaaactatattcatatatatatatatatgaatcagaaagactcatttttccaggcattttgggttagggaaaatctgtcctttgcttccccgaccattttgaatgtgattaaatatgcacacacacatgcacacacacacgcatgcacacactgatgcaaactttagcaagtgacatgagggtgtcttttcacaggataacttttttcatttgattcctcattcataaaacactagtatgatatacatccccacatagattttccccgtttctataaaggatgaagattcaaatgctgcaaagctcactccgggcccctggctcagaaacagttctctcagcactctcctgacattattaatggccctgatgtacaaacccagaataaaatagaattaaaatccaaagttaatttcaagctccattagaaattaaaggtgttgggaaagaaatcaatatttgcccagtgcaaaatgactaaattcaaagcaattaattctattattttgtaacttctaaaaactataaaagaccttcaaacaataaaatgttgccatgcgcacacacatatacaatgtgtgactaaaaataatgagaatgatatccagcagcgacatgcaaaaatctcttttattattttatagccacactatgtagtgtacacactaaagtgtgtcttaaaatagagccaattattccataaaattcgtggctatttccagcaattatcagcacttagttgtaaatctgggagaatttaagggacagaaacaatgcaaaagagcgaggagattaatttaaatggaagaaatgtatctgttttcttaattttgctttctctttttccagcttctttttatgtaatgctatcgatcaccaaacaaatggccttaaacgctgtagttcccaacaggatgaagtatttcacaacctgtagagctgtaggttataatacacataaaactggcactcggtaaaagctttttcctgtcagaatcattgccatttcttccctgtagtgccttttggagaaagtctgagttaacaaatggatcttttccaggtgcagaaagatcagagtcaaatgggtttggatcagatcttgtaacgagaatgtgtcactctttccctccccttgtcaagaaggagtctcttaagaaccggctcaagcatcacttatcattacagcagactggggtgaacagttgtaaaagataatgatagaccaaaccagttcttagctaaggagatgtcatgagccttctgatgaaacctttctctctttgtgatagagatagtcaaaatgattaaggactactagcaacagaggaaggcatggccaggcactaggaccattctaagacccatcaatatgaggaaatggagccatcgttggccaaaggctcgggtccttcaagtttctaaaattttttgtttgtttgttctgtttgttttttgttcgagatggagttttgctcttgttgctcaggttacagtgcaatggcgcgatctcggctcactgcaacctccgcctcctgggttcaagcaattctcctgcttcagcctcctgagtagctgggattacaggcatgcaccaccatgcccggctaattttatatttttagtagagacaaggtttctccatgttggtcaggctggtgtcaaaatcccgacctcaggcaatccacctgcctcggcctcccaaaatgctgggattacaggcgtgagccaccacgcctggcccaagtttctagattttgacacgtccttccagtggctgctaatcaacccctggccctttgaaaagttgtatctttttaaattgatttctttcaaaattgtactaaatgtagttagttgcccggaaggtgtgacttgtttaacctaatgaatcaaagctgggctttagcagttgagccacctgggccactaacatctacccactgtctggttttccacactagctataacaaaaacacacttgttagaccaaattgattttctgctctctttacgtctccaaattactcagctgtttcttccttcctgtgatattttaaaaggtctggggttctagccccaactctgtcacttactgtgggtgtgagctgaggctagtgatttggcctccctgatcctcactcccctctcctgtcaaatgaaaatgattgtatttaccttgtaagttgttttcttaaaagaaaaaaataaaacaatttaaaatgcatgtgaagtggatgttcatgatcagacctattgtagactctccaaagtagcagctgtggacattaccatggatctccattttcctgggtttcccaggactgcacactctctccccgctctgcttccttcagacctactctccagagagcttctggtacctaatattagtgtttgtaggtgaccataagtcaagttagcaaatatgacatataggaaagtagataagaatgcaggggtatgaaaataaggtaaaaatggggagtaacatgtgtttaaaaattgttaatctttctcaacaacatttcttatggactcagctaagtaacccaaggaggttgtctctcttcacccgctcctccccacaccagtccacccttcaacccttcaacgtggctaccatcttctctatatcactggatcgactcttgtcagttacttctatattggcaaattgatgttaacttatataaatgggacatctatattttatagaagttgctttctctttctttctttttttttttttttttttttttttggagtctcgctctgtcacccaggctggagtgcagtagggcaatctcggctcactgcaagctccgcctcccaggttcacaccattctcctgcctcagcctcccgagtagctgggactacaggtgtctgccaccacgcgcggctaattttttgtattttttagtagagacggagtttcaccatgttagccaggatggttgatctcctgacctcgtgatcggcctgcctcgtcctcccaaagtgctgagattacaggcgtgagccaccgcgcctggccactttctctttcttatagtggtttttctttgttttctgtaactcagcagctcttcatttgggttcagtgtagttcaagcctctgcttctcagtatacttcctgggctttttctttagccttgtcctccagtagtggtgctctccagctgtgtcctcaggctttccttctcaacatatgcacttacccttactgtccctaaccatggcatcaattttcatttacatagtgattccttcatccatattgccactctagaacattttgctgggcccattaaatgtcctggtggacagtgaccagcacatagtagaaatgtaataaattattattgaatgaatgatgtctctagatcctagccattatatccctgcatcaagcttggcatattgaaaatcaacttattctttctgccccctgtcccccattccaaccagacttccttttcctcctgcatttcctataaaggaaaaacggtcctttagcaacccagccactgaagccagtaatctagccacatctaattggtcaccaagttcagcatcttccatctctggaatgccatttgtatcccatcttcctcttcaggtcatacttcaacacagatactccccatttctgaataacagcaaaaaccttgcaactcttgatttaagggccttcagtttatccttcacacatctgcaaaagtgagaatttgatgccatgacttatcaggtcttatcaggttaaatccggatattctttggctgtgtccccacccaaatctcatattgaattgtagctcccataatccctgcatgtcatgggagggacctgatgggagataattaaatcataggggcagattttcccgtgctgttctcagcatagggaatacgtctcatgagatctgatgattttttaaagggcagttcccctgcacactctctcttgcctgacactatgtaagacatgcctatgactccttcgccttctgccatgattgtgaggcctccgcagccatgtggaactgtgagtccattaaacctctttttctttataaattactcagtctcggatatttcttcatagcagtatgaaaatggacgaatacaaaaccctttaataaatctccaaagttgtaaatataaaatttgaataaactaatctcacaaaatatgcataatctagttcctgtctttgtatagtttaacctttacccagttcccactcagctgcaggcattctgagcatgctataatgctttgtacacgtctttgtatggaatgcaaactccctcttttacttaattatcattggcatgttcttcattactcagctcaagtctctttgattgcaggaaacattgtatcatcccaaatctgatttagggcccccactctctgttctcccacagcatgctgtgcagaccgtgtcatagaaagagcaatacagagttgtgggatatttgctttttgatgtcaaaaaatatcttattaacttctcataccaaaaaacaggacaggactgatgcaatagttattcaacaaatgcttgtcatataatgaatggaaattccatatatccagcctgacactcccgaaattacttactggtctgacttttttgcttgaaggaaagcagctggacttgggttaaactttcactcttctctttctctgtctcttcccttcattgtgctttttctttctaacctgtatcaaatgagagagaacctgatattagtcacatatttggaaattttttggtatcactgagatttggtccctctcactgtcttagcagttacactttaagctggcttacatatagttgtaaaaagaaagactaggttccccagttaaagaaacttcagggacagaaaagctctcttctgcttgtttccttgcttgtaaagttagtctttgatataaagtttaatccttttatgctgcctggaatgtgctcagaggttttctctgcagattgtttcatctggcagttaattcctgggtacttctgggaattgaaggaaagaggtttttgagttttagttactgaacttcgataccaccagtcaatccaacagttctatgtctgtatggttttttgctttgtttcctctaaatcggtgattcttaaattgtattttatttgatgggcacatgagtaagtcaatacaagtacagactcctgggcaccatcccttctgattcataaggtctataatagagtcatggaatctgaatttcactgggcttatgagaagattccagagcagaggattcgtgccagtgtgactagggaatctgttttctctcttagcctttctatctgatcagaagatgaaacctgtctggggttctgcgtattctaattctttctcttctttgacttcaagttccccagactctgagggctaaaacccagtatttagtggccttttacagagcaaattggctggccattccaccttatccttgccatgtaagccaccagccatgcagactttccattacctcatgatcaagagtttcagtctcttcaccctcaccaggacagaggacatagtcaaggagatccctgcagaatacactgacaaaggacttcagaaataaagggagtcccagttatgaggatagcagacaaggaaatatggtagagcttatgttctgaatcaatcatttcagattctttggtttttacattgaacatgtatttgtgattactacaaatggttccaaaaaaaaaaaattcccaaaaagtaaaagtacaaccaatgccatacaaaatagattaaaaaaatctccaaaagtttaatggttcataagtacactcataaattttgaattattattaattcataattcccaagtagtatgataactagtatgcactttacaaaaggcttggtaggttaatatatgacaaatattgcttggaaattttattttattacaacactcaatttctaaattttagatttcataagtaagtgctcctgtgatgggcctacaaccatatatatatatatatatataatgcttcctcatatatatatacatgaggaagctttagttactgaacttggataccaccagtcaatccaacagttctatgtctatatggttttttgctttgtttcctctaaatcagtgattcttaaattatattttatttgatgatctcatgagtaagtcaatacaagtacagactcctgggcaccatcccttctgattcataaggtctgattcatatatatatgtgaggaagcattatttcccactgttctgaagcagccaagtaagaattaagctattgtgtcggtgcatacagacaactgcagtcctttgcagtttttcgcccctctggctacctttattatgtcagtgacaaaaggtgatacatttagtacatcgtgaataccgacctttcacactctttgagcccctctagcactttttctttttgttctgatcttcatacactatttaagagtgttatcagcaccaagaattcatagagtaatgattccactatttaattcttcatttctttaaacaagtttttttcttcctcaagccgattttcttttttaatgaaaaagctaattatcctttaaaacaacattttttttttttgcattttgcaataaagctaggaagtaatttagtaactttctaatagtaagttaatgagttttatcccagatctagtatcgtggggcatattttttatgtgtacataatgtttctaaactaagcccagttaatattttcttttacatttatcagcaagaaagagagaaaggagactaaaaacagacccatagctccccaaagtgcttaacaggagtatttaatggcatccaatcatacttagtcgctgtgtagatagaaagctctttgcaacaaaacgacaaagatcagacaaaccactatagtagccaccagagaactttgtatttcttatgtccattctgggctgattgtccctaaataagagctaacctattttctctgactttacatgagcaaagaaaatgccttcaaagtgctttctatagcaggaggtacaggtgccaacgtaaacctagataaaagctgtttgtatatttatttgtttgcttgtttttatcacactcagtggcctcgtgatgcatgtaattaccttgaccaaagcataatagtagacagcattaccttggaagagtcttagtaagatacaaactggacacatttttgagagaagaaataataggagttgggtgaaaacatatacagcatgggatcccacctaatgcactttatatcctaaaatagggagctctccacactctcaccatcgccgtgcccacacatctcatacgtgcatgcactcatgtattactaattctgtggtgtcacagtgtccacactcccatttgcagacttgtccttttgagacagttttttggaaccagggagcacttttcttgatagagagaattctaaatttttttgcacaatcaaaatcttcagtactaaatattcacattagcaacataagaaaagtgtccatataaagactaattgtccatacaacagttcctaatgttacattttagttagatgatctacagtttaggtcacagatactcagacctattccagaatctagccatattcaactttcatacatcattttttctcataactaaagatcaaagtagtaggaaaattttcatgatattgcaaagagatttttaaaaatacattagcttaaagttatttatcattaggaacctaagttttattcttatttaaagaaccataaatagaatttaaatcaacatctatcaagatctgtctatcatatcaccttccagaagtcaacactgtaaaactcaaatatgcgtggcttttggacaacaattccatttttagaattgtatagcaagcaaataataagacagagttacaaagatttatgtatgcttttcatctcagcatagttttgaatgatgaaaaatgtgaaaatattttaacatcaatagttgtatggtaaaataaatgatctgatgacatgctaagaaacaattagagttagcaagcagagctatgttgtttgacagagaaaacataagaaacctactctatactaaacagaaaataaaactaaaatgaaaatacctggttgaaaatataaagaaagaaaaaaacataaagtgatatatcaattttaacagtgatattttccaagtaataagagtaggtcatttgaatattttttcatatttttaataaattgtttcagttgaaatcaaatgaaaatctattatttgtataataaatgatacatgtattttcatttaaaaatatttggtaaagagaaactaaagaggaataaaagaccagatgtttagttttactgtattttaaatctgtactcatatttgaaatacctatttgtttgtctaaatgcccgaatggattataatcttcttaaggcaagaggccgtggattgcccttttttttttccattgtacccctacaaaatagtagttgcatgataatgtattatgaataaatgtgtaggtggccttggtaaagccactttctctctttgaggctcatttttctcatctagaaaataaatacagggttctctactcacctcgctggggattgctgtaatgctaaaaggaggcaacacatgttgattataaagccttccatgtatgtgaaggaacattatttttaaccacagtaattacactcatagaaatcagtgaagcaagtgttggattcccatccccaggcttggctcaaggccaaatacaaaatcatgaagcaagccaaaaatacaggctgcacaagctgctcatctgtgcctgccttcctcactttagagacatagcctgccctcaggttccctgcaccttcctgctctatctctacctctcatgtaaaagtgtattcccattaaaatggaaccagagacgcatgcttcaatctgcacccgggggatatgcgttttcaccagagataagaaattatcagacaagaacaggatcagacctggatttttctgttttggaagacacacctgaaatcacacacccctccttcccctcatctgaaggccaaccaccaccacatggtcctttcaccagaggtagagagcactttgacactcagatctctgctggaaatgaaaacaccataaatctactcaagcaaatttcacccctctgtaagaaaaataacacatattattaaaagttatccttgtgttacatgaaaaaattagaaaaaaatacaatgacagtaggctttgctactatatccccataatcacagtcataatgtattaggtactaagaacaatacagaacaaccatattggtttattcagctgtttaattagatcacagttttttggatagatgaaggtataaaatatatatagatatggatattataaatcaatagatgtagatagatttttacatctattttaattttttttctgtttataaataagtaaaatcatgtattttatatatttaaatgtgtatgcattttaaataggtttcaatatttaaatattaccatctactttaaaagtctattatatatttgtttcttgtttttcaagctttttaacataagagcctgaaaactattctaatgaggacaaagtaacagaataaacctaggcacatgcccaagggaatgaagtttaatggactgtttagaaaagcatgaggttaattaggttaagattcttagaaagtgagatttgaactaaaaaaaaaaaataataaggtgttttgctgttggaaatgagaagatcataaaattcactaagaacttatccacagtgagtatagagaagagaatgggccatcctacccattgctgaggccaaaacccatcctggctgcctctctacactcacaacccacgtctaccccatcaactagttctgctctcaatgactctatcaccgccattctggttcaaacaccatcgtcctctgtctgtttttgcagtagcttcctgccttagtcgacctactttcacccaggccctattcactctcatcacagcagccagtgtgattctgttaaaatatgcattctggtcatgtccaacctcatgttaaaaacaacagcctccaaggccctgaactatacctcgatgatcttggcttctactgcccttccccttgtttgctcactcagttgctcacacattttaatcatactggatgtgttgctgtcccatgaacacatcgggcaagcattagattctcagggcatggcgtgtgctgttcttccaacttacctactgcatggcaagatccatcaactccatccagtcattgcccagatgtcatcttctcttgaagacccaccttaacaaccatatttaaaatagtaacctcacttctgttttccttatctcccttatctgctttatttttcttcatagttcattatattctttttttgtttgtttgttttgagacaagtctcgctctgtcgcccaggctggagtgcagtggtgtgatctcggctcactgcaacctccacctcctgggttcaagcgatcctcctgcctcagcctcccaagtagctgggactacaggcttgtgataccatgcccagctaatttttgtatttttagtggagatggggttttaccatgttggccaggatggtctcgatctcttgacctcgtgatctgcccacctcggcctcccaaagtgctgggattacaggcgtgaaccactgtatgcagcccattatattctaatatactgcatcttttgcttatttgtgtgctatatcacctgtctcccgcaattagaatgttaattacatgagttcagggacttttacctgtctattatgtttataattgtctccccatctaaaatagtgtccagaacattagtaggtacacaataaatattttttggattaactacattcatttatttgtgctgggaacagcaacaaaactagtctgaagagaaggggctgaaattagacctacaaaagcctgattcagtagatttttcagttggaaaatattgagtgcttacattaagatagttatggtatgatatactgatactgaaatgaaaggtaaaaaccaaagtaaaatttaagtatagatcttaaaatgaatagccccaaaccatttcttactggaaaatttaagtctgactctattgctgctattatagcagagataagagacttacaaaatctagatgaattaacaaaagattaaaatcatttaaaatgttaggagaaaacttaataaaactcttataatgtgattgccaaaaaatgcacaaatatttccaggaagtgttaaaagttgtctattgctaattatatatttgtacttttttttacagctactcatgtgtagaacaaaaaaatagacaaaattactcaggctcaatgattcactatgtacagtttacaaattaattagcttctcttaattttttcaattaaaaaagtgttaaagcattagtttattgcttatttccgtgttaaaatgctggttaattgcaaaacattattaggggccaatattaaaattccacttacaagtgtcagagaagcaaaacacatttaaagttcatttgcaaatccagcttacctaaatctacttgggataaagcaatactgctgaagtacgtaaccacattctgatgatgtatgtgcaatagtttttcccattagcttactaatgtatgtgtatgagacagagagagagagaatgtgtgtgtgtgtgtgtgtgtgtgtgttactaggattagctctagtttttaacatcataacagaatatgaagcacgatgcacaaaaattcatttataatttataaacactgagcttttaatttcaggtgtttcttctttctagttctctatgtcaatcatatagctagatacaacccagaagcaactctcattcagaaaaccacaaaatgtaattaatttctttcttttcttttttttttttttttttgcgtgtgtgtgtgtgtgacataatctcgctctgtgcccaggatgcagtgcagtggcgcaatctcggctcactgcgaccactgcctcccggattcaagcgattcccctgcctcagcctcctgaatagctgggattgcaggcacccaccaccacacccagctaatttttttttttttgtatttttagtagagaccaggtttcaccatgttgggcaggctggtctccaactcctgacctcaagtgatcttccctccatgacctcccaaggtactaggattacaggcgtcagccaccatgccccaccaagatgtaatgaattcgattaagatttggaatcagtcttgctgagatattcaagaggaaaattgtgaaatgggatctgatgctattcacaaagagttcttcttaatgcttcagaggcagctctgactgttagggttagggtcttatatggcaagtacgaatactcctactcttaaatcttcaatacagcaggcagggagaacttccttgttgaatttttcaccatgtgctaaaaggatggggtgaacttggaaagaaacatccgaacgtcaacttcattacaaacagcaaattgagcagctgtgggagagaaagttcaattgggacataaaagatccattcactgatttcagaaaagctatttctgaaaatgcacaataagtatatagcactggagtagcaaaataagtgtaagtcaactatagaaagctatgataaacaagaggaacaataaacaggacctaagattcattcgcacatatgtaaataagactacagcacaaagtaagggatactctgtcagcattatttggcattggttgttgtttttgttcaaatgtttaatccatgtcccagaaacttaagatttcaagtccttaaaagggacttttaaaaagtctcaagtaacaatgaatggaattaacagttttttagccagtcattttagtgtcttaaaaatagaaaaatatttttatgaagataaaaagaataagaaccatccattgcgtcaccatctagaaataagcactgttgtttttctttttgtttcctttttcttttgagacagaaactcaatctattgtcccaggttggagtgcagtggcgtgatcatggctcactgcaacctctgcctcctgggctcgagtgatcctcccacctcaccgtgtctgttttgtttaagagtatatagttatcaatccttaaagccgaatttcattcttggtagttactgttaaaattaagcatgaacaattgaaagattttacaaagtatatctatcatatacctgcggtgtatcatccttggagaagaaatgaacatacactgaacatagaaacaactaaactttctagataaatggaactaagagactaacttctgtttcaaatgatgacgaatttcagaaagagaaaaaattaagtagaaaaaaaaggagaatgtgagagactggggagagaaaaaataaatgagagaaggtggtagaccactaggatgaagaagcagaagatgaaggagacaggcaagatgctgacctcttagctcagtcaaggtctggactttgggggcctgtcctagcatcatctcttgcagtctagcacatgtacatacagatgctatgagaacatatgtctgtcaaaggccagtgtttttctagatcagaaacattttgtagctcttccggtggacagagttggatcatgtgttctctcaagtatttttatagatttcagaaacactgaaataatcagcactgaacgaatgtagccaggcttgtttctaaccctggattctgtgctttgattttgctatcacgcccctcactgtcaaccaccctgaaaagagaccttataaaaaattatggctgggcgtggtggctcacgcctgtaatcccagcactttgggagggcaaggcgggcggatcacctgaggtcaggagttctagaccagcctggccaacatagtgaaaccccgtctctactaaaaatacaaaaattagcagggagtggtggcgggcgcctgtagttccagatactcgggaggctgaggcaggagaatcgcttgaacccgggaggcggaggttgcagtgagccgagatagcgccactgcactccagcctggcgacagactctgtctcaaaaaaaaaaaaaaaaaaaaaaattatgctgcagtttcctagggctgctctaacaaattatcacaaatgttgtagctgaaaacaacacaaatatgttatcttacagtttgggaggtcagaagtctgaaacgggtctcactaggttaaaatcaacaggaacgcattcctctgggaggctctgagacaatctggtccattctttttcagcttctggaggcctcccgcattcctgggcttagggcactggccgtcatcttcaaagccagcgatgactgatgtaatctttctcacatcgcattgctctggcactgactaccctgcctttctctttcacttgttaagatccttgtgtttctattgggcccatctaaaaaatctaaaataatctcctacctcaagatccttaacctaatcacatctgcaaaatcccttttgtcatataaagtaatttatccacaggtttaagggatagggcagcaacatcttgggaagtcattattctgcctacctcaaacctcaaattgtattctgtgattatttttcaaaggaataaacttggccaggcacagtggctcatgcctgtaatgccagcactttgggaggccaaggtgggcggattgcttgaggtcaggagttggagaccagcctggccaacggggtgcaaccccatctcaactaaacaaaaatataaaaattagctggacatggtggtgtgcctgtcatcccagctactggggaggatgaggcaggagagttgctggaacccaggagacagaggttgcagtgagccacagtcgtaccactgcactccaacctgggcaacagagtgagactccatctcaaacaaaaaagaataaattcataaaatcaaatatttttttactgtgtgatagaagcagaaattagaaagcattatgaccacccacgaatcataaaatctttagtaggaccagtaggttaacatttttcctgttggagggagcgtttctttgatatataaactttcaaggagtcattgaaagctttggaaggcttctttccaaaaataatcttttagaaaaagtctttccaaagaatccagtcgttgtattttgggcaaaatattagaagtatgagaagccagagtgtgaaaactgagttaatattcttatgaacacgaatacttggcagccaatattgaggctgaaaatgcatttagaatgttaatgtatttccatagtatttcagatcaaagatactgaagggaacttaactgcaaattaaaaatagagaatctacaggaataagttacatttcttatagcttcctgtgcaatatcaaatcaagtagagcaagaggtggttcctactttacataatttttctcagaaggatgattttgtttactaccattgccctgtaagtattatgctttcaaggaagctctaacaactggttatcgctgaggttagtgtctctcatggtactcgcttcatgctctgtccattaggtaaatgacatgcaaagatggcttcctctaagtttctgagacacaggtactcatatttaacttccgtggaggaggaacacaggagtgaaatagaaaggtctgcatttggtgtctgtcttcccatccattcctaagagaagatgacataggcctactgcttatcaagagcatttgaccctaatgagtgtcgttatagaaaagttagaacctttctataagactttgtattttactttccagaaaattccaattcactaaactgtccatttcttctcctactagtgtgttattttcagggtgttttcttcctattatagtctcagaaggcccatgctcagcttccgtagaccctgtcctctgtcagtcagtcacttcatttacccctaggttttgactcttcacagatttctggatatctccctccaaagggatagctcttctgttgctaatgactagcatgagggttggtaagtagtgacagtaaaattaacattccttgaccacatgaatgtgagcaacgctttggatcagacacctgatctctgccacaccttccagattaagtcaaaaatgcctatcttggtattcagggtccacccaatctgcctttcctggctaattttccatgtctctcctatgttaaccctgcattccaaccaaatggtctgtttcccattcctggaatccctaggataaattccattaatttgcctgcttcggtgtagttgttcatgccattctccttcctctattgatcatagttccactataattttgttgtaattatcgggaaccaaagaagcatgaccctttcttctcatacaaggtttggatcaatttagaaataagatgcctagtagaaaaaagctggccatcaaaatgtctgctttattacaataaaagcttatttgaaagcagtgcttagatctacctacagtctaggcatactgctaatattactgtctatgcaaaaactgaaatcccattccgtggaagtctcccctggcaaaggaagagcctgccccaaggtgtttcccatgtggaagatgcgagaatattgctcctaggcagcctgaaatggagaatataagctgctctgatcaggtattgtttcttcttctaaattcacaaaatagacgagtcattctctgcctgtcttcactcgccaggatcagtgattttgaaggtgggggtcagggtgggagtagaggaatatagagagaggcccaaagtcaccttggctaaagtccctctgtgtggaaacatgagaccaggcgcttttatgaggctttcttgaatatgcttatctgtgaaacataatgttttcccctttgtgctcccaggtttgtaggttatatccctcatgcagaactgagagagtggttcagctaccaaataccatctgttagtctgttccagctactgtaaccaaatgccataaactgcatggcttataaataacagaaccttatttctgacagttctagaagctgggaagtccaagatcaaggtgctggcagattctgatgagggtcccctactttctggttcatagatggcactctctcacaagtgtgctcatgtagcagaaggggcacaaggagtatctctgaggcctcttttatgagggcactaattccacctgtgagggctctgccctcatggcctaatcacctcccacagttccccacctcttaccaccagcttaggggattaggatttcaacatatgaacttggaggacacacgaatattctgaccatagcatatacttactggttttttatttctgattttaattggtgcttaaaggaatatctaggtattcctaataactattatccaaaccttccaccaatattttcaataaatgcctggggaacagaaaatgaatgaattaaagtatctaccaataatattttagaaaaaaaacctaaaatttgcaccttcctttttattcacaatatgattttcatatgtaatatttagaattattaccaaaagttgtagcagagcctataaattaaaaaaaaatttcaagggagcatattagaattaagcagtaaaatggtagaaacaaatggcttggtgggataaggagcagtaaacatttttttgcatattctccagttttacaaatttgccatcttcacattttgggggaaaaaagtttgaaagaatgcctttttaaatccattgagaaacatggatagctgatgctgtgcccatactcaaacttcaaaattttctggcccagcaaaaaaaaaacaaaaaaacaaaaaaaaaaaaacctactaaaaaataatagtttattgaagacaagaaaaaaatattactctgccttattcatatgcctgggaatacaatatatttgaaatgtattatttctaaatgaataacaaacttgtaaaccaacacaatcaaatgaattcattttcatactagttatgtgttacagagcaacaaattactccagattgtagtagcctaaagcaagaaactcattatttcacagtgtctgtgggtcaagatttcaggcacagcttagctgagtgcctgtggcctgggtctctcacagtcaagatgcaatcaagatgctgatgtcagtgagggccgcactgatcataaggcccaagagggtaaagatccacttccaaaatcattcaaatgctgctggcaagtctcagctctttgctagtcatcgactgggcacatctgttctttctcatggagcctcgtcatggggctgaccacatggcatcccggttcaccaagagggagagttctgacacagagagaggagacagcgagagagagaatgaatgcacaaaacagaagccacagtcttgtaatagtctaatcatggaaatgacatttcatcacttcaccgtattgtattctttggaagcaagtcactaggtccagcgagtctcagagggaggggattatacaaaggcatgaataccaggagttggggatcctttgggatcaccgtagaagctttcctacatatccttctttcctaccttgtctggataagttctgtctgttcctggagacagctgaagaatttcctcttccaggaagctccctccacacagctgagcctcctcctctctgcttctgcagcagcttgggccccctgtatcagggcatcctgaactgcacaggtgccttgtgagcacctgtctccttgcgtgtctccctcttcgggctcttattcctcaacagccaggttcctgtcttactcaattcccatgcctagttcacagcacagaccgtgtgctatgtacagatgtctcgtatggagctataaattataattgaacataacagaatttcattcacgttacctgcagaaaataaatactgcggtgaatctcactcacttgcccctaatactcctctgcaatatttaagcacggaggtcaaacagtttcctccgtttgggaacttgatatttaatgaaacattttatgagtccgttgacattgcttacctcagctgcagttccacagatgacttcggaatgtgtgaaatagatctcttattcttcactgataaaacttcgggtcagactctcacacaactgcacacatggtagctttgctccactcacaccttgtctacagcctagatgtttgcaaatagtgctttggtttttctttaaaatatccttttgctattactatatatgcccactgctttgttcagttgaaaaatagcgtggctagccgggcatggtggtgcctgcctgtaatcccagctactcgggtggctgaggcaggacaattgcttgaacccgggaggcggaggttgcggtgagccgagatcacaccattgcactccagcctgggcaacaagagtgaaactccatctcaacaacaacaacaaaaaagcgtggctctgttatgccctggcactgtgctaggtccccaacattcacagaagactaaaatataatttctaatgtgggagacaaaggtttataagccaaagagacacaactcatcagctggattttgcactgtgacaagaactgacttagaggagcgtggctgtcttctaattcagggactctggagggatgtgtaactaaggttcaggtcagcacacccaatgcaacatgcatactctgtgcagaaagtaaattgaaaactctgcttgagggtctcagtggacctcaaagcagccctgacattttcttgtaagttagtgcagcataggagttccaattctgcgttcatcctccacagtgagtccccaggagagggaccagagaatggagtaaaaacaaagggaagggagagaaaccacagctctagtggtcacaatgacaccaggaccagtagaagcctgagtcatacaataatttctactggttcagtttctactgaataatttccaccattaaaaatgactccaagcacttacacatgggtgaaacctagaaagtgaaacaattgcttgttatatcttgttagcaggcaaagaaaggatggtgaaatcagctgttggtgaaattctgacagcagggaaagtcgggggctggcatttctggcaggcatgagagccacaaacgggtgacagaatatctcaagagacaatctagccttattcttaatttttgcttaacatatttgttttgacataacattctcatacatctttaagttgagaatcagaaacatgtctttgttataataatattgttgatgtcaaagaaacacagagcatatgctgtcttaggaattctaaatggcaaatgacatgtgtgtctgtataacaaagacaaggagagatagagacaaatataaggagagaaatgcaaaccaactctcaaagtccttaaatcatattataagtgggcaaagacaaggaaagacagaaatagagacaaatataaggaaagcaatgcaaaccaacactccaagcccttaaatcatattctaagtggataaaatgtcacatgtgaaagaagtgagataccagatacttgtgggaactaaaaatggttgggcgtgtccagagcatataaagaatgggcagcagatatagttggatgggtaggcagaagctagtgataaaatattggatatcttaaaccaagtccttgaactttattctggaagattgtgatttaatggatttaatggggctgtacgtcttaacataagaagggaagattatgttaagaagccatacatagggaaaaaataaattctctcggatcaagttacttcagtaaacatatttactaactgtattaatattatgactctttcatattccgatatgttgtttcctaaatttattttccaacagaaactttttcttggggagcatgggtttcaggatctcaaggagccagtagtccaattgttttagaaaatattgttaggctgggtgcagtggctcacatctgtaatcccagcacttcggaaggttgaggcaggcagatcacttgaggtcaggagtttgacaccagcctgtccaacatggtgaaaccccatctgtactaaaatacaaaaattagccaggtgtggtggtgtgtgcctgtaatcccagctactcgagaggctgaggcaggagcattgcttgaacatgggaggaggaggttgaagtgagccgagatcaccccactgcactccagcctgggagacagagtgagactccatctcaaaaaaaaaaaaaaaaaggaaaagaaaatattgttgtggaaaaacattgcaggaatgcttgaatctttggcatttttaaaaaatctaattcacagtgtgactttgggacaaataagttcatttgtttgggctttctcttgtggactaaggaggtagaagaaaattaagcagtttctgggatcccttctggcagtatattctcctagtctatggaaaatatgctataatcagcctgtctggaatatagatatcaagctcgaggtaaagttttactcgtgaggattaaatcagtgagaagtagcatatttaagaaaaaaatatacaatcaacttgagcactctaataatggtttagtgctcattgcttgaaggaataatttttgacaaggtcctgattttaaaggctaatgttcattttttgcctcgaccataagtaagagctagaacctgtagtatataggtcaacagattctaaaatatatttcagtatgtgctcaccaaatcaattagattttttaagtgaaaatgaaaacctctttgagttcagtcctaggctagctggtaaagatggaggaatcatgtgctcatgactagtcctcttccaccggtatgtcaagtattaagagaaagaagaaagacgtttccaaataacttgggatttggggactttggcttaatttgtacttgtatttgtttccttagactataagccacggattaagtttttctgtcattaaggcaccattaactattagaacaggttaacattaaccaatagaacaggtatacctttgatttccatgaattatggaagacaggcatttctttttttttttttttttttttttttttgatggagtctttctctgtcacctgggctggagtgcagtggtgtgatctcggctcactgcaagctccatctcctgggttcacaccattcttctgcctcagcctcccaagtagctgggactacaggtgcccaccaccatgtatggctaattttcttgtatttttagtagagacagggtttcactgtgttagccaggatggtctcgatctcctgaccttgtgatccgcccacctcggcctcccacagtgctgggattacaggcgtgagcaactgtgcccggccaagacaggtatttcttttcatattttataaattagaaaaccaaggtttagaaatcttagagagcatacccaaggtcctaaaaagtgaaaagctgcaaaattggaaatgcagcttaagtcctctcagtatgcgcagcgttatacctcattttctaaaagatagcatttctcaagaaaatgtatacatactgtatgaaagtccctgtaaataatgcaaatgcttgttgaatttttaaaatgtattctgaaactcttgtcaaaataatagttagtttttaccaagtagcatcagtagccacattacatagcagaatttaaattataatggcttgaatcttcttactctttggcacaggtgagaccaggcaggcacactagggaggggcagatgtgagccgtgtaactatctcattcccttaggaagccctttttacaaaagcaaagttggcttctgtcatagttttgattcttctcaagtcagattctgagattaagacccaggctggcctgagactaggagaaggattatttgggaggttatcctggaaagcccaagtgaaggagtggagataataagacaggagagggaggaaagcaaacaaacaaaaaaagtgcattgatagggagaaactgctgctattaattgagctcaatcccactggagagtctctgagaaaccttttggtacgtggggatgctgggacgttattcactgactcctgtcctgtgttggttcagggtggactctaaggatattgactttcacacacttccaggttgcacctatatgtggccaagcaggctccctttgagcccaaggaagtccatgaagagacataagtttctgaggtgggaagctgtttactctaaatagtcaaactcaattgtggctgaactcagaagaatatttaggggagaaaaatacatgaagttctatttcctcattcacagggatcgtggcataaggcagactgcatgggttagggtagtttgggctgccagtaagtgtaacattctctgtgcgaaggccacattggttggttttctaaggatgcaggtgtgtctcatggcacaggaggccagagaagggctcagaaaggctgcagagcatgaacagaaccttactcattctgtctctcacttggtctccctcagtgtgctagctttccctctctcctttacacacaacactcacagacacacatgcacacacatacatgtacacacatgcattcacgcatgtgtgctcacacacagactagctttttctgtttttcttgtacatcttacatgttcctggtttaatcataagacaaatggcctctctcttctggtaacaattttatattcctggtcaagggagctaggttggcccacacatgagagggaacagtggaagtaggatgtgtaatgcccagaagaacaggcatcggaggagagcccaggagttgattctatatgtaaatctgttataataccaatccgaacaagctagtattctatcaaatagccaaatgcagaggtaagcaggaagtaagtaatatcttttgtgattttttaaaatgacacacagtagatgagctcagaacatatacagtacagtagccactgggcaaccattagataaacaagaaaagagccagaccatggggatgaaaccatctttaatcatggcaagtggaataatgtgtaaaaaagttatgctaatcataaaatggaaacgatacatgtccattttagaatcaaatggcacagaaaatatgtgagcatatcagcaccatctatctacattatacccttgagagcttgtagattctgagtttaacagcaccatatcatgaaaaatgacactggacaatttggattgtttttataccatgggtctcagtgagaaagtcagctttctctttcccaatgcaaataaagattagcaaatatatttaatatttatacctgttctggtgattcattttggcttttgaaagtgaactccaccataaaaagataaaaaccaatcttccttttctcattccttccattattcattcatttattgatattactatattataggcactgtgccactctctctgtagaagcgcctgacagtagaaacaagggcttcatcctcctggctatgatcatgaggctacaacataacactgtggctttttgagaattatttcacagcctatttccagagcaaagtaacaatgctgttttttttttggtttctattttcttgtttgtttgtttgtttatgaagtcaaactattatggtgatgttaccaacttctttcaaagcagaggccagggaatcaaggacgttgaggcttaataaaataaaagcaaagtatgtttgtatatttttcatgtgttaggactacaggtttccagaaaataaacctttagtgcataggcaattttatcattagagatttcaaaggggatatgcatttatcgctatcaacagagccggataaaaagatttttttctgactatttccataatgttccattatgtttttaaacatgaaaaatttattccaaaggccaggaaatcacaggactccaccaggtgtgataaggtcccaatctaataaaagtttaactatctctctggctattagtgtttatttattcaagaaaggtccagaatgttattttgaatattcagtgtattatcaataatcgtggggattgtgatgacagtagtggcaatgacaaaaataacatctgtattagtctgttttcacactgctgataaggacatacctgagactgctaagaaaaagaagtttaattggacttatagttccacatgtgtgaggaggcctcagaatcatggtggaaggcaaaaggcactttttttttttttttttgagacagagtcttgctttgctgcccaggctggagtgcagtggcacgatctcagctcaccacaacctccacctcctgggttcaagtgattcatcagccttccaagtagctgggactataggcgtgtgcctccgtgcctggctaatttttgtatttttagtggagatggggtttcactgtgttggccaggctggtctcgaacttctgaccttgtgatctgcctgcctcaggctcccaaagtgctgggattacaggggtgagccaccgcacccagctgaaaggcatttcttacatggcagtggcaagaaaaaatgaagaagaagcaaaagcagaaacccctaatagacccattagatctcatgagacttattgactaccacaaaaatagcacaggaaagactggcaccctggattcagttacctccccctcagtccctcctacaacacatgggaattctgggagatacaattcaagttgagatttgggtgaggacacagtcaaaccatatcattccgccactgactcctccaaatctcatgtcctcacatttcaaaaccaatcatgccttcccaatagtcccccaaagtcttaactcatttcgacattaactcaaaagtccacagtccaaagtctcatctgagacaaggcaagtcctttccacctatgagcctgtaaaatcaaaagcaagctagttgctttctagatacaataggattacaggttttggacaaatacagcggttccaaaggggagaaattggccgaaacaaaggagctacagggaccatgcaagtctgaaatccagtggggcagtcaaattttaaagctccaaaatgatctcctttgaccccagatctgacatccaggtcacgctgatgcaaggggtgggttcccatggtcttgggcaactcctcccctatggctttacagggtacagcctccttcccagatgtttcatgggctggagttgagtgtctgtggcttttccaagttcaaggtgcaagctgtcagtggatctaacattttggggtctggaggatggtggccctcttcttacagctccactaggcagtgccccagttaggactctgtgtggggactccaaccccacatttcccttcctcactgccctagcagaggttctccatgagggccccatccctgcagcaaatttctgccttagcatctaggcgcttccatacatcctctgaaatctaggcagaggttcccaaacctcaattcctgacttctgtgtacctgcaggctcaacaccacatggaatctaccaaggcttagggcttacaccctctgaaaccacagcccaagctgtacattggcccctttcagccatggctggagaggctggtacacaggacaccaagtccctaggctgcacgtagcacggggaacctgggcctggcccatgaaaccactttttcctcatgggcctccaggcctgtgatgggaggggctgctgtgaaggtctttgacatgacctggagacattttccccatggtcttggggataacattaggctccttgctggttatgcaaatttctgcagccggcttgaatttctccccagaaaatgggtttttcttttcttttttttttttttttccgagacaaagtctcactctgtcacccaggctggaatgcagtggtgtgatctcagctcactgcaagcttcaactcctgggttcacgccattctcctgcctcagcctcccgagtagctgggactacaggtgcctgccaccatgtccgactaatttttttgtatttttagtagagacagggtttcaccatgttagccaggatggtctcgatctcctgaccttgtgatctgcccgcctcggcctcccaaagtgctgggattacaggcatgagccaccatgcccggccaggtttttcttttctatcacatagtcaggctgcaaattttccaaacctttatactctgcttcctttctaaaactgaatgcctttaacagtacctaagttacctcttgaatgttttgctgcttagaaatttattccgccagatgccgtaaatcaactctctcaagttcaaagttccacacatctctagggcaggggcaaaatgccaccagtctctttgctaaacataacaaaacttacctttgatcctgttcccaataatttcctcatctccatctgagaccacctcagcctggattttattgttcatgtcactatcagcattttggacaaagccattcaacaagtctctaggaggttccaaactttcccacattttctgatcttctcagccctccaaactgttccagcctctgcctgttacccagttccaaagttgcttcacacattttcgggtatcttttcagcagcgccccactctactgctaccaatttactgtattagtctgttttcatgctgctgatgaagacatacctgacactgggaagaaaaaggaagtttaattggacttacagtttcacatgactgaggaggcctcagaatcatggtggaaggtgaaagacacttcttacgtggcagcagcaagagaaaatgaggaagaagtaaaagcagaaacccctgataaacccatcagatctcatgagacttatttactatcacaagaatagagtgggaaagaccagcccccatgattcaattacctccccctgagttcctcccacaacatgtgggaattctgggagatacaactcaagttgagatttgggcagggacacagccaaaccatatcaatatcttacttttgtattaaataatatgattcctgaagtagttactcatatactgccccatttatttctcataagaactctgggagaaaaaatctatcacctctgttttactgatgagtaaatgtagactgaaagaattcagatgatgtgtaagagaacacatagattataatgacaaagctatagctggaattcagtttctgtttggggatgttgttttgttttattttgatcttagaaaaaactaaaagttatcataaaagactttattctaactgcaaattcaaagataatgtttattcatgcctaggacaaaatttctattaacaatcaaatattacagaaggttgtgaatttttgatgacctgattatgtttacataagtctctaccttttctaaacctcataaatatgaaacctttgggtgaactcttcccagaactgatttccataaacttactgaaaatgagtaggaagaaagagctcaagggacaagtacttattgtgtatactctttagtgatacagaaataaaagaaaagttaaatacctatatttataaaattgaatcttttaaagtcagctgacaggtcaaaatgcaggtaacatttttaagcttcatgcttaaaaaaataagctttatttaaaaaaaaaaaaatacttacttggagccaggcacaatggctcatatgtgtaatcccagctactcaggaggctgaggcaagaggatcacttgagcccaggagatcccatctcaaaaaaaaaaaaagcaccttactttttacttcattgcctcagtgatagcagaccaacagggcattggtaagaatagttttaactatactcacaatcatatactggcttcagttgtactagcaacagttaaaattgaagacacattaagcatgtaataaatgtgaactatcaataagtgaaaccattagaactagtattaaaccgtttcattcttaacatcctttacagataaagaatcagagactgagagagcttaataataccactattcagttagcaagctattctgtggtttaaagagatcagtattgcctttaactttctggcttttagaatttacgcaattctctatcaacatggaggctcaacctgattttggggcattgtgtaagccagtagttttcaacctggagtgattttgacccccaggtgacatttggcaatgcctagagacatttgtgattgtcccatttggttggggttgctatggtatctaatgggagaggccagtaacgctggtgaacatcctacaaagcactgcagagcccctggcaaagaattttccagcccaaaacgtcagtggtgctgaggttgagaaaccttgatatagccctctaagactgaatattaatgaaaatgtttatttaaatcagtttgtatggtcccagtgccacttagaattatatttcttaacaagttagagctcaatttcctctgcccaggcctccttaggatacagaagaataagccagtagtacccttacacggaacaggatagggcaatcatatgattctgaatgccaaggggactttcagattgatggtttcgtaaagtgactgacaccttggacggttcccaagaaaattactaaaacttgagtcttttgcaggtatgcaaaacccatgaatttcataaaaaataaatctttatttcaaagatgggacttttaaagtttaaagtggccttcgggtggagaaagaactaggaatcaaaatttcaatgggcaataaaaacaagtgataatttcctttgattctcacaatcaagatgaagcaggattgtgataagagcttagcatttctatccactcgttgaaatttatcaaatgcctctccctgacttctcgcccttacactgaagtagatatccaaagacttcagatatatacactatggacaagtatttcccctcacttgcagaaattcaagtggcaccagcagtttggagacagaagtctcagtgggcgcaaggaagctggggtctggggcctgactcttccctgccattttggtgccccttcccgcctacccacgccctaccccaatgtgtggcattatccagggggttattaaatattgaaatacagcttgacaaacatctgataacaataggtggccaaggccgggcgcggtggttcatgcctataatcccagcactttgagaggccgaggcggatggatcacctgaggtcaggagtttgagaccagcctggacaacatggtgaaaccccgtctctactaaaaatacaaaattatctgggcctgatggcgggcccctgtaatcccagctactcaggaggctgaggcaggagaattgcttgaacccaggaggcggagcttgcagtgagtcaagatcgcgccactgcactgcagcctgagcgaaagagtgagactctgtctcagaaaaataaaaataaataaataaataaataaaaaggtggccaccagctgtgtcaaaatcaactagttaaaaggtggaaattaaatatgacagtggaaaaagatttctagttggagaatgaaaacttcctaaaatctaagatggctgccattaaatgatattcagattcttcccgggttcttgcttttggatgaataaatggctttttcttcctccaaagttctaatctgatgaatgtgtaatggagataaatgttttggaaatatctccatttgcctggctcctcggtgtctctgtgtaggactttctccccactcaggccaagcttccatctgtgagtggaagatggggaggaggcgaggaccgcgaaggtcacaataagaatgcaaatacagcagtaaaaacagtttaatattcaccctctgtcagcaaaaataggctttcctagtctgcagcaatgtactggaacagacgtaaaagacaggcgttgccaggaaatagggatttactaaattcctttatattcccatttaatatatcaagaggcagtcctggtatccttgatcatatagcatttcccaacaaggaggttagaaccagacaggaagaggagagaaatccacacatactcaccccagtaggggaagaaacaaatctctgaagctctgagcacttacatgactcaccgtggcaggaactaagctacccaagacaacttttaaaattattgcatccacagagtttaccaaatgagtctgaaatttaacatgtttcttttcccagcattttaaaatcaattcctcctttgaaactcctctccaattactcttcatctgtataaattcaaatatattttcattcatttactcattcaacaaatatttattgagcatctatcacgcacagggtgctgcgaatgtgccagtgagtaggtacagataaagtccctgccctcttgaaacttactttttagttggagagaaaaagaaaagtaaatatcatttctggctgtgataaatttcatgaagaaaaacaaacaagaacttcctggtcctcgtgctcactcccttccaacagttttgggggacaccaaagggacagagaggagtcaagccccagaccccagctgccttgtgcccactgggacttctgtctccaaaatgctggtgccacttgagtttttgcgagtgaggggaaatatctgtccatggtgtatgtgtccgaaatctttggacatctacttcagtgggagggagaggagtcctggagagggctcagtacatttcaaggtggtgagagcagtgctaacacgcagcgttctctgacttcctaatgtacctccctctctgccatcagactaaaatttttcaatagctgcttgatgcaatcactttctttttcaagacccgcaactgctcatactgcctgatgctacctcccaggccttgaacatagcttcaaataatgtgtttaacctatgcctggccgtaaagcctcccctctcaccacgccacctcttctaaagtcacataaaaatcccagttctctgtccacacatctaagaatggacactcctctgtcttctcttccctatctttctaaatctgacccttttattaagattcaaccagtttcctgcctgctctattccattcaacacccagaccacagtgatacctcctttgtctaatctttcacaatacactttagcacgttacagattcccaaatgtggaaagaaccatgctggtcttttagtctagcattaaatacaatgtgagtaacacagttataacctttctaataggtagtctcagactttcacactctttcctaatgtttttcaaataagtacatttttaaaaatgcaaatacacagtggtaaattaaattattttgattattaagcattcataatcataaagctatgaataaatctgtatgcttggaactcttatataatcgtaaaagaaaacaaacttaaaaattatattcaaactgaataacaaaattcattcattccaaatgatcaacattaatttaatgtgacatgtaatattttgctaaagtaaagtacctattctcaatgtaaatgtggtattggctactatcaaatgcaatatgtaatagtggggccttacttacctacaaaggccatctctgtcattttttcttaaagaaccttaaaaaaaaaaagttgtagcttcttactaaagaaatctccaatgctaacacaatataagcgtgacttaattacagggtgataatctagatcatgtggacttttcagcccattaaaaattaaaatgaaaaatctaaccattttcaaagaaacgcacatcttttatcatatgccttcatataacaagggtccagaaatccatgttataaaggtttgtactgattcaggtgtttatattttgactctgaaaatggatctatgtaaaatgtgctgacaaaaagggctatttttaagttttgtgcatttttccttatagtacctaaaaatgcatgtagcacatgctggatgttaactaaagattccttgaatatattatctctatttattttatttcttctgatgtgaatttgaaaaaacatttatttacagaccactaaaaatctcccaggaagctgagttagtggtgactgtttgattctaaccttctgaacaaatgttttcatgaactccatgaagctttttaataaacttactcctcacagtgatgcaagtcaaatttaagacagaagaaactaaacgttcatcggtataagaaaatctaagtcaaggtggccaaaaaatcaagcaatcttttaagaatgttgaatcaaatgtggttgttggtgaatgaaaatttcttctattgcagacaattatttgaagggtacatctttttaatactatttccaactgtctcctagagtgatagtagccctgttaaacaattagtaaaacaaacaacaacaaaaaacacattaggccaagtgcagtgactcacgcctgtaattccaactctttggaaggccaaggaggaaggatcacttgaagccaggagttcaagaccagtctgggaaacatagtgagacccccttctacaaaaaaataaaaacttagcccatgaggtggcacgcatctatagtcccaactactcgggaggctgaggcaggaggatcgcttgagcccaggaggtcaaggctgcaatgagctgtgatcatgccactgtactccagcctgggaaacagagtgagattatatatataaaaaaaaatccctcctatctttgaaattttcatagagccacctgtagtttggatgtttcccagggaacacaataaaaacaaattcaataatcctcaactaaaaggcctgatatcatgtttatgccagttttttttcctgagtattttaactttttttctctacttagtttcatcaattaaaggcttattgttaagggagaaaagcattaggacccctagtaagatgctccagggagtgtgttttcagctcaatgtaagaaaaaaatttttgaaccgtcagtactctttgaaactctgtttattccaagatagtgaggtgtctcttaatataacagcttatacaggggctgaatgatgccagctttgggcttaatgttgtttttaggttatctagacagttctgattttagaatgttcataagttaggtctgaattaataagccaataggttcttatttcaaaagaatatatatatacacacatatatatacatatatcaaaaatgtgagctaaattcccatttatctttagtattctccatatctctttcatttccagagtaatggtccttgggaagataatagctagcataatgagacctggtacttacacagcactcaataagtacaagactctctaaatgttcattcctcacaaaactctatgagatacattatagtgctattccccttctacagataatggaactgggacactaaaggttaagtgatgtgctgatacttccaaagctcataaacagaagagtcatccagagccaaactattttggcttcaaagtccaggcacttagacagtgacgctatccactcactagtaccttctggagaagccactaggatagtctgagaatattactggactactaaacaaattgagattcttgaaagctgaattgtgttgtgtttttaccccatcatcacaaacctttacatttgttcagaccaggaaaataaatgtcagatgccaatgtagtgacactatcaactcccaggtgtaatcaagtagagactgagatccctacaccaagtcaaaaacttttatttctttgcatactatggaccatggtgtcaggaataatcacaacccaaagaatcagggaatacagaattttagagctggaagcatttttaggaattgttcattctttctttgttattacagaaatgaggatactgacttctactgagaggatcgtatttcaagaccatgtgatggctttataactgctctttctgactctactgttaactctctcatgtccaggctcataccagccaaaggaaattcgtaataaaatttgatcctctctataattgctattcctgattccactgttaactctctcatgtctaggctgataccagacaaaggaaattagtaataaaatttgatcatctcattctgcttctttacactccttcaaatgttctgcattactttgagacttaatcaaagtccttcagttaaagcatcagttctttgaagacctggtccctgattgtctgcagtctcatcagctcctacttgctcctcttgaaatctggactccagtcactctgagtgtcactccagaccccccagaacatcacactcttacctccatcctttacacatctctttccttctactttcacagcacttcccctggactcttctgtctgcctccacttcatttttcagaatgcagcttaatacctccaaagaaagtcacctctaacccagaggtcacatttgttctgtttagttattcaaactcccaatttaaacaagtctgcctatattgtttcctaacctatgacagatataaagagtaagttatatttctgtgcattaggatacaagaagagcaattagaatttgcacaatgcaacatgacatctccagtaacaatatattgcaaggattcactacttataaaaagggaaacaaggagggcagatcacaaggtcaggagatcgagagcatcctggccaacatggtgaaactccatctctactaaaaatgtaaaaataagctgggcatggtggcacgtgcctgtaatcccagctacttggcaggctgaggcaaaagaatcgcttgaaccggggagttggaggtcgcaatgagccgagatggtgccactgcaatccagcctggtgacagagcaagactctgtctcaaaaaaaaaagaaacaagttaatgaaacaaaattttctgagatcatttggtaaaggtgtcagattggtgcagcgtaatccagtgattgatgtaggtaattttgaaacctgagtcagcaagaaatagcaattatatttaatgtaatatgatgaaggaggcagaaaactgcaataacttagaatgatttccactaaagatacttaaaataaaatgagttttagtgcttatagcaaggaaaactccatttatgtttaacatctacttcttttaaaaatgtatacgatatagggggaagatggtaacagttagaacacccaaattctggtctggtaattgacactaaattagtgagtgactttgagtgagtaagccatatgatatctttgactcttagtataatgcagtggctaggaacaggggctataggctcaaatctcattctattccattactttcaagctccatagccttctgttactttaattgctctaagcctcactttcctcctttgaaaatggaaagaataataccttcctcataggattactgtgacaaacagaaggcacaacacttacaaaacactcagcatagaatatgacacataggaagagctcaaacagctgttgttgttgttgtcgtaatataagtagttacagtgagggagatagatcacatgctctccgaggtcttctcaaattctaaaattctgtggttctatgaacaactcgctcccaaatgatgtcagataaatgagatctcactgtatactgggcaataaaatcaatgtggtcaattttaaatcgtaccctgtaaggtaaggttgagcaggtcatgaattattcaaaactttggttacactcaatatatttctatttgatcatggaatgcatagaactatttaaaagagcatttttaaccttctcatattatgtttaatgattaaaatgagtttgatctttccgtgttcactaagggaaaagaaatggagcaatgctggatagtttatatatgtgccccacttaatcattagcgatttaggtgaaatcatcgagcaactttttgggtaataaaaaatgcaagcaggatatacagttttggcccagataacagacatgcctataaatgagagccagtggcacatcatctccttatgaagctttttcagaatttcaggtagttcaggtccatatgtgctttgaaattctaagggtgagaagatgactatcacgtgtttttccaattatatcttaattttcaaaataggcttattgcagcattgatgtctaattagagttgccggacacagtggctacagtccaatgctataataatctaattaactaaactctccacttatcatgtaagtgcctcctcacctaccacacacttcaccatttaaagtgatatccttttcctttcttcttttttaaatgaagaatttgttcagggagacatttggattgttcagtggtaaaaaaaaaaaagctccaaaaaaaaagcaaataagaaagtaagagtttgtactggacagcagaagtgacatcacctgggcaggcagagcacctgttgaaatccaagacttcatttacggactagctgtgtgactttggcaaattactaaatctccctgagacttagcatctttatttgcaagctgggaataatcggaggaagttaactgagaagctattgggacttaagcttcagggccttttatttgtgtagggcatatatgttcacatagtcatatgcttatgttaagtttacaatgttaagataccttaactgtgactagctaagagctctgtctctttcagtatgactttcttccatcacatggtgaagatctttggagaaaccttgaacaggtttggtgtcatgctaagggaaagttgagatccataaatttgtgtttagtgacaatatttatgtgctctgaagttatttctctatattgtcacatattgctaggcatctagtgtaggaataattttcaagtgcactcccagtgcccatgttcagacctacatatgtatttgtatttaaatatttcaatcttttcttaaagagagattccaaaatgacattaaattcaagctccagaaaacctagattttcctttggggataatgatatgctgagaccagctcagctggggagaccctaacccagcagtgctagaggaattaaagacacacacacagaaatatagaggtgtgaagtgggaaatcaggggtctcacagccttcagagctgagagccccgaacagggatttacccacatatttattaacagcaaaccagtcattagcattgtttctatagatattaaattaactaaaagtatccctcatgggaaacaaagggatgggttgaattaaaggaataggatgggctagttaactgcagcaggaacttatccttaaggcacagatagctcatgctattgtttgtgacttaagaatgcctttaagcggttttctgccctgggcgggctaagtgttccttgccttcattctggtaaacccacaaccttccagcatgggtgttagggccattatgaacatgttacagtgctgcagagattttatttatggccagttttggggccagtttatggccagattttgaggggcctgctcccaaaaatgacacctaccttatactatttctatgaagattaatgtgaaagttttttcctactttcctttgtttgttctgttttgcattctcattcttattctgaacaactctataataaggacatgaagattatctaattcagagtttttatgttttattcccaagcacttctaccccctcaaataaaaccataggcgtgatcttgatgcatgtaataagccagtaattgacagaatttatatgaagcttaaccctcactgtttgggtatatccatctctcatttctgtaaatctccaaagaaccatggcgagcctcaggattccatacgctccatttgaaaacccatgatttaactcaattccctctttttataatggaaactaatttcagagaggctaagtaacctcttgtcttcccattctatgttcaattcaccatatcttttctgtaggtttatgatagcaaacaattgttattatttattagttttaaacacaaagctacctgttttaaacaaaacaatttataaatattcttcatgtcatggaatatttattctagaggaattaaatctttaaatataagtgtttccaaactggaagaaaatacagaagactacatgtacaaatgaggctttgaggtaacctattaccaaagccatcagagatctgtaaaaatctgaaacttttgtgtgtaaatgtacaacatataatgttgttctccacatactaaattggcaaattatgtttgcaacagttatggcacatacaaactgctcttagaaatataaattatgcaaagaatgatgactcagaagcccacagaagagcacatttcaatggccccagacttccaaaaaaaaatttcaggctcctggtaatgagagaaatgcaaattaagtagcaatgaagctctcacttcacatccatcagagtggcaaaaaattaaaagtgataataactactgttggtggggatgagttaaaagggtactttcatttatttctggcaaaaatgaaaattgttataggctttcagaaaacaattttgaaatatctattccaataaaaaaaaaatgcaagtcctctttccagggccacagcatgactttcatgggccctagaaacttgtgcctgtgttgtcttctttctctattaatattatatatatatgtgataagatttggctgtgtgcccacccaaatctcatcttgaattgtaactcccataattcccatgtgttgtgggagggacctggtgggagacaattgaatcatgggggcagttcccccatactgttctcgtggtagtgaataagtctcacgagatctgatggttttataaggggtgtccggttttgcttggctctcattctctcttgcctgccaccatgtaagatgtctctttgctcttcctttatctttccccatgattgtgagcctccctagccatgtggaactgtgagtccattaaacctctttcctttataaattactcagtctcgagtttgtctttattagcagcatgagaatgaactgataatacacacacacacatacacgtactcatagacatatatatgtatgtatacatatacagacagaaaatatattttatgattgtgttggtgtaaagaggaatataagtcaaactgaatttattattactggatttactttttcttaaatttttaagataaaaatattccctgaatccctaacatcttgtgggccctgggcacgatgccttttgtgctcaacaatacaagccctaactcctcactcagaaatttgtctactgaaaccagaactttagtgatgtttactttcagcattttggtagtagcaaaaactagacacaaagtgaaaaccttcagtgggcaataattgagtaaatttggttagtatgataccattttagaaaaaaaatgtaagccaacacaactgtgtgtatgtgagttgtctgtgttagttatctattgcaatctaacaagcctccctaaaaattaagtgcttaaaacaacaatcactttatttacccatgattcgaataggttatcagtctgagataggctcttctgaataattctttgctagtcttccatagggtaattcatgcagctgtagtcaaatgacagcttgcctggggctgggcagtctgtgatgtccatgtccttccacacaagtctgatggttagtctgttcctcagctgggccatatgctgccagcaagccagcccagctttcttcacataggtttgaaaagcaacttttaaaacctaaggttgcatcactgatatgatttgactgtgtccccacccaaatctcaccttaaattgtagctcccataattcccacgtgttgtagagggacccagtgggaaataattgaatcatgggagacaatttcccctatactattctcgtggtagtgaataagtctccaagatctgatggttttataaggggtttcccctttcacttgggtctcattctctcttgcctgccgccatgtaagatgtgactttcaccttccgccatgattgtgaagcctccccagccatgtggaacagtgagtcaattaaacctccttcttttataaattacccagtctcaggtatatctttattaacatcatgagaacagactaatcaaatcacatttgctaatgtctctttaatcaaaacaagccatatgatcagacccagaatcatggtgggagggccctgacaagagcacagatgagaggaggtatgattcattaaagaacactactgtaaaattctgtcaatgtgtgcaattgcatatttatgtacacattatcatgttggtatggtaaagatcagcaggaaaaaaagaaaatggaactattaataattttattcagatagagtgaagttacttactgtttaataacagtttatattacttatatattaattcattaaaagctgtttatcaagtgcctactctatgctagatgagtgctgagtatagaacaatcttctggaaaagtgaacatcaagggacatgcccacaactaagaccgtttacttagttattgtaacaccatcttttgaggattaaaaaaagtagatatgtacttgtgcatcataatttcttagcctaggacaaatgctttattacagttaaatactcaatatgatttgtgtgaccccttggagcttgggtgaagccagtgtacagggaaaggagaaaagccaatacaacagtgcattgtcaagttgactgtggtcagttgagtcaggttttcagtcccagggcagctccctgaggaaacctctgaaacacatcgcagatctttctgcccaggagtacacatggatgaaactgattctcatcccctttgttcgagtgactccaagggcattgactttaccagatttttggcatatgcatgcatgaggccacatcaatttctgagactaaccctgctctgcagtatcaatgaaaccctcagggcaagaagcaagaggaacagggcagatgctgtatctgtgattagctaatcaaaacctaggagacattggttaccacagcagtggctgcagtaagaggtggggccaaaaggatataaattagtatacaagaagtgtctgatacagcccaccccttgcagaactgagacttgctcatgtcttctctcaagtctaatctgtcataaagtcatcttcaatctctgcaaagtttcaatacaaaagattggcagaataagtgataatccctgtattacagctgaatccaaggcaataattgatattatttatcctttccttcaactcatcctaagccagtatttcagctggttgcttgactgatgcagtgacccagactttcatctcctggagatctaggtccttagttaccttgctcttcaccagccactaatgctgcggttgcttaatcaccattaacactgagcacagaagcagcaacaggtattacattcaatcccctgggctccagacattcttctccctgcctgctagggggcagcagcgctgtctcctcagctcattcagataagctacctttgccagaacagtagtaactcctttctttgcttgatggtccactggcatgaggagctttgtttttgtttttatttttgtttttttgttttgtctttatttcttctaaacacacacacacacacacacaacaacaacgggatacatgtgcagaacatgcaggtttgttacataggtctacgtgtgccatggtggtttgctgtacctattgacctatcctctaagttccctccctgcaccccacacaccccaacaggccctggtgtgtgttgttcccctctccgtgtccatgtgttctcaatattcaactctcacttatgagtgagaacatgcggtgttgggttttcttttcctgtgttagtttgctaaggatgatggcttccagcttcatctatgtccctgaaaaggacataatctcattcctttttatggctgtgtagtattccatggtgtatagtgccacattttctttatccagtctatcactgatgggcattttggttggttctatgtctttgctattgtaaatagtgctgcagtaaacatgtgtgcatgtgtctttataatagaatgatttataatactttgggtatgtacccagtaatgggactgctgagtcaaatggtgtttctggttctagatccttgaggaattgccacactgtcttccacaagggttgaactaattttcattcctaccaacagtgtgaaagtgttcctatttctccacagcctcaccagcatctattgttttctgactttttaataatcgccattctgactggtgtgagatggtgtctcattgtggtttagatttgcatttctctgacgatcagtgaatttgagctttttttcatatgtttgttgggagcctaaatgtcttcttttgaaaagtgtctgttcatattatttgcccactttttgatggggttgtttgattttttcttataaatatgtttaagttccttgtaaattctggatattagacctttgtcagatgggtagattccaaaaattttctcccattctgtaggttgcctgttcactctgatgatagttccttttgctgtgcagacgctcttcagtttaattagatcccatttgtcaactttggcttttgttgcaattgcttttgacatttttgtcatgaagtctctgcccatgcctatgtcctgaatggtattgcataggttttcttctagggtttttatgattttgggttttaaatttaagtctttagtccatcttgagataattctgtataaggtgtaaggaaggggtccagtttcagttttctgcatatggctagccaattttcccaggaccatttactgaataggagatcgtttccccattgcttgtttttgtcgcatttgtcaaagagcagatgcttgtagatgtatggtgttatttctgaggtctctgttctgttccattggtctatatgtctgtttcggtaccagtacatgctcttttggttactgtagccttgtagtatagtttgaagtcagatagcatgatgcctccacctttgttctttttacttaggattgtcttggctatttggggtcttctttgattccatatgaaattttaaacatttataattctgtgaagaatgtcaatggtagtttgatgggaatagtattgaatctataaattactttgggcagtatggccattttcatgataatgattcttcctctccgtgaggatgaaatgtttttccatttgttgatgtcctgtcttattttcttgagcaatggtttgtagttctccttgaagaggtccttcacgtcccttgtaagttgtattcctaggtttttattctctttgtagtaattgtgagtgggagttcattcatgatttggctctctgcttacctattgttggtgtaaaggaattcttgtgatttttgcacattgattttgtatcctgagattttgctgaagttgcttatcagttcaagatgttttggggctgagatgatggggttttctaaatataaaatcatgtcatctgcaaacagagacaactggacttctaacctgcggagctttaagtgaccaggtcacagccattctttgaagtaaaggggaacccatatacttgacagatatggtaagaccaatgcctcccatggcaaatcctgctgaggtctataaaaagtagtcaccacagcagttctggtataagggatgagtcaagggatttgaagcagtgggctcgatgtgtctgatatagtaatatgtaatctacatagaggagttaattatccacaccatgtcttcttttcttcccccatttcttatcacatacaccctggaatcagagctatttatttaaataacacacgcattatatttgaattatttggttgcacatgctgtataaagcaatacattatttttattagaatgtcaatgatcatataattgtttgataaaaatttttcttttatggaaattttctctgaggggggaatatcacaattttcatagaaggatttagaagttgcactatataatgagaaatgagtactgcagatccttagcaaatatgactttattcttccacttttaacaacataaatgccttggaaaaaatcactcaatttgatcatgattgaaattcccggtggaaaaatatatttgggatttgttaattatttttcagtggggttctcttttttgagagagctgagtgatatggtttgactgtgtccccacccaaatctcaccttaaattgtaataatccccatatgtcaagggcagggccaggtggaaatgattgaatcatggggtggtttccaccatgctgttcttgtggtagtgaataagtctcatgagatctgattgttttataaataggagttcccctgcacaatctctcttgcctgccaccatgtaagatatgcctttgctcttccttcatcttccaccatgattgtgaggcctccccagctatgtggaactgggagtccattaaactatttcctttataaattacccagtctcatatgtctttattagcagcatgagaatggactaaatacactgagcatgagtggaagaaagtctcaaactgaagtgaagaaaaagggaaggggctgatgtggggagaggagcagtccctcagcagcaatgtcaagttcatttgctttgcctctggccactgaggaaagacaatgccaggcaactgtagagctgggccagcaccttctgaaacgatcttgttccccaaataaccacaacagatattatatagcaggtaaactaacaagtaaaggcagaagtgaaaaaaattgttctgtgaaaatatatgtactatatgtacatatagatatagtatatacgtttgtgtgtgtacttaaaccacaatgctgtaagaaatcataaatttatctgaaaatactgggtaaggagatagtatccataaaaaatactattcccatagaatttaaatattcagtgagctttcactgactaacttgcatacaccaggcactgtgctatcaggtatggatgtagcaaaaattatgatatggttcttatgtgcattaaggtaaacattatccagaaatatgtaggctttcttgttttcttaaattagaagacaaacagtataggtttctcctgttagctcaggtatatcattatcaggttcaactattctagcaggtggtaataaattgtttttcttctcatgctgtctgctgtaaataggatcaataaagtcagaataaagatcacaaaaactttcattacagtgcgaatagtttaatgcagcagtttctatgtgcctagattttggcagatgctttaagattctggaatatttgaaaatattattacttctctggtccttgattgtgtaaggaatgctgaagttattgactccttaatctctactgaaggggcttactttgaagactagcaatttcattatttgattctgattctgagatgactttaacagaatctcaagcaatgtaagccacatttagcaatcatagcaatagtctgatatttttgaaacctgtcctattataaaacaagcctacatttatataatcctcatatctcaaaagaagttggagaaagccactgcctgggaagttccttatcctgaacctaaatcagatgctaatatcttgttgctgcattggttttaacagtagactctcaaggatgctaatatcttgttgctgtttcggtttgaaaaaagactctcaacttgtattcatcgatgggtgttctctatttcttaacaggattatctatatttgaatcttcttttaactctgactgaagagctctgaaatcaccaataatgtcttcattactacatcaatacttaaataatggacaagaaattataaaggcttagcaaagacattcagattattatggccttttgaaatatgcaccataaactattaacttagagtgcttggccaaagtaaaacttgaatatcccatcaaattcctcatttttatgagaaaatttatactcagaaaatttaagtggcaaataatccaagtcatatggactgtaagttacagaaccaagtcacaaaaaggagttctgattcttgatctaaaagtcttcccactgtgtccttctatggccttcagttttgggcggtgtattttgtttgttttttatttgagttatatgcgagtttaaacacaattctttctgctatgggaaacggcctgtttcattttcaaattttgaagctcacattttttaatggtttattttttcattaaatttaaaaggctttatttaacaattaaaaatcagtcctattgcctcattcattgaattccataaattacagtaaaacattttaaagctgtaaattagtatacaaacgtagctatctttttattatttgaatcatagaatgactttaaatgactaaagtttgcatttagaattaacactttttaatttaaaaatctgatttttcatttaactgtgatttgtttagctaaaaacaaatggagaatttgaatttctttactccattttactttcctcaacacacacacacacacacacacacacacacacacacagagatataaataagaaaaatctacacttccaagagtcatttccttagtgaatcacatccctcacttttctccacactgtccttcaacaatgagaataaaatacgccttcttcctccataatatcagtagaaacaattcagcacaatgtttaaacaagtgttaggaccctgtagccagaattcctgtgttcaaatcctggctctgcctttttctaggtgagcaatcctagacaagttaactattaaataattgctttgagcagatggcagtgacagagcccttgaagaatagctctctctccaggccagcagaagaaaaatgacagtgcaagacacaggataggacagtcaagaggcaaaaagaaatacaagctaagggcacagaaatgaagagaagaatgtttccatgaggagtcagccaacaatgacaatgtctactaaactcctagagaatgagaacgtagtgaaagcccagggtaggtatcagtgacattcttgaaggtgagacagcagtgataacattctgacttgaggggctaaggtgtaagtggtgaagaagcaggagttcccctagattggacagggaaacgggactagcatgtagcacgtgtctacctgcccttgaatctaagatcgcagagaccagtgcagatgaatagagaagatgcagccaatggaaaaaagagaggaggtaaatggagaaaaccattaaatgatctcaggacaagcatggaatcacatggttctggggaggaagtgtaaggaaagtccttctcttgtcttccttgcaacctcctattcatcctataagacttagcataaaaccacttcacaaataaagtatttccaaactgtcctaaatcaacttatccagtttatttttctaaagtctctgagtactttgttttataatcttttataacatctaacaaattatatatattatttagttaacatgcctgccccatgtattacatagcaaattccccagagctaggatttatgacttttttacttttttcttcctagggcaaggtatagtgttagatactactaccacattagtaggtgttcctaaaataattagcaataagaaaggggctgaggtggtggtttgcgcctgtaatcccagcactttgggagggccaaggtcaggtgtaagagaccagtctggccaacatggtgaaaccctgtctctactaaaagcacaaaaattagccaggcatgctggcgcgtgcctgtaatcccagctaccaaggcaggagaatcgcttgaacccgggaggtggaggtttcagtgagccgagatcgcgtcattgcactccagcctaggcgacgagcaaaactctatctcaaaagaaaagaaaaaaaaggaaatgagagagagaaggttagagatgggaatggagactcaggagatgcagcaacataagcaacctctataggatctgagcaagatgaactggatgctaagcttcttcgtccagacccattaaattgaggaagcgtgtttgtagcatgcctgttggattttgtaggctttctctccttcttagagttttctataacctaatagtaaccctgaataaaatacaagtagagttgtttaggtttagtcatgtaatacaggaaaatttgatatattgtggagtgcaggtcaaagaataccaagaatggatattgaagtctccaggaaatatggcaatcacagtgatacaggggcaaagagtcctggttttgtgactggcattgcaatagtatggattatttttttttttctttgaaacagtgccttgaagccaatttatagagggatttgggaaggatcaaacaaaagaaaaaatgggctgggtatggggaagggagagagtagaaatgaaataataaatgtagatatactctggctttcagaaactttttgaaggacttatcaagtaaaagaactacaagctattgtaatttcaacaagaaattgaaactttgtcttttttaaaaaaatcctaatttcctccctccccttgaggcttggacaggtaaataaacccattagggggctataatgaataacatctcatacagaaattatatgcagggaaagatcatgacacaatattagcatacagaatatctgtttttaaatccacattctctctaccatcttcatttgctgtgtgctgataatgagacaatggttcctaagggaaataatgtagtttactcagggtattcattcaagctctaaaaaaaaaaaatccaaacagacagagaacatatgaggttaatattcaagtgttaatgaggacttaggtattgtgaagcttatattgtactaattaaaaataattgcatggtcctagaattagagagctttcactgaggagggtctcaaggtcattgccgcctctctggatttccaacttggctgtgcacaaacctcagtggttaccttaacaggaataattaggttctgggcaaacacattcctgcaaccaaattcactagagtctgttgagataaaaaagtcagtttcatggtttctaatgagaattacctctttccaatatagaaacttatttttgaaagcaagattaggatcagaaggtggtttcatggttaaaaagggagcagaataaggagggccccagagaccatcctacactgaacaataccaacccagataagccccatataaactatatcgccgctatgcctacgttttacatgaaaaggcttctttatccattcaagggtagaaattcccagaaaaccaatccctcattttagcatcttataacctggtccctacagcaagtatgtacaagtatatagtaagcatgtgatcgcctccagtataaaagagcagaaaggtgagggcattcataagcgattgatggatacgcaaaatgttatattacagcatttcttatcaaaattagatttaaaattatttcatgctttttcccagtttcatatcaaatcattaaaagtgaatatttttccctcttctgtacagtcaggaagactgcttatgatgttccaaagataacctttatgtatgtgctcagctttgacttatgagtaagtttctcacatgggttaatacccggccacttctagtgatcctcatgcttttcaaggtcacaacaggaaggatgtatatttcaagtttaattgtttctctcaaagcacgaggagtagacaggtgtggagagagtcttcctcagctcatcagcgtcatggaactctagctcttctcctagggaatagggcctccttcatgtttctccccctaccctatccattctttaatcgatgctttatttcccagcaattcatgcctgttacttgtctttactcttaaaccttttgcttttctctttctgccagcattttggcaatcctgtataggcctgcggccacgtctgcatgtaagcagagagcagaatttctgctttaacagaatttctctgtcacatcgtctgcttgggccatggtgtttcgtattctactggtagacataaccttcaaggctatgtggacctttaaagtcagtatgaaaatttgacttcattcttccgtctttctttattattctgcttaatataccttgtgttcatccacaacactggaagcacattagttgcttaataaaagttattctttaaatagagtcatcatttttatatagttgtgatattatttccatacattatttatataaaatcatattattttatatagtttttatatatctgtgataaaaataatgctccccaccagaggttcatgtcctaattcatggaaccagtgaatatgtaactttatatggcaaagggactttgtgcttgttaagagccttgatttgaggagattatcctggattatctgggtggctttgtgtaatgacagagctccttaaaatagtcagagaaagagactatgaaagcagagagttgcagtgatgcagcaggagggaaattccacctaattcctagctttgaagatgggggactgagatgatgagcccaggaatgtgtgtggcctctataatctggaaaaggcaagtatatagatttcccccctagaatttgcaggagaaacacagtgctaccaacactttgaatttagcccagtgaaccccatttcaaacttctaaccagaactgtatcattattattaacagaatcatcatctccagaactgtaagataaattggtgttgttttaagtcactaagtgtctgtcatttgttagagcagcaagaggaaactcatacaatagtacttcatcattttccatgataggtaatacacagacaacattcattcattgtttaatgaaaatgaataagacatttagtggctgggcacagtggctcacacctgtaatcccagcactttgggaggctgaggcaggcgggggtcgggaggctgaggcaggcgggggtcaggattttgagaccagcttggccaacatggtgaaaccccatctctactgaaaatacaaaaattagccagacatgttggcaggcacctgtaatcccagctgcttgggaagctaacgcaagaggatcgcttgaacccgggaggcaaagattgcagtgagccgagattgcaccactgcactccagcctgggcaacagagccagactccatctcaaaagaaaaaaaaaagacatttaggacttgtcactgtctaaatttttgcatgctatgaaattcaatctgatatgttcagtagtaatatttctgaatagctgatattatgaatatatagcatgagaacttttacttgggacttggagttgcaacagagaaaaattactttacaaataaatcaatagacttgatgagtctatttattttgccatcaacccaattacctttctgttcttcagcagtctactggcaaaactcaattatcgacaatggttcagacccttctgtttcttcagtggctgctgccttagctcctgtgttctgtcatctcctagggcttaatgtgcaaaaattgtgcaacccagctaggactccactgggtgcagagctaactggctgaggcatgcagggtaaatactgtcattagctcattctctgcataaaaaaatgaaatatactcaataacttctagtttttgaagtatctgattttatttaatcttcacaacaacttggtgaagaaggtattactattaggttgctacaaaagtatttgcagtttttgccatgacttttcatagcaaagccgcaattacttttgcaccaacttaatacctcaattttacagttgaaaaaaccacgttagggagagtatccaggcggtaaatgacagaaaggagatatgatctaaaatttcttaattctttattcagatgataaaactaatgtgactttgctctatcacagctattcttgtcattttactgcagtgtcaaaattctagatacatatttttaaatgtattttaaagacaaaataacataacatatgcacattataaagtgatgtaggaaatttaaaaatctgtgaacagttttaaatcacccacaatattactgctgaaaaataacacctcttactatttttatgtatttataaacatttttctgtgtatttatatatttcttttgacattatggttttgcatcccattccattttatcatatttccagtgaagtgaggtggcattctaaccttatcatatgtacaattttactgtattgtctttcagtaacctacttttgctggatatttaaatataaataaaaattagtctaccttgaatttaccttttttcaggatgaaatctatgcttctccaaatgcagtctgaggacagtagtgccagcgtcatttgggagcttgtcataactgcaaattctctactgagtccaagtctttggggtgaaatccaggaatttctgttttaataagctctccaggtgtttcacacatgcagaattttggactgaagtgtttggttttctgtaagcgttgatgaggcaaagcagcttaggcctattgtaggtgaaaggcaagcacaataattgttatactttgaagaaaaagaaaacttttttccttcgttcgttctttccttccttccttccttccttccttccttccttccttccttcctttcttccttcctttctttgagatggagtcttactctgtcacccaggctggagtgcggtggcacaatcttatctcactgcatccttcgcctcctgggttcaagcgattctcctgccttagcctcctgaatagctgggacaacaggcatgtgccaccatgcccagctaatttttgtatttttagaaaagaccaggtttcaccatgttggccaggatgctcttaatctcttgaccttcagcccacgttggcctcccaaagtgctgggattacaggcgtgagccaccatgcccggcctaatattttttaaaaatgtctgtagagatggggtctcacaatgttgcccaggctggtctccaactcctggctccaagcattcctcccacctaagtctcccaaagtgttgggattacaggcatgagccaccgtgcccggcctaattgttaactctgactgagaacttttgtagattgagaaagtggctggtagtatattgtagataaaggccacaccagaaagggtgagtgtgaggtaagcgagctcctgtggggaatttgcctgaccagagcacaacattcacattggcaagcagctgaagccaagaaagacctgttaggataacccaagttcttgtacacatagatgaagatctgtgatataatttatagatattgaggaaacattacacattatttaacataaaagtgatgtttcataactagaagaacattggttaaaaagcacactttagtgagaagtgaggagatatttgggtagaacaaccaatgaataaggtgagtgttgtaaacaagataccaaatgaaagacaatgataaggagttttggcagaagaaaaagacaatgatttattactaaatattataatggaaaagaaggggaatggtttcaatggcagattggacaaagggactaagaggaaaactagaatttgaacctgacatcctggtttctcttgagctatacataccaattttaataatctggagagaggtgtaaaaaattaacaaaacagttttattttcaaagattgtgagtttagtttactcttaactcctctgtattcctaatcacctacatccagttggattctatgtcttgccgatcttaaaaaaaaaaaaaaaacatttgaggccaggtgcagtggctcacgcctataatcccagcactttgagaggccgaggcgcagatcacctgaggtcgggaattcgagaccagcctgaccaacatggagaaaccccgtctccactaaaaatactaaattagccgggcatggtggcggatgcctgtaatcccagctacttgggaggctgaggcaggagaatcgcttgaatctgggaggcagaagttgtggtgagccgagatcgcgccattgcattccagcctgggcaacaagaacgaaactccgtctcaaaaaaaaaaaaaaaaaaaaaaattgaatcagtcctatttactctattctttgtcatattgctttagtttaagtactggtaatctttcaactggcagcctatagttgaaacagcctaaatactctttttaccttttgaattacttccctaaaacctattgcattgctgcacagagttttcattctgtataagttgatataaaacctatattgacttatggcatcttcctgctaaaagtttaaaaatacttttcctctgctttttattgtactgttttacttggtatgacattctgaattagagcagccgtgtagtttatcatctgaatgagacccttgggacattgaaagtgggcatattaataattacactgggacaaaagttgtctgggctttgccgagctttctagccccatcctcttctaagagcagtttacaaatgagcaataccaaaataattagtgaacaaacacggtttcgaaggtcttctatccgtgttgttcacagctgtatctgcaatgcctaacgcactgctcagtgcagcatagttcctcaataactatgtgcaaagggaggaaatgagggagggaggcatggaagaagaaatgggtagatcaaagaattttagaaagcttgaatctagtatgctgttgtttaaatgacatagagttgaaggtctaacatccttggaaagaggaaggcatagaaagccaaaggaggcacagagaacttggtagaggaaggttaaaaaagggaggtcccagaatcagaccacccatgaaactgactttctgattccaaccaggctctagtgaatttgactggagaaacaagtttttccagaacctaattattcctgttagagtaactactgaggtttgtgcatagccaggctggaaatccagagaggtggcaatgaccttgagaccctcctcagtgaaagctctctaattctaggaccatgcaattatttttaattagtacaatataagcttaacaatgttttgtaatttattttgtactattttatagtttaacacacaacaacccctaaggagtgtaattcaagtgcaacttacccaaagacttcactgcttttgtatcaggttgacatatttttaccgaaaacatatcttagttttgtgaagaaaactttcacattcttcattaattcctgggcagagctgtttaaaagaaagttttgtcagtagcattttagatgttctaactacaaaggagatatgtaaatgtccgttttgtacttctgaaaacaggtgcagtctcagtgagaaaaagaaaatttgtcatgagcactggaataaaaagggaaataatgaataagaacataatttaattacatgaatgtcagccgtctacacaaactagatttgatgtaattaaagcacctggaacaaataaaatgaatcaaggaaatctctttcctttttttgagaaaggaagattcaaaattacatactatttatggacaacttgtacaaactatgcaaaaaataagtgtgcatgtgagtgtatgtgtgtgtgtgcacaagagagaggcagagagagtgaagggtaatttttcctggcctcttagttcataaccaacaaagcagccaatataagttttttatagtaaggggataatatctataaataagtagaaattaaatattgttttcaatgatcatgagccccagtaaaataaaaattacatttatttaaggattgattattttagtcttttccccaacataaagtcataccaggagcttgctgtctttggtaggtcaggaatgcttatagagaaagaaacaaatcatgaatttaaatttagagacaaagaacgctctttccaggaagaactactcctaactagtggtttgctagcattgcaatatgccactgggacatttatctggggagccatttgttctgtgctgtgcttatgtaggatattttgtttgttctagctatctacgagccttcctgtgaagcctacaaacacctaggacagacatcaaattattactggatagatcctgatggcagcggacctctggggcctctgaaagtttactgcaacatgacaggtaactgtgtcatatttatgttttatgaagatgcttttctatatgtcacgaataagtagttccaccaatggtttgtttctttggtgctatgtttttatcacaacatctaatcagcaacatattgctggatttgttagataagatgatgaaatgtattattagagcaataaaacattttgacactgtgcttttcaaaaagttcatgtttgatgtgaacaattaagcatcatttttttaaaatcagcatgtagggggaaaaaaacagaaagtaaagttgcaaagttcagcccaaagaaagaactagtaacctagattagggaaatttagcatcactgctccaatattctcactgtgcatgctagaggaagcttttagatcgtgacagaccttcctcgattctccataatgatagaagaaatctttctaagtcctgaaatcccattctgataatagcaaaaattacctgaagcttttatgaaatatatttgggcttttcttcttgggaagaggacctagtttttctccacttccatgtgaaatgagattatgggttcttgtcaacttccacaacaatgtgtaaaatgtgcagatctctaagataagaacagattttccatcagacacttggcaatatcttacgcttcaaaaatccagaggaaggtgtgaggtatgcattatttactggctccagcaaaagaccagcatttgatgtgaactcctgggcataatatgataagggtaatgataataagatgctactgatggtagttactgagtgtgactgtttaccatctgtcaagtatcatgacaaatcctttggacagacacttgagtttacatcctggcttcattaatcaccacatgtgtaatattgggcactttagtaactttgctaaattcagtaaacctcagaatctttatctgtaaatgaattaatgagaatacccacctcatagcattattgtatgaatacaataaggtaatctgcatatggttcttagcttattgtctaacacacggtaaaccttcaataaaagttattggatgaaaaaatttaaaggctttagtagttaaataacttgcccatattagaccaggtgtggtggttcacgcctgtaatcccagcatcttgggagactgaggtaggtggatcatgaggtcaagaggtcgagaccattctggccaacatgaggaaaccctgtctctactaaaaatccaaaaattagctgggcttcgtggcacacacatgtagtcccagctactcaggaggctaaggcaggagaatcacttgatccctggaggaggaggttgtagtgagccgagatcaagccactgcactccagcttggtgacagagcaagactccatctcaataaataaataaataaataaataaataaaacttgcccatattattcaggcaaattcaaactgaattatatgcagcccatggatcttctggctatagttcagaaccacttatagagttttattttgtctttggttttgttttctatacaaacttcttggctccacccctgcagactctgattcattatgtgtgaagtggaaatcagattgtaaaactagaactgaaaaccatgaatggtactctaggcaagcagacaccagcgaggaactctcagcagtatcaggaagccaggcatggtacagaatgaaagggaaaatgatgagggcatcagtgtagtatggaagacatgtggagaagataataaaatggaagctgaccagcctgggcaacatagtgagaccacatctctatttagaaaatgtcccagctacttgggtggctcatgtggaaggattccttgagccccggaggttcgaggctgcagtgagttgtgatcacactactgcactccagtctaaaagagtgagacctgtctcaatttttttttcaaaatagaaataaaaaaataaaatgggaactagcgtccccctaaatttctaaatttcccctagaaatatgcaagatgctagctcccagtttaatttttttttctattttgaaaaagaactttaggcatgtctcagagaaggaacacacttaccagagagattaatctaagagttcactgacagctggacttgtcaatgcacttgaattcttttttatataccttcatttttatctttttagcactaaaatattaacctatgataacttgacttaatttataagaatctcgattctggtttctcctaatatatgaaaatatataatacaattaaagtctattcttaacctcaagggaaatcagggcatcgtggcttggactggacaattaagaatttattttagttattttcttaaattcatctcaaaggaaattagaaaagaaaacaaaactataatatacataattctcatatcaaggacacacacaacacacaggactagtctactctcaggagagcttctcctgtgcattgaaccctttgctcagaaacatatgtcttatcttcatcaatatctcccttaaacagcatggctgcaatttaactcagcacttcaaatgacttctgagctctaaggagcagaatacaactttttgcaagtagaattttttttctattcattcaagatagttacaaacatcagtgtgttcaaggacccttgaagaatcttgccttacaggccagcaggcacctttcagttctttgccactaaccaacccttccttttcctggaaagaatgtggatttaacatcataaagagagcatgatgccacaaagcttggcttgggctattccattttcaagagatacatgttaaagaagaggagggagtaacagcatgaagtagtctataaagtcttgatatgtaactctatgtcatgaaaaattataaatgctcccctaaatccgaagtataaaaggaggcaagcactcaaaaaggtgaagaagagaaatgagccatataaatcaatcccccagggcacaagagagattggcttattccaaagaactgaaatcccagtggctggaacatagtgagcgtaagagagtgactcaaaataaagcaggggaaaggtgggtgggggcaggccagagcagaccagccataaggagtgtagggcagaaaaaagtgcgcttttttttattattatttttcaattgcagtgggtggtcgtctatggaaagattttaagcaggaaaataagatcttgattgcattcatacatctaccacttgggcttctataagagacagcatgaaaacattgggaccagctctgaagctattattgcaaaagtccaatgaagagatgatgctcccttgaactagggtagggatggtttaaagtgatgagaaattgatacatttttagatctgttttgaaggtagaattgacaggattggtaaaagtttggatgagaatgtttaaagagagacagttatcaatactaacttctcaacatatggactgagtagctggatgaactttagtgccatttaggagaagtggacaattaagggtaaaacagttttaaaggaagctcaagaacttacttttgacctaattaaatgtgaagtgccatgtgccatctaaactgagatgcaaattttacagttgggtgagccccaaaagcctgattgggttagagatataaatgtgccaattattagcatattaatatatgagaattgataatatcatttgggggttgatgtaacagagaaacagcatctcaggaatgagctcttagaaactcaataggcgggacacgatgactcacgcctgtaatcccagcactttgggaggccaagacaggtggatcgcttgagcccaggagttcaagaccagccttggcaacatggtgagaccctatctctaccaaaaaaaaaaaaaaagcaaaaacaaaaactagctgggcatggtggtgcaaacctgtggtcccagctacttaggaggctgaggtgggaggatcacttgagcctgggatgtcaaggctgcaatgagccatgatcacactactgaattccagcctgagtgccagaaaccctgccaagaagaagaaggaggaggagtaagaggaggaggaggggtagagggagggggaggggaaaggaagggggagggggaaggggagaaggggggtggggggatgaggaattagtccgttctcacgctgctataaagaacttccctgagttcgttctcacactgctatgaagaacttccctgagattgagtaatttataaaggaaagaggtttaattgactcacagttgctcatggctggggaagcctctggaaatttacaatcatggcagaaggggaagcagatgccttcttcacaaggcggcaggagagagcatgtgaaggcagaattgtcaaacacttataaaaccattagatctcatgagaactcactattatgagaagtacatggaggaaactgtccccataatccaatcacctctcaccaggtccttccctcaacacttgggaattgtggggattacaattcaagatgagattcggacagggattcagagccaaactatattactcaataattcaatagagagagattagggttctcgtgttaaaatatttaataagtgtttggaaaaatatacataattgagggtaagtagagaaaaagtgtctgagagcatttggggggcaaacagatcatctgtgtggaggttaaaatgactgcttggatcctagagaatgacagaaagacttggagaatgaagagcaacttggcatccatgcacacatatacagtggatgtggtggtgccacagacgtatggcaaataatagccactagaatgcggggaacatggtatggccaggaataatgaaccttctaaggatgctgcatagacagcataggggagccatggattgagctacatcctaggcaattagggggtgttctaaatgacagagcatttcaagcactgcataggacaccagcaaaatcttccccaaaacggctgactcatgagctgagtgttgaagaacaagtgggtgttatgcggctgagaaatcaggagaaggaaaaataggtcaacttacaaaatgctttgtgtaggatgcaaagcagttgaaagtttgtcctgaggtgaaagcaagcaatggatggtttcaagcaaaagagtaatttaatcaggcattgtatattaaaaacatcactttgacagctgtgaataatattctccaaaggacacccagagataagacagggaaacaagttcgaaagcccccgtagtaatgcagaggttgaaaatggagacttaaagtagtggcaataaagtaaaagaggaggagattgatttgatgggtatttaagaagaggagttggccagaccgttcctgatgagacagagaaagttgaaaatggtaaccacatgacatggagcacagaggagcagaggaaaactaggaaaagggtaagattctatgttgctttgggtccctgtaattcaaccaggtaaagttgtcctacaggcagatgctacgcaaagtcactgtaggaccttgaacacattaaaaaaaaaatctttggccgggcacggcggctcatgcctgtaatcccagcactttgggaggccaaggtgggtggatcacctgaggtcaggagttggagaccagcctgaccaacatggcgaaaccccgtctctactaaaaatacaaaaattaactgggtgtggtggcgcacacctgtagtcccagctacacaggaggctgagacaggagagtcacttgaacccggggggcagaggttccagtgagccgagattgtgccactgcactgcagcctgggcaacacagcgagactccgtctcaaaaaataaataaatataaaataaaaaaatctttgtctcgggtttcttgtaaataaagttcagtaattggaataagttgatatcttcactgcctttccttcaaaaaaaaaaaggaaaatatttccattgttaccatgagacatgaaaaaaatcactgcttgcagtcaaataatttagacagaggcttcttatctcaaacaagcttgaatttactatttcttgctaagtttgacataaattgactcttcattttttatcgtaaggcagtagttctactatgtaattcttctgactgtctgcagctcagagctacatctcttggaaatttagaaattagggggtgtcctaaattatagagcatttcaagtgctgcacagttgatgacattgaggagagaagatttttcacagaatcctttgtagaaaaatttatcatcctgtgaaagccaaagcctggtttctttttttagatcttagggtacatgataaaatgtgatcattgttagcctcgccttccttctccatttttatgctccctctgaaaatttggtgttaaaacttttgtgaatataaactatcttatattttcagtatcaacctcttttaattgtatatttctaacatttcagcttttcatttccattttcttcaggtgttaccagcatcctctccctagataccctgaacctttgtatttaaaaggttctttctgctttcacttagttctttctgctagatgattaatagtaacaatagtaaataatgctcgatccagccattattcttgaaactttactgtctatccttaaacctaagacaatatttttcttcatcttctatcctctaactcattttctccataactccctttgcattcatttttttcttaatttaagcaagcatctgtgctctagtgcgtgaagtttaaagtccaaataaagtactcctcttgcattcttcctagccctggttttgtagttttatcaaaaagccattaagcttgtttacataatttgtgctttataaagccccaggatttagctgatcaaattctattatcctctctaatagtgaaagctgttcgtgtctttttaatctaatatttatagagagcttgtaacggaagtttctaagcgcttgcactcagtattagtatcgtatttagtattatgtttctcacaagttttacaagtacagtgtgggcaggaggaaatgggtcactgaggtggtggacttgggctccagtggagagtatcataaacccacccacctccacctccccctccccgtgtccacaaagcaaaacagtttctatcctatagtacagtcatgcaccacatagtatttcagtcaacaacagactacatctagaatggtggtcctataagattataatggtgtatgtttactgcaccttttctatgtgtagataggttatatacacagacaccattctgttacaattgtccacagtattcagtacagtaatatgctgtacaggtttgtagcctaggagcaataggctttaccgtacagcccaggtgtgtaatgggttatgccactgagatttgtgtaagtacactctatgaggtttacacaatgaccaaatcacctaatgacacatttctcagaacctatgcctgttattaagtgacacatgactgtactattttccttagcagtttacagtaatacaaatttagtatccacagtttctgtgtgtcaaggcacaggtgacctgggtcaactgctcagagtcttgccaggctgagaccaaggtgtcacccagggcttgggttttaccagagacttgggatcttcttggaagtttattcaagtgttgatagattcatttccttatggtttaaagactgacgtctcctattcttattgtctattggccccagattgctctcagctcccagaagctgctcccagctccctgccttgtggctctgcctgtccaggaggagctctctgactcgctttccagcgctgacctgacttggtcgtcactcaggataattacccatttgattaactcaaacccaccagtttacagcccttaattacacctgcaaaatctcttcatcttttccatgtaaagaagcccggtcccattagtgacaccccatcatatttgatggccccacccccagtctaggagagggtattatgcctggtgtacccaccaggtggctagaatcttgaagaccattttagaattctgtttagcatgcttacctatgtgcctctgtaaattattcataattccagcaacctttatttctaccttttgagtaacaacagtgccatatttagattataaaatcttaggctttactgttaatgctcttataattgtaacatattgttctgtaaaaactttgacaataaagataagcaaaaataaaaattgcttgtcaaccagaaatgacaattactaacacattagtcactgtgcaataaagattgtatattttatacaggtacctgcatacataattgagggcaaactaaatgccaggcacatttttaaaatatcacatgcattaactcatccaataactcatgacgacctcacaaggtgggtaatactattgttctcccattttttgatgatgaaactagagctcagagaacttaagtactgggccacacatgtagtaaataataaagcttgacttttcagccaggcttgtgtgttcagagctggtttgtagttaccgtgtgtatgtgtatgtgcacacacaagttcacacatatataggaacagcactcctcattttagattctgtagtacgatttgcaatatgattgctgaaatgagcattttttattcaaatctcttcattatcattgaaactttcttacacagctctgattcattatctgtggtttggacagcatttttgttataaacaatttacttcttaattatctaactaatgccttggggtttttaatcagaggacacattttaaatgaaatcgatatataaaccattataggcaattagtatgatttttagttcttttttttattattattatactttaagttttagggtacatgtgcacaatgtgcaggttagttacatatgtatacatgtgccatgttggtgtgctgcacccattaactcctcatttagcattaggtatatctcctaatgctatccctcccccctccccccaccccacaacagtccccagaagtgtgatgttccccttcctgtgtccatgtgttctcattgttcaattcccatctgatgagttcatttttaattcttaattcaactacaagtattttctctaatataattttctaagagctttacataatttgtatatttcctgtctacctaggtttatcatcccttaaggtttgagcccagctttcagaataacttaaactctatccccaacatctagttaatttttcaatgtaaagtcttaaactgaatctaacaaaatcttgtttgaatatgcaacaggattgaatggaattgtactggatatcatcggtaacaatgatcgtagtgtctcattcttccccttttagagaggaaatcatgtagaaatgaggacacacagagctctcctattctatattagggcttattaacattcataagttgggcgctactaagcttctaaccccttcattttcctttatatcataactatttctctgatgtgtatactggcttcctccattatattccctctactcatttttatttctttctcatcaaagccattttctctcctctttctgtctcctaacctagtttacctcctctatggttaacccactcagagaatagctgtcctttatgtcttctttcagacacatcttctcctctttgtcgacctctcacaggctgtctttgttataaacctttgtaatcactcagcaagtcctgcttcacgcattcagctatttcagttcttcacaatcagtataaatctttgaattcaattctgctcatacagcttcaattgaaaatctcggaaccaactcactgatcaaacacagcctgtaaagaactcttctccgtaacggattacccactcccaaagactcccttctggattcagcctcattccagagcttctgcctgccaggctttctttgcaatctcatcttcattgtgtgtcagccatagtgataggttaatactatagaagttctcaaatggttttcaaacttcaaattaaaaaaaaaaaagagaggaaaaccatgagatccagtgaggcctacaccacaggagaggacccagaaagggggtacaagaccccaggtgaaatcaagatgaagtggctttaggtatatcacaggtcactcagcccttctgaggtttccaaaatcgtactctctatgcaaatgctcttccttcaaatgttttcatgtaacctgacaaaacaatatcttatagacactgcttgattttgtgcttttaaaagcactgcctttcttatgcaatttctctgctcaaaatccgagaaagacttcacagtgtggatggctagggactgttgtttgattacctctggcacttggaatctgaaactcttgcctagtctacagtaatcaactattcaaacaggatgggaaacacacacacacacacacacacacacacacacatgttgggaaattcaattaagatcaactcatttctttgcaatcaaaaatcaaaaaccacaggaataatctcatacttttttttaactaggaatttctctcttccggctaaacttaaagccaataataactgtttctgtttctccaaactttaggtttttccaatttgtggatcaccttttatttcttctgaggatgtcaagtttcatatcagaatgtccctggaaattttagaaagaaaatctcatatagcagctaatctctctttttatcttgtgtctttgtccaatcaccacaaccaagaaagttaaatagtaaattgcaccaatattatatgttgcccaaactggaaaatatttaaagttttatttcctggacctgacttaaactagaggccctaaaacttttcagtgccccacataaatgattgctgcataaaagtacttgtctcattaatgaagaatgaaaatacaactttgggaaaaaatatccctgtggatgaagttgtcaaaaaatctgtttgctgcatttacgtacagacaatttcattagcattgaactcttcacataattattaatctcatgttcggtttttactcagatttctgaacaaaatcagcattaaaaagtgagattaggcaaaaacttgctgtatcattcacttcatcatcattactgttgttattcatgttttgcttttatgtgcatccatgttattctatcttcactggacccctatttgtccttctgtttctaagctcacttggtgtagctctaggtttcagggctaggacaaggcagcataattttgagagatgaaatgaatgcctttgctgctccaggcagcagggcatggaggacagagcgggaagtttgttagtacattgtagaatctgatatctttttgctctcaggttttaaaagactataaaataatattgagcatcttgctgacatttcactttgttctaacatgaagtgtttgctctctatatctggggtataccatcatcatggacttcatcttcaccatgtctgtgtttatttatccaagaatgtcttcatcccccctatattggaatgcatgatttttatataatgtcttcttcattttaattttaccctctaatgtggatatagcacatcccctggtagcttcttgatcctttagtacaacctacttcttctctgaaagttagaagaatcttgtttttgttccagatgttctgaaatttcaaaacaacgtgacttggaataggtcagttttcatgtatttgctgggtgttcactttaacattggcaactcatgttcttacatttctttttatttatctgtttgtgattctgtctcttatgatttatctattgtctctttctagaatgcttttcattgtggttttaaatcagagttcttttttcttcttgaaaatttccttttctaatggcgttctattactgctttatgaatgcaataccttttttgtatcccaaggataataaaacatctttttttcccttctttcttagttttctccaagttacttgattctgttcatttttttctgaccttcacagctttcctcatattcgtgattattattagctgtgtgtttattattacgagtgggagggtcttgttgacttggagctttactgtgggttagagtaacaattatgtcctggcttgctcagtacagtcccattttactcccattgccctgatgtccttgtgaatagctcttccttttattctcagtagtgtccttgtttggatgataaattatttgatcacctcactgcagaggaagctgagtgttcccgttttaggactctctcatctgttgtcagcattatttttttcattttctctttattagtcaggttctctaaggatacgttttaaaattctttcctggaggtttctgatctggttgccaacaatcttggaaccatttggggaaagaggtctaacagcatgaacattcagtatttggtacaagtgtaggcaatctccattttctgtgtagtttccacattctttgtaatacttggttcttctcaatgcagggattcttttagaaaataaacctccagttatctcccagagtgagagaggagtagtcaatcagccacaaggcttaggagacctagggatctactatctgtcaaacagccttaatgcagttctccttactttattaattactgaatcttttatggattcatggtcgaaagttgggttggttctcatctttccagactttcaagttaagattcagcattctactaagtcagtgagcacatattcatttactttccatcctccaaaattgtattgctagtattgattcatattctcccggtctttgtgggaaatgtgtgtgtgtgtgtgtgtgtgtgtgtgtgtgtgtgtgtgtgtgtattccctagctttaggagtatgcatatgtgtatgtgtgtgtgtgtgtgtgtattccctagctttaggagtatgcatatgtgtgtgtttgtgtgtgtgtgtgtgtattccctagctttaggagtacgcatatgtgtgtgtgtattccctagctttaggggtatatatatgtgtgtgtgtgtgtgtgtgagagactgtgtgtgtattccctagctttaggggtgtgtgtgtgtgtgtgtgtgtgtgtgtgtgtgtattccctagctttaggggtatatgtgtgtgtgtgagtgtgtgtattccctagctttaggggtgtatatatgtgtgtgtgtattccctagctttaggggtatacaactgtgtgtgtgtgtgtgtgtgtgtgtatgtgtgtgtgaattccctagctttaggggatttagaaggcatataagttaattgtcagtgtgccagtgtttactcaccatcctaaccaaggtgcagcttctttatttttaattctgtaatttaatgtcataaaaccaaatagttcaaatacatgtttcaaaacacgtattttaaaatgtatgaaaatctccaaattttaatgtaaattaataaattttcctttttggttaaggagtgtcataattcttaaagtgtttattattgattatctgctgtatgagaggtaatatgataaattctttcatctattgtgtttcatttattcttcacaataaccctgagaagtattagggtcccaattttgagatatggaaactgaaacacaaacagatattaacattctctgtaacacaatttacaaaaggctgtttacacaaagaatatagatttggatgacatcctgtatcatttagtggcataagtgtgtcactttcactttttaataggttgaaacattcgaagaaaccctcagttcttataataatataaattactattattattatttgaaaatttttttcttctctctatgatttctggttaactggattctagactgatcaagggccatgtctgtcttgtttactactgaacccagcagagtgtctggtatatgtcagcactactactgctgtgaatagacctcaccactgtgtctttttcagtagagctaagtagccaccaccaatctcagtgctaaataagaaaacaagtttgagataggtaagagtgtgcatcacttataattagaagacatgcgtttattagcaatatgctaaaaaaatcattcccacaatctgtcctataaacttgaaaaagtccaagtgctctatccttttaggtgctccaacttgtccttgtatggctgtttttacagtaaatatgaaaatattctagaagcaggattgagtttgccttatactgggatcaggtaactagagtcctctaatttaatgactgaaaaagatctatttaagaatcaggcctcagtcagcattatgaaaagtaaaaggtaaagagttcactagattctttcatcattttgatgcaagagtgaagagttactaaaatgttttagctaagcaacataggtgaacatcagtaatttcttccaccagtgaaaagtcaacttccataatgcaactaacaattaaatttatgtaacaaaatagcaggttttgagctatgataaatgcaacttatacgtttggggtagtatctacctctaaaatctgttcttttaatgaaatgctagccaacccccctatgaagtgtgggttttgttctcgcttagggtgactgaccagccttacaccaacccttggatatagagccatattgtctaatacacatgcaattatatctaaccatccttgggatgtattttaaaagtaaattacaaaccacatagcctatgagttgactatccaggtagttttaccaactgtttataaaagaaactatgtcaacataaagcagtcagtttggaaaacacgtgcaagagatggttactttcacgtgaccagcatgttgcttagttgtaacatgctataaagggttgtgttttactaacagtgtcactgatgatcctcggttcattcatcatacttctgcgtcactgctgctacttactaactacaatcccaggccagcttaagcattagttttctttacattttgctttgctcattgcttctttaatatatccttattaccatagtcttccctctgtgttctccagtagatagaagaagaggatttgacatgacgctaagcacattaatataatagtttcttctcccagtggtatttgcatttcaaagagaataacaacaagatgaaccaaaatatggaagcaatattttcagacaggataccttccattgctctctaaatcactcctatctgtagcccccattctacttgtgtatacaaaggcttgtagcccatgtaacgtttaaagtctctcccatgtagagtttcttctattggggtggcaggagggggctgaaatggcaagccactatttctattaactgctctgtcttttgcttcaatatctgtttcataacaagttttttttttctcaatagctaccccattttataggcaaaggctcagaggaaaatgagatcagagaaaaaaaatgagttaaatatcatctgcaaacaaatataaagcaacacaccatgcaagaaaggctcaccccctctggatagagaattctctcttggtatcgtgttggtgtcattgttctcaccacctctactctcctcaagtttatcttttctttgggagttccagattctatttattaagtatccagtatttccatacacagtattcatttttaatattgaaatcctaatctccattcctattgatatttgatagcaaaatgttccaacttctatacaacatttgagtacttccttcattgtggccgctttagaatctatctgtatgtaactatgggtaggcaaggaccaaacttgctcagaaagtttcatagatgctgcggttttatcattacattgcctatctgcatggtgatttttttaatcagttattataagcatgtttgatacttttgattgataatggaaagtaaaggaatgaaagttcagctaattaaaagagatgattagaaagaagttggctttgcaggagattggttgataaaacaactgatattttctttttcttgtttcaagccttgggcagaactcttatgaaagcatttagaatttagagggcttgtcatggccacactaagcatctgactcatctggttgctgcaatgtcattaaaatgaatttttggtgccggttcaatttgtctttggctctacagacatgaccttattcacattgattgctctcccattaacggtagtgtagtaaaggaaacgaaataagaatatagtgttcaaaagcaggtctacatgcaaagggtttctttaacagtattattatatcatgatgttttcagagatgtgaagtatatttattaagtatattcctagattataagaatgttgctttaaatgatatattaattttctaccatagtggaaaattatttagtatacagtataaatcattcctaaaataaaaaattatgggatttatataagcatgtcaatatcaacttttcatttagaaaactacaaaagaaaccatttatttaaacactttaaaaccctgtgtattacgaaattaaagtatcattttcaacagagatacaacttttccgtcttttgccttctctaagcttagaaaactcacaaagtttatgaactttaaatcaaaatcaatgtttcttagtttctcatcaatattattttaaaatattgaatatctttaataaatatggagaaaaaattaattcagaaatattcttgcaaattggtctcttttaacataatctttaagtcattgcttacacttcccagtcactttagtaaattcttaattgacgtggttccaaatctcttcctaattctggtcattatgttcttttttaaatgtaatgaactgtgtggtgtgattaacagcaagcttcatgccaagtacaatacagtggggttttatcagatagcagagagagggtgtgaatcgtttcccagacttatgaaatatctatgtttatcattctttgttatctcccaggtacagtttttagaattttaatgtgtttaaataagcttgcataattgttaatgtatttacttaaccaatatttatgagtgcatcttatgtttcaggcataggtacacagtgacaaacacacataaaatctgattgtgtggaacttataatgttataagtatgtataaaattatttcaaataatctgttataatatgccagtgatacagttgttgctgtcagagacattgaattattgaaaaatgagaaaagtttacattattaatatgccatttatagccaatttctgatagatagttaattaccttaagaaagcaattctcaaactttagtgatttgtgcattgtcttcagaagtttcaccaagccccagaccacctatttaattatttaataaatatgtttttaatggactccctttttaaaatcttattctcattctaagcaacaatttccatgaaaggttgtgtttagttcacttgacattgcttcctactgtgctgtcagaacatcatattgtttagatatatcataatgcaatatcatatgaaatgatatttcacaaaccatcaatggtacatacacttgggaaattctggcttaactaaatccttgtacctaatttaataggtacttttctccaaaactattaacttgtatgaccttagaccaagaattgtgactagtacaattcacaaattgtcaaaattgaataccttatctaaatgcaaagaagtcttcagcataactttattttaaaacacagatgttgtgatttgatagtaaattattcaactggattctaatgagttatttgctgactgttcatgcatgttgacccaagtactcttcattcccacatctgtcctttagacagtctcctttttctgtccttccaactataactctgatttaatatttaatgaacaattactatgttttatattccttccctcaaagaagacaagctgtcccaagacattctaaaatgaccactcctcccacccctgtgagttctctgtgcaaccctgccgtccctggcctctccttctgtctctcaccttaccaagctcttagtcctaagtttcaggtaatggctattacaccctcactgaattttgagctgaagagaatattaattacctagtcacatctagttttacagatgaaaaaattgagacttatgttttgacagtccatacttaaatgctgaaattttttttaattgggttcagcatcttcacagaattaaccccaatcatgacagttcgaacatttcctgaaaacaccttgtattgctgtctatttccatcggtttgcaaaatgatgttgatcttgttttttacattatcattttttttttttttgagacggaatcttgctctgttgcccaggctgaagtgcaatggcacgatctctgctcactgcaaccttcgcctcccaggttcaagcgattctcctgcttcagcctcctgagtagctaggactacaggcatgtgccaccgtgcccagctaatttttgtatttttagcagaggcagggtttcagcatgttgaccaggctggtctcgaacttctgacctcagatgatccgcccgtctcagcctcccaaagtgctgggattacaggcgtgagccagtgcgctcagcccattatttgtttatctaatagcttaatcattcatcactgacattttgagcatttaaacaacatcatcctcaataaagttctagaatttctccaacgctgtgttctagacatggcacttcatgtgaacaattccacaggaagtaggtggtactattactattcgcttttatatgtgaggcagccaaatcataggtagataactggcctagagtcaaccattattaagcaggagagtggaaactagctttgtgtgatgttggagatcaccatttttgtcacttcattataatatccactttattccaggtgccattctagaggtataagatactgtataaatttataagacacaaattatatttttaacagatctttggtctagtttaaaagacagaagtaaaagtatttattcaccagatttacatacaagtaattttgggctattgtcacaattcaaatctaccttcataggagaaacattcatgattatggatatacatggaaccatgctgtatagacaattccaatcaaaatgctccacattgctttggacaatgtcaggatcactggaataagtacatagcatggcaaaatgagttttgtgttgtttttcctcctggaaataaagccaatataagacccctggtcaaccaagagaaaagcccataaaggcaggttccagtagctcagagtaagtgtataggatttcttgtgacaaaagcattgtgacatattatcagtgaatttcccttctcccatccaaatctggtgattagtcattaactccagcttaacagcaactcagcagtaacaacatgtactcggtttagttatctgaaataaaacaacaacaaaatgtttctagtggtatgactgttgtaaaaatatacattatatacaaagcagagaacttatacatagtaggagtttgctaaataaatatttctaattgattaaagaaaatacaatagtaagggcctgcctatttatacatataaataatttgagttatggaatgtaatgtgagattatataattttttctccttgtgctgtaagatatgaacaaagagattttagaagaaaaagatataaagaattgtatcacttattaaaaacttagtttattgaagttctttaagagacattgtacttttaaagaattttcataatagcctcaagtttcaaacaagtgaatgtctgtaattgacagccaactctaatgagagttgtggtgttggaaattagcttagtatcttcaattctttaccctgaactggtttacactggcacttgtagattgcatgttcttattggaggtgacattgagagattacattaagttggttatcgatcatactgtataggttcactttactaaaatgtaatctctgtttcaacaaatctaaatctgacaaaatatgccatttttatgccttatggactcagaggttataagggggatgagaggcaggttgcagccccaaactctgggcatttcaaatctagcccagagtgttatttattaaatcaaatgatacatatgaaaatgtttcctatatttaatatgcagatatgaaactatagtactttaaaaagtacaaaacaagtgtcattgaatactttctatctacaaaacattctggagagtatttgaatgaataaatcaattccctccagatatttagtagtaaagaaattctttatgccaatagtgatttatctatcctaattatcataacagaagtaaaacaaaatagtgaatatatttattttattatttctagcttatcttattaattgtgtcagcttcttttcctatttttcctcgtatgagttaatctggtcttattctttctgaactaaccatatcctaccctgactttaccaaacatacaaaagtaactatagccaaagctactaatattaatctggacttccttatgcaaaacaatgttcacattcatttaactgcggactctaatccccagagcctatttaatcattattgtgatatcgtttttgttacttcaaacatttggcatgcaggcagaaacatgtatatgtgtattcctgggaaatctatcaagcagattcccaggaagtctcctaaggtgatattgattacattcataatattattattgttcagagaccttgttgaaaaccaagaggtggtgaaagcctaagcgaatgacccattaaataaaactcagtagactgatgtatacaactaaaaagccaattaatttaatttatgagaaataattatctagaaaccctgaaactcaaaattataactactgcatcctctctctatggcagttccacataatcagctccatttgggggcttagaatcagcatgaaaggaattacataaatcacatgaattgatgacatacggctaagcctgtttgttgcattattttgctacttcagtctgctggataaaattcctctccattggatagtgctttgacaatcaccaaccacttctgctcctacaactctattttttttccaaacttttaaaatggaacaaataccattctgctcatttcttatatatatatataaaagacatgacatatatatatatatatatatatatatataatgtcaaacagattaaaattagttctttctgacttacaaatcaatccatctcatataggttagtttacatttttctattctgatccatgtaccaattttaaagtttaactctttgcagataattgtattcctcacatgtccacattgtggggacaccaaagtactcacagcatattctctaaggggagatgtctataagtcaacattataaaatatgaacattatgtttactgtcagtgtctcagttaacaaaataattcattgattctcagatccatatgatttttcacaatttcaacatctctgaaatcagcatgtgtcttactatcggtagcatctcacaatctctattggccaagccgagacggtggcatgggtgtctcttcctgtggacatgtggcacttgtatcaaaacttgaagaataggcctcagtgccttagaggaaagttctggagacaatagaggctcaacctttttaagaactctgtcaccaatgcttttgtagacagagagaaccattcagagggcacatcagtgattcaagccgcaaagtgtttcaagagcgttagactatgaaagagaagaaatttggggaatggctcaaccaagtcatgtcacttatgttttccttttcaagtatgcacaaaagtgatataatttttaaaagattagaagagctcttttgagatgcttcattttctctttcttaggggttcacgatagagtggtgtatcttacaatccatggcctcctaattatgaaatataacaatgcatactttcaagtaatattccatctgtatacatttattagacattttagaaatactaggagcagaaatcaacatctttttcaaggcgggcaaatctttatttactcctttgtaaaggatcattttagaaagtcatttccttattctgaaatatgtagtggataaatttaagtaatattttcaaattctgtcctaatagcaaatggaaaaattaaagctgttgattcatgaagtatgatgatctattctattaccacagagtcaaagccattacatggtttgcctgtgaaaaaatagtagagaatacaaatttgtgtagataagatatgggaagaaaatgtcatgtttaaatctgtaaatggaattccctggaaaagggttagcagcaccactattaccgatgtgaaaaattcagagcttcttgcctcttcctctctgatccagagatgctgctgagaaagaaacagctctgttttgaagaggctacagcaggcaggcatcttcatgcttacacaggcctctctctgctgaggtggcctcttggggaagcctcacaaaaactccctatcctcagctcccaggatcaggggagaaggatgcccttgatggcctgcggagatcttgagacaaggcatgcggccaggacagacgttgattggcatgaccctcagtgagaatctcagtgaccttcctaggacctcctgggtctgctagggcacatcagtctctgagtctctgtgttgcccacagccttctgtctgcactttcctatttgacagaaacagcttcataaaagcagttcccataaattgaattcccgtggcttgacctaatttactatctccatatgtcggttccaaatcagcagcaggcatatttacagacctgggttggttggcttacccaattaaagatgttaagtaattaaagtgtattactttttcaagtatggagtattatttttcaaataatgcagtatatccttatatactgcactatttaatatgctgttctaatttaaaaaacaataaatatcattactatgagttaggaataaaataactggtgagttatatatatacaaatttatatgtatatttgatataaaattatatataaatataaatacatttacattgtatacaattatatatgtgtaaataatatttattatctcattatagatatatagatctattaatatatagatagatgatatatatagatctatatatatgatatcaatatatgtgtatagctatagatgatattaatgtggaatcacaactagaaataaatagtaggcaaaggtaattttgaggccaaaaatataaatacttataatctctcacctttaattaattcagattttaaataattgaccaacttattttaaattattttctatggaatttctgtggtgttttacctctctaaaagtgtgtgtgtgtctgtttgtgtgtatatatatgtgtgtgtgtgtgtatatatgtgtgtgtgtatatatatctacatatgtatgtgtttatatataatactttataggctatatgtcagtaaaatatttgaaaagttttattctgagccaaatatgagtgaccaatggcccatgcatgatacggcccttgggagatcctgagaatatgtgcccaacttggttttacacattttagggagatttaaaacttcaatcaatacatgtaagatgtacattggttcagtctggaaaggtgaaactgaagcaggaaggagttagggggcaggggcttccaggttataggtaaattaaaagattttctgattggcaattgattgaaagagtttaattatggtctaaagacatagaatcaagagaaagcaatgtctgggttacgttaaggggttgtggagacaaaggttttattatgcagatgaagcctccaggtaacaggcttcagagaaaagtttgcaaatgtttcttaacaggcttaaagaatccattctatcagtcttaaggtctgtgttgatgttaatgctggtcagctgggcctgaatttcaaaagaaaggagggtataaggaggcttatctgactcttcctttctatcagggtctgaactagcttttcaggttaactttaaaatgcccttggccaagaggtggggtccattcagttggctgaggggcttagaagtttatttttagtttacatagatacacacacacccacagagagagaagaggaaggaaggaaggaaggaagggagggagggagggagggagggagggagggagggaaagaggaaaggagggagaaaaggagggaatgggagggtaaagaatgaggcagaaacaaaacggaaatacccttcacagctaacctgtgcatttgtgctgccattgggcttgtcattagttgtgttggttgttccttgcacaagggcagccagactagtgagtcagggctgaaatcagttcctgttccacttggaaaccacatgctctggcacccatctgcatttgtggggaaagtgacacctttttctaattcatgcaaagacaccatatgggctacctgtggcctggcaacagagtctaccacttatacccacagaagattaagcatttgtgctcatcattaccctttccagccactgtcttttaaaatctagtgacacttcagtgcaaagttgtttaactgataccttgtttttggtgaattgagtagatactggcaacctaacaaaccacgagaatttggacagaggcatccccaaaaaagcagtgaggaaaggaagtgtttgcagctaaaatacatttaattacatcctgggaccacttcaacatcttaagcatgtggaccacagctacctcttcattaggtgttgctctctatttgatttacagaatgcagggtcagcacttgtgaattagcgtcgtgaataagacattcataaaaccttatcagttcagaaccgatgctaagacaagacgcaggtctagagctcataagactggtgacaatttcacttatttatgtcagagaaatgttacacctgtgtttttatagcataaagttggtgagccttcctctgtgcaaacctcataagccagacaacacatgcaattaattgacagagacaagagaatccccatttctgttttctgcatggctgctttgcttacatttcagcatactttacctcagttttatttttgaacttgatctagtttggattttgtacacccctaaaaattacctaaactcaattgtaacactagactgctgctgaacgtcatgcttatagagttggaagtgttctgttgaaggatcatttatccaaaagcaacagcaaagatttatcgatacctagtaaaattctgccattccatccttcactgtccagctcccttctgaagatcggatattcttttaaaggcaaataagacgcatagtggtattttacttggaaccttatgagagagaactcaatatatttgaagaccctggcatttgtttttaaaaatactttattgtgtgtgttttttctttccccatcatagcattgttaggggagaaaattgcattatttaaaagtatattatgttagaagccagaagtcttgagctatatttctctgctgtctgtataaccctgagtccatggacaaataaatttgctttcctgagcctttgttttcctgtttagaaaatgagacaattgatctagataaaatttaagctcccatccaatcataaatgttccataatactaatgtagaaaaagcaggttactcagaactatttctgaatccaaaaagatagatagatagataaagctactttataaattatgaattttttttgtagagtctgagactttatgtaaaagagaaagagagatggacatacagagagagagaaaaaacaaaacaaaacgaaacaaaaaacagagaaagaggtgctggatatatttggaccctcctttgtgagaagggaaaagatgatcccaggagaagatgggatcatctcatccaagaaaagatgatcagctagaaccagattgctggggtagtctagaacaaacatttcaaaagaggttcactactttatgaggagacagttctcaaacaagaggatactctgtgaatagatgtattagaatttatcaacagaagcactctttcttcaccccttccagctatagtaccctgaatattttgatattttaatgcaaaagaagacatatttccctaggttttaatttttgactacccaagaaaattatcaacctgtaaattgcttttttctctatattgatataataattagaaccaagctaatcagatgtgccattatgttctttccttcacatcatagtgccaggcaacattgaggggacagctggccagcctgatgccaaaagagaggcatctaagcctcttcaggcaactgacatttataggaattatggtatagcatcaataattcacacaacctcacaacaagtgctggtaagcagctggtctgtagacaggggcctcatcacttactcatgtttgagacatttatactggttcattgccttaccttaaggcttctttaattgtagggaccacgaaaagaatgcagcaactagcaattaaagcaaaagtgctgctctgcattataagggtatatgttgattacttcatggagagggtgattggcttttgaaaccctaagtgaatgtttggtcacaaaaatctaacattttaaatgatcaatttatttctgtttatcatttccttgagctgtgaattgaaaagaaaaaaactctaccacttattttatagaatcttagacatttagtattgaatgtttccttagaaatgatccaattctttattttgtttaaaaaacaaagatctagagaactaaagtaactttcctcaaatcagacagctggttagtaaaagttttaagactagaactcaagtttggtgaaaatgtttcccctaactgacctttgcatgcacaaagttcgactgattataatccttggcttgggacagactgtcattattcatcaataacttatcaacttttattttacaataatataataaaggcttatggacccagcagccctccaaacagcaaggagcatgtcaataatatgctgaacttatggtccttctcattcccctttccttctccctttgctacctagaagtaaccagcaacctgaatcctgcattttcttgatgtactttgcatagttttatggcatgtaaatgtatgtcttaaaaatatatttttaatttataaaatgtgtatcatgctgtatataacatgacataatattgccaagactcatccatattgttgtatatgcctgtatcatagtgtatttttcactctcccattaataagcttttggattctctctaagttttttccattgtgaacagtgctgctatgaatattcttgtaaatgtcacctattccaaaggtgcatgagtatcccaggggtatatacttagcaagaatttcttggtataacactatacagttattcagtttcagaaattagtgacaaactatgtcccaaaggggtggcaccaatatggactttcaccagcagcgtggaagatcctgtagattgtatctatctggcttttactgtagagggccatacagtcattattgttggctctatgggcctcatatggtttctttggcagctactgaactctgtcattgtaggtaaaagtagccacaggtaacacataaatgagtttcataaattttcacagtataaaatattgttcttctgcttctttccaaccatttaaaagtgtaaaaaacataatttgtgagtcacacaaaaacaggtggcagactgattactttttctttcctcatcctatcttcttttatttattttttatttatttaaaaaaattattgatagcctgttacatgccataacccgttccaaattgatatggtttggctctgtgtccccacccaaatctcatgttgaattgtaataatcccaatgcatcaagggcggaagcaggtggagataattgaatcatgggggcagtttcccccatgctgttcttgtgacagtgagttctcacaagatctgatggtctttataaggagcttcccccttcgcttagcactcattctctctcctgctgccctgtgaagaggtgccttccgccatgattataagtttcctgaggcctccctggccatgcggaatggtgagtcaattaagcctcttttcttcataaattacccagtctgttatttctttacagcagcatgagaacggactaatatacaaatactgaggattctgtccgtgaacaacttataactttcctgctctcacagagtttgaactctaatcagaagaggcagaacatagacaaatgtatatattctaagcaagtcatgataggtattttaaaggcagattcagagaagtagatgctggtggtaggaggtaatagtttacatagaatgatgaggaaagccctgtttgatagaacaacacaagttgagttcatttttaaatgagggattggaacatccaagtatctgaggagaaactactgagtgagagagagcagcaaacctctacacctcctcccctgagcttttatggttctaatagcatgctgatatctcttcccaaatattccacaagctcctttaagtcttcatttgccaatctaaatttatcatctactacagccttggatttcctaacttggtgaagggcacctgtgtgaactcatcactcaaaccaaaacccttcaaattttcctgcatcttaggttgccttttactccaagcatcaatttactaaacaagtaatttcattttttcccttagtatctgtattagtttcctagggctgccataacaaaataccatggactgggtagcttaaacaatagaaatgtattttctcaacttctggagtctaggatcaaggtgtctgtaggtttatttttttgtctgtggcctttctccttggcagatgacagctttctctttgtgttttcaaatggtctttcctcatttcctcttcttgtgaagacatcagttggattagatgaaggctcaccttcctggcctcattttagctttatgtcctctttaaaggtcctatctccaaatatcgtcaaattctaaagcactggggattaagacttccacatataaattttgagaggacacaattcagcacatgagtatcttctaatctaatacctttcctctgcttttattgctaccaccttaccatttccttcccttttttatttatgtttattggttttctgattctagattatactcttaatgatcaattgtccccaaaaccagcagaatagtcctacaaaaataaaaatgtgatcttattttattctgcttgaatctttgatttgttccccagtagccttcaggataatgtccactggcatactgtatcctcaaagaactgcaccatctgcatccctgttcttcctctcaccaggtaaactctcatgctgtcagctacaacaatagtaaactatttgcagttcagggcctttacaaattttctttgcctgaaatttcatctctgccttaatccagtctttttaagtgacagattaatatattccaagaagcatggctcaatgtcatctatgaaaaacattagcataccatcattttcaccattgtctgagttagctgttcttcctctgtctcccaggtcatgatatctttcatatcactgacattgtataggataattatttctgccttggactaagtgcctgtgaacagggactgtgtcctgatttattcttacatctttagtgcctagcaaagggctgctcctcttaggcacttagtaaatatttgttacatgagtgaatgaataaatatataaaggaataaaaatgattagatagaagaaacatttttgtatattattttgatactctaaagctaatattctaatggtaatcaatatagtttaaaaataaaccattcaattttactaaacaaaatggtgaactataattggattacatggtataattatgacaatatgcatataaaaattaaaagcctacatagcaaattaatacaccaataattactaaaaataatacactaataattaaaagtggttgtttctggttttttttttttgcaaatgattaagctgtacacaatttattctttttttatacttttctgtatttttcaaataaacttgattctatgaaatatcccatgacccaattcatgttaagcaaatttactacccttttctcaacatcttcaaactgttttctttacatttcactgtttagaaaatataaaatgatatctgcaacaaattacattctgctacaaatccacattttcacgacaagaacaaaaaaatgcataacaaggcatagaggataaatttctctccaacccactgtgaaattttcattaagcccctcatatcttctccaggtctaggccctaaggacaaatgaagagtctaatctttgatcaaggcttacttcaagccaaaattatctattgctctagagaaactcttccaaatggtcataccctgctgctatgaaggtgacagtcctccccactgctcacatattgcatagctgcaggatgcgaggcaaagacttgaaaaacaagattaaaccttactcaaaacattatttccattaaaattacatcacaccgaatatcattacctaaatatttttatctttctgtaactcttacaaaacaaacattacccttgaggcaaccttgcagaataactttcacttaggagaaatgaaaaaggaacagacattataattgtagggaaagaataaaacaataatggtgcactttcttaagaccttcccttatttttttttttttcatttgctgattatccctttggccaaatagtagaactgtggaggttcagagatggaaggaaccttactgatcatctagtatgtatagcataatttacagttgtggaaatttaaagcccagataagccaaggaacttggttaatgtactgattcttcttcctctgggaaacctaggaaatgaattggatgataagtgacatggctctgttattaatttcagccatgtgattgatttcacaggttcttcagttaaaaagacttgggttctgtcccccttttaccacttaccatctgtttaaccttgggtagattatttaggcctttaaaaacctccatttcctcagttgtaaaatatcaattttagaggacctatcatgtaaagaggtgttaggattaaatgacaaattgcttagaactgtacttgggatcatagttggctactactattgttgttgtcatttatcctacaggtaatcctactgtttgagataaggcattctgggagacaagatttaagagcttttgaagaagacaactttatcacatttgcttcagactgtttagtgtgtgtccagcttcaatatctctctgtttcttagacattttaaagactgttaaaggaggagaaaggccagattacaacaattgttgacatttagtgaaggcttagtataaaacaggctctctcctaagtgaattttgtgtagtaacccatttattcctgaaaacagcttcacgaagtaggcaggcactgttctaatatctgctttgaagatgaagagacagacgcaggggttggtttcaacatgtgaaagtatattttattatcacctcccacattcacttctgcaattccaacatttgcaaggcaagagaggatttgccaccctctggtgtctctttttttttttttttttttgagatggagtctcgctccagtcaccaggctggagtacagtggcccagtctcggctcactgcaatctccacttcccgggttaagcgactaccctgcatcagcctccccagtagctgggaccacaggcgcgcaccaccatgcccagctaccctctggtatcttgggtttgatcttctgcttcgggctgtggcttcaggagctggcagtggcttgcgtggtggcaggagaagttcccaccagtcctctggctgtcataacatgcatttcatagctctcaccatatgtaacagtgagcaagtttttatttatcaaaaaggtagcctttgatgaggggcttgactacctgcttatgaattaacaaatagcagatataaagatttctaagtcatgctcttagggcaagaaaatgctttgaaatactatctgatctgcttattttctgggttttcgccttctccaccccttccaagtcaaggtctgagtctgagttctattggatattcactacaactgagagttattattgttctcagctttgagccttaaactaggcttttagaaactctaagcaagatagcagttttaaagggaagaatttttcctgaatgactaaattaggttttatcatagtcaaaagcatagattaaccaaggcaagctctaaagtaagaagcaatatggtaaaaagagagcatggtaaaaacaaagttcttatcacatcttaaatagaaaggcctttctattaatggtatacaagagagaaagcggaaggagagagagaagagatgggagaggagataggaagagaaaggggtagaatgaaggaaaaaaagaagaaataaaattgctgtgaaaggagagcaaaggatagcagagagaggaacaaagcaaaaccagacttccctcctcccctcactttctgcttggtgcccaaatccagagcagaggcagaatgcagagatacccagattgttttcagggaactaagatagggagacacataaggatcatctccttcaataaaaagagcgttgatgtcctcataaattttctctattcttaatgtgtcactctcctctaacagccatagtcagtaaactttttatgaattcccttcttagctttgtgactcatgtctagatttagtagccctgatctctgtttatcatcccttaaccttagcattcaaatgattcaccaatttatgcatgcaattgtattgtgatgccttattttccaatctccaaagaagtgtcatttgggaaatattgtacaggtctggatataaatgttactctatccaacatgtaactcatatttacaaattgaaaaagtttcagaatttttatggggacatttaaaaacgttaggtggcttaaaatattccctactgatgtacatcatctcatttgaaataatgtattcgatggaagcaaatgatctagtgaagagtattcttcatcttgctttccataataacttacggccgtatctcagttctcaaaatgcttttccaattacagctagcacttgatcatttgcgtgcacagcactttacctgaacgattgttgtggcacttttacctttctaccttgccacctgtcctgagaccctcctcagaaatcgtagttgctgagtctggagtagagaggttggtgactatgcagtaaggatacactgtgtctaacttagaatcttacaagatgtcactgacctccatctcctttgaagactctccgtgacctctaaaagttggagttcctgaggccttaccctgggctttcttctctttgcttgacgtataaatgttttgtttttgtttttgattttttgttttttttggcagtcatctcttccatttccatggcactaaatgccgtcttcatgctgcagctccaacatctgttaagctccagatgtttatatcttgttgtttaccaggcgtcagcatttaactgtctctcaggcatccccaatctgacttgttaaaaatgaaacttttgatccctccaccaggaaaatgtgttctttcattattcatttagacaaaaaactggcagtcatcatacacactcgtctctctttctctccttttctttttctcactctcttttactacctgccatatccaacccaccaataacttctattttttaaatttctgtcaaatatatgttaaacttattgaccttacatccactgccatcaccctgattgtagctactgtcacctccattcagggctacaagatcttctacccctacctaccccaatccattctccatgtaacagacagagtgatcttttaaaaacagaaattcgattgttttgcttccctgcttaaaacctgtcggtgcttcctatcattctttgtgttaggtatccacactccttctcggggtctcaaaccttgtgcagaatggcttcttgctaacctcagcctgagccccatctcattcattcagccttttgttttttctggaactcaccaagttgtttctcctcttacaacctttgtgtcagaggcattcaaaccagagcaactccatcttgaataagagctgggtgaaataaggctgagacctactgagctgcattcctggacatccttaggcattctaagtcacaggatggaataggaggttggcacaagatacaggtcataaagactttgctgataaaacaggttgcagtaaagaagctggccaagacccaccaaaaccaagatgcaatgggagtgacctctagtcgtcttcattgctacgctccctccagagtcatgacaatttacaaatgccatggcaatgtcaggaagttaccctatatggtctaaagaagggaggagtcctcagttccagggaattgcccacccctttcccagaaaactcatgaatagtctaccccttgtttagcatataatcaagaaataaccataaaaatgggcaaccatcagccctcagggctgctctccctatggagtagccatttttttatgcctttactttcttaataaaattgctttcactttactccatggacttgctctgagttctttcttgtgcgagatccaagaatcctctcttggggtctggattgggatccctttccagtaacatttgtaccatctcttccttctatctagaactttcccctgtcccacctacccatgcccctcactcccaacccagccttatcctccatcacttactttttgatcttttaggaccagttcaaatatcaattgttttgacacggtccatgttcaccctaaggagatccttcctgttggtattttttactaaaatctatttatttcctgaaaattacccatcctattgaattcttatttagtctctttccctgtttcatcttttaagatattctttgaaggtcaagtccatgtctgttttattcaccactaacaagccccattacctgggcccatggtaagcagcttattgaatgaatgaatgaatgaatttcccaccaataacatgtgagttagataggaactacctcaagctcatctcagagaagtgctttttcacatgtctaaatcccccatccttcagccccttcatcacttttcttaaaaagcacttggggctggttgcgagtaagagtgggaaattcaaatttgcaaagttagttcctgatagttcggaaacgtgtgtcctggggatccaatcatatgatcatttgttctgcttcaggttctttgctagccacccatatcctgctccagtcaattcgcaccctttagttcccaagggcgtaggtcagaaacaatgctcagtactttcaatcctggcattgccagcagcaataggtcaggcaaacactggggttgctgggaccacttagaatgtggaatgggaaggagcagttctaagatcattaatggtttcagcatagaaaaacaaaagtccagagacctgccaaacccctgtggggtaattgtggttctgtaagaacttggcctctgagttcggcattgcctgtaattacagcctttctttctttctttttttttttttctactttaagttctggaatacatgtgcagaacgtgcaggtttgctacataggtatacatgtgccatggtggtttgttgtacctatcaactcgtcatctaggttttaaatcccgcatgtattaggtatttgtcctaatgctgtctctccccttgcccccgaccccgcaacaggccctggtgtgtgatgttcccttccctgtgtccatgtgttctcattgttcaactcccacttacgagtgagaacatacagtgtttggttttctgttcctgtgttagtttgctgagaatgatggtttccagcttcatccatgtccctgcaaaggacatgaactcattcttttttatggctgcatagtattctatggtgaaattacagcctttctattcagcatcctcatttgtaagcctctgaaatgtctgagattatgattatcagtgcataagccctacactgtgagcttactaagaatattttcttatgtctgctatcattgggtgatatggtttggctgtgtccccacccaaatctcatcttgaattgtagttcccataatctccacatgtcatgggaggtacctagtgggagttaattgaatcatgggggcggttaccctcatgctattcttgtgatagtgagtgagttctcatgagagctgatggttttataaggggcttttccccctttgcttggcactgctccctcctgccaccatgtggagaaggacatgtttgcttccccttctgtgatgattataagtttcctgaggcctccccagccatgctgaactgtgagtcagttaaacctctttccttataaattacccagactcaggtaagtcttcattagcagctcgagaatgaactaatacattgggctaaaataaactgtcccaatatataaggaccacgttgtaaaaacttctccactgcttccgtcttttgcctagaacatagaacaggggttaaacgcttccatggtgtgtaaagttgagtgatagattaaaatgtaccattggtcaagagcagtagctcacacctgtaatcctagcagtttgggaggccaaggtgggtcaatcctctgagatcaggagttcgtgaccagcgtgaccaacatggagaaaccctgtctctactaaaaaaataaaataaaaattaaaaaaaaaaattagccggcatggtgtaatcccagctactcgggaggctgaggcaggagaatcactttaacccaggaggtggaggttgcggtaagccaagatggcaccattgcactccagcctgggcaacgagtgaaactctgtctcaaaaaaaaaaaaaaaaaaaaaaaataccatgaactaggtgacaaaataacagaaatttatcctctcatagttctggggagccagaattctgaaataatgatgtccacagggccatgctctttctgaagtttctggggaaaaaaatctttccttgcctcttccagcttctggtggttgcaatccttgagttctttggcatgtcactgcatccctcccgtctctgtcttgtcatcacatggtattctccatgtgtgtgtccatgttcagatccccttttcctatgaggataccagtcattggattaaggctcattcttactctaacatgttatcttaatttgattacatctgcaaagacgctatttccaaataagatcacattcacagtttccaggtggacatgatttggggatgatactattcaatgcagtgtatgagggttcacttgtattcagttatatcaggtaataccattaagtgtttcttaagcttttaatatttgaaaacaaccttattcacaataattgataaaataactacatttcagaatttaaatatacctgaacaagaaatgacaaatggttgtcaagtacttttatgcttagaataccatgctttcctcatgcaggaaattggaacagaccctggtcatgggcgtgttaaatcctcctctttcatccaccactgatctgtctcataacttgatcactcctatggaactgactgtcatttctcagtttcattctaggaggcttaaaagttctacagagcaaaagtatttttcttcctctttttgcttttttgcttgttacttttgttgaggggtcagcaaatgtcctctgaagagccagatggtaaataatattagtaacattaggctttgtgggcctcacggtctctaccacaactattcaactctgcctttgtagtgcaatggcagccagagataacctgtaaacaaatcagcatgcccaagttccaataaaactttatggacactgacatgtgcattttatataattttcatgtattgtgaaatattattcttcctttgatttcccatccatttaaacctgtgaaaagcattcttagctggaagactgggccaagaagaggtgggccagaatttgttttctgatttctgccaagtcttgttccctctctcttgttggttgtctgcctttgctccaccttttctggcatagaggacattctgcagggtactgtgtttcatatcctttttttcctttcccttctcctcctgcctttgaccttccctttccttttcttccttccccctcctactactatgtccctaaaataaatattcactacccctaaactatatttgatcattgcacattgattactgtaatcatttcctattttctaaaaatttgatgagtgtgatgtaggtcatggtgataacatgagggtagtcattctcttatttagaggtagaaattagatttaaatttctggcataatataagtatgaattgtaataatcccctgaacattattagaaatgtagattttttctcttctgagtgatcagcctccaaacatatccaaaattggagagagcactgtaaaagtcctgtgtccccgttactcagcctcaacaggtttccattcacagccaatgttgttttatttgtacctctgtctcctccctcctgtgaaattattttgaagcaaattccagacatcagtattttcactggcgtccctgtgaagagaccaccaaacaggctttgtgtgagcagcaaggctgtttatttcacccgggtgcaggcgggctgagtctgaaaagagccagcaaagggagatggggtggggccgttttataggatttgggtaggtagtggaaaattacagtcaaagggggttgttctctggcgggcaggggtgggggacacaaggtgctcagtgggggagcttttgagccaggatgagctaggagaaggaatttcacaaggtaatgtcatcagttaaggaatgaacaggccattttcacgtcttttgtgattcttcagttacttcaggccatctggatgtatacgtgcaggtcacaggtgatatgatggcttagcttgggctcagaggcctgacaagtatattttagtatgtatctcttaaagacattgactcttaaaaaaaaatatatatatatatatatatatatatatatacacaccatcatagtaacatatctagaaacaattaatacaaatttcttaatgtctttaaatatccagtgtttacatttccctaattgtcctgtaatttttttatgtacaatcggattgaattgtaacctacaaactgattagttgatctacttcttaagtctcttaatttttagattcaatctttttctgtctctctttctttctctgtttctcttccccctattttaagtttatttgtaaaagaaagtaagtcttccgcctgtggtgtttcctacagtcttgttaactgatatcttcccagtggtatggtctagagatttgaggaaatttatgttgtatttgtttgttaataatattttataattgttgcagtatccttccatcaagaggtccaaatgtctacttgtcgttcttttgtggtgttagcagccatggatgaccattagtgtaattattagcagttgcaaaatcatgatgttcttcatacagttggggtatttatcccttaaaaaaaaatgctacctgttgaactagatgattatcctgcatttttataggaattataggacaagtgtttatttttttctttaataagatttcaaaataaatttgttttctagtattctccaaaggcaatcaatgaaacctaatgtttgtttattaggcattatgtacttcagtctattttttttttttttttactttaagaacatattttatttaacccaatatatccaaaatattaccacatcaatgggcaattaatataaaagtttattaatgggatattttacattcatcagttcatcctacatcttttttttttttaatactttaagttttagggtacatgtgcataatgtgcaggttagttacatatgtatacatgtgccatgctggtgtgctgcacccattaactcgtcatttaacattaggtatatctcctaatgctatccctccccactccccccaccccacaacaggccccagagtgtgatgttccccttcctgtgtccatgtattctcattgttcaattcccacctatgagtgagaatgcgcagtgcttggttttttgtctttgtgatagtttactgagaatgatgatttccaatttcatccatgcccctacaaaggacatgaactcatcattttttatggctgcatagtattccatggtgtatatgtgccacattttcttaatccagtctatcattgttggacatttgggttggttccaagtctttgctattgtgaatagtgctgcaataaacgtacatgtgcatgtatgtagcagcatgatttatagtcctttgggtatatacccagtaatgggatggcagggtcaaatggtatttctagttctagatccctgaggaatcgccacactgacttccacaatggttgaactagtttacagtcccaccaacagtgtaaaagtgtttctatttctccacatcctctccagcacctgttgtttcctgactttttaatgattgccattctaactggtgtgagatggtatctcactgtggttttgatttgcatttctctgatggccagtgatgatgagcattttttcatgtgttttttggctgcataaatgtcttcttttgagaagtgtctgtttatatcctttgcccacttgttgatggggttgtttgtttttttcttgtaaatttgtttgagttcagcaaagtctcaggatacaaaatcaatgtacaaaaatcacaagcattcttatacaccaataacagacaaacagagagccaaatcatgagtgaactcccattcacaattgcttcaaagagaataaaatacctgggaatccaacttacaagggaagtgaaggacctcttcaaggagaactacaaaccactgctcaatgaaataaaagaagatacaaacaaatggaagaacattccatgctcatgggtaggaagaatcaatatcgtgaaaatggccatactgcccaagctaatttatagattcaatgccatccccatcaagctaccaatgactttcttcacagaattggaaaaaactactttaaagttcatatggaaccaaaaaagagcccacatcaccaagtcaatcctaagccaaaagaacaaagctggaggcatcatgctacctgacttcaaactatactacaaggctacagtaaccaaaacagcatggtactggtactaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtaggaagctgaaattggatcccttccttacaccttatacaaaaattaattcaagatggattaaagacttaaacgttagacctaaaaaccataaaaaccctagaagaaaacctaggcattaccattcaggacataggcgtgggcaaggacttcatgtctaaaacaccaaaagcaatggcaacaaaagccaaaattgacaaatgggatctaattaaactaaagagcttctgcacagcaaaagaaactaccatgagagtgaacaggcaacctacaaaatgggagaaaattttcacaacctactcatctgacaaagggctaatatccagaatctacaaagaactcaaacaaatttacaagaaaaaaacagtctattgcaattgttactcttattcatgatcacattgtcccatgttcagccagtgggtgtaccttccagttggtttttaaatatttatgacatgaccttcgttgtctgctgtttcttcctttgggataaaacaggttgttctcagctaatctcttgccccacatctggagcctgctacttctctgccccacccactttgcttctctgctcttcatttggaataggaagcataattcatttacctctgtggaaactctgttgttttagaaggggagatgccactctagcagtactatcagagggtaaataatggaaccaaccaatccagcaactctggcacttctgaaatttagacaagggggtcatgttgtgtacttggaatgcacctgcattatgttgtggagagcaacacaggcaaactctgaaaaccaccctcatgtgtggctcactctgaggccttcaataatgtgttctttggaattcagatctgctcactgcacataggttgcaatagacatcatattattcccataatagtcttcaataaatgcttctgaaacaaatatcaatgaataaatgacattttcagcttttagagatgaaaatgacctagcccattttgtctgatactccatttttacctcaggaaactaaggccttgatatttcaagtgatttgtccaagttcatagtgcaaagtagcagatttaatccccaaatcatctgacctcaagtgcatcgtttcctactatacctactgcctctagactgtattagatcatttagcattaattattttgatcattgtccatttcttttttttccttccttctatagggatgaaaaaactttctaccctctgaatttttgataattgagcctatgaaatcaactgacagtagacacattaacatgaaacagaaattttaattactgcaaatgcatggagtcccacaaaatatgggactggaaaatgtgttcgatgactgaagcttatataacatcctgagctacagaaaggaataggggcctgaggcttctaagggtggtggtgacacaaattatgtgaggtgaggaaaggaaatgcatgtcgagcaaaggttaccttgtcatgcagataaagtctctctggtaataaaagttgtcttcaagcagccctcagaagaataggtgcgagtctgagtcacaatctgggcatggtgtccgcccttcttgtgatataaatccatcttccctagttgatgagattcccagagagacaattcatgacaaatgtgtttctttcagaggacctgcccttcattagaaagggaaagttcagaaaaaggttctccctgcgcttttgggggagaaagaggggcaagaaacggaacagaagagcagagagaacttggttctccttcagttcaaggcactcaggatatcaaagcatcatattttggggtattgttttgtggaccccagcacctcctttatttctctttctctctgtccctcttcccttctctctctctctctttctctctctctgtgtgtgtgtgtgtttgtgtgtctcttctttctaatgtaaataacatgagcctcctgtgattgttgttcccataatagtgagtagcaagtctaacaacggttcaggtaacccccaggcaagcaaaccaaaaaaaacagcctgttcaccgttcactaagctgttcgtacagtacatccctatgcccatttccaagtcttagatgactttttctagcacaattcaaaaagtactttatttcacaataataataatagaaactcagaagctttactttctcacttacctaagtaagggtggtaatgttttaggctacagaaataatcatcacttaccataaatgaatcaccttagtgttgccagcatactgaaaaagcaaatgacaaacaagataattttgatagtcactttattgccttcctgtgaagtgctaaggaacggatttattttcttgaacgtttccccttggaggatctgctgaaatctttttaattccgaaatcagagatttgctagcttagcatttggcaaaaatgatgatttatcctatttaagcattaaactatctatgtctatttgggtttcaggtgaccagatggctgagcagggcacctttacatcttttattcttaattttatttcattaactcagcaagtatttattgaccactagagtaccaataccagataacctgtaagggaataaggattaaacagtgaaaatggcacccatagggaccttaacagagtagtggctacaacaaatatgttacagagacactgtgataaatgcaaacacagacataaacataggttgttagggaagcatacggaaatggacagctgatctgcgcttggccttgcattgcggttttgggaagtgattggtattttctgacaagtgctttgaagctgagacctaagggactaagcaaaagcagagtggcagtgtcctgcatgggggcagaatttgctggatttagaggcacttgaatattttgataagcctcacagagaattttttttttaatgagtgaaatcaccaaatgcatttgtacttttgttaaaattaaagttgagaacaccaattttagtccctttgaatatgttaactgtgctatcttcaaggttttctttctccaaaaagctatttctagctaattatcctcactaaggaaagtgatctgtcggactgtgttgctaaggctcctcacaatgggggctgctgcagtgactagagactgagtcaatgaggaaaattaaatacttccagggactgattatttgggaattttcttccaagggaagttcagagaaagcccctccctgcccttctgggagaaggggtcaagaaacgggacagaagatcagagagactttggttcacctttagttcaaggcactcagcatcccaaggcaccacactgtggggtattgttttgtgaggcccaacatttccttcctttctctttctctttctctctgtctctcttcctttctctctctctctctctctcttctttctaatgtaaataatatcttttgtctcatcaaagagtctttaattaagtctttttcctgggttggaagcaatgagaaagggtcacaaccccgtcaagggaaagtcacatataacacagcccgcagtgcccccaaggatgtaaattgcttggatgtgtttaatcttcccatgtttgaagacacagactgtgatgtgaactagggtcaacatgaaaggcagcgccatcttaggtgactttagcctgttaatagggaatcctcctgtccttttcaattgtatattttctgctgcatcaaagcttttcaggtaacggtgtcagaaagagcataatctctcaggttagcctggtacaacttaagtttaaactaactgctaactgaaaataaaattccccaacaataataaaaattttacaaagttaaacactaaagaattttttaaaatattgcataaataatttgttgtaggttataaatgtgtttattatttatatgctgcctctcattatttagatgaccctagcaggtgcctgaaaatgaacgtttacatttttaggttggaccataattacttattttgtgtatcttcttcccactagctttggtggcataaaatttgttattcatcttcacgtgcttaaggcctagaacagtgcttggaataaagcacattgttcaataaatggaagctcccatgctcacgactctgcttgccctataaggagacagtgtgtacacttaccatagaataattattatcttactgttcatctcagaaaaaaaaaaaaacacaatggttttaagaagtaccttgcaccttacacatacttttatgttgctctgtgaaaagtctttgcagtttagtatcttataaatattgtaagtaaaggtcaaattccacaggggtctataatttcaaatattacttttattgttttacctgtaaaaattttctaagtgttttttttaaacttactgttacagagctatctggtaggatctataaccccatgaactacattttattatttattttattttactttttggaaagacagagtctcaccgtgtttcccaggctggtctcaagctcctgggttcaagcaatcctcctgcctcagcctcccaaagagctgggataataggtatcagccaccacacctggccatcaactacatttcaaatggatgttttataggaatcatcattgatgataatgagagatatctgttggaaaacaaaatgaagaaagggttaaggagtattatcagcactgtcacgcgtgtctgtgtgaagagaccaccaaacaggctttgtgtgagcagcaaggctgtttatttcacccgggtgcaggcgggctgagtccgaaaagagagtcagcaaagggagataggggtggggccgttttataggatttgggtaggtagtggaaaattacagtcaaagggggttgttctctggcaggcaggggcgggggtcaaaaggtgctcagtcggggagcttctgagccaggagaaggaatttcacaaggtaatggcatcggttaaggcaggaaccggccattttcacttcttttgtgattcttcagttacttcaggccatctggatgtatacgtgcaggtcacaggtgatatgatggcttagcttgtgctcagaggcctgacaggcataatatttattgaacttctgtagactaatgggcactgttctgggtagcagagattcatcaatatataaaatctgcaaaagttaaaacaaacaaacaaacaaacttctctgacatcctggagtttattgccctttaagaaggtggtgggccgggcgcggtggctcacgcctgtaatcccagcactttgggaggccgaggtgggcggaccacgaggtcaggagattgagagcatcctggctaacatggtgaaaccccgtctccactaaaaatacaaaaaattagccaggcatggtggcgggtgcctgtagtcccagctactcaggaggctgaggcgggagaatggtgtgaacctgggaggcggaacttgcagtgagccaagatcacaccactgcactccagcctgggtgacagagcgagactctgtctcaattaattaattaattaattaattaaggttgtgggggagacagacaatacaaaataaacatcacaaaggaggaaattgttgactgtcagaaggtgatgtgtgctataggaaaaaatagaggtgatgtaggggtgggaagactttcctttatcctctgagggtttgatgagtgagtgtacgaaataatctgaagggaggcagatgaacaggagaaaagacacacaaatttgttacctacaggaggacatcactggagagaaacctgaacacccaaaaggccagtgagattttgaagcttatataccttcttcccagggaagaaggtagagtggatatagtcaaaatttaggggagagtaaataaattcggggaaagacaaatggcccagagcataggggatagtctgagtgcagggttcacctccaggctcccctcttgttttttgttgtcgtggtggtggtactggtgtgaagggtgaggacaatcagtgtgtttttcccctcagagcaaattgtaaagctaaattagtcattatttaaatttactatagttgcctttataaaaactttaaatttacattatacatgttgaaattgaagctatgcaattgtaatataaacacggatttacaactaaagcatgttataatgtaaataattgattttctgtatgaaatcctaggcaatattgtaaaattgtacagacccgtcaactttttccacttaaatattctgagtaaagtttaagggtgttgtagttttcaagtggttttttttctttgtttgtttgtttctttttgtctcttgtgatccaagttttcttctctggttggtgagattactggggcaaagatttcttgacaattgagttccttttgaaggatccttcctaaggccggtaatgggagctcagaaaaagctcctcactgcatttgctgttctccaggtgccctcagtttgaagcaaccagcatgccacagtggcacattttggggtggtattttcttagttccctcaaaggtaaaatgcagagtgggttatatgtttaaacaggacagttgggtgggcctcagtgaggacgtgccctgtgaatagaggccaaacagagatgagagagctagcccaggggagttttaggggaagcatcttctagtcagaggaaacagcccaggcaaacgtcctaaaacaggagcatctggcatgtttgtttgttggttggtttgttttgagatagagtctagctctgttgcctgggctggagtgcagtggcatgatcttggttcactgcagcctctacttcctgggctcaagcgattctcccacctcagcctcccaagtagctaggatcacaggtgcacgtcatcatgcccagctaattttttgtatttttggtggagacagagttttgccgtgttgcccaggctggtctcaaactcctgagctcaagtgatctgcccacctcagcctcccagagtgctgggattacaagcatgagccaccacgcctggcccatttagcatatttgaaccacagttaggtcagtgtggtgtagtagatattaggagtgattttttttttaatgaagagcaagcaatacgttatgaagtatccttaaataacagggagcgttctctttaaggttcctcaggaatggtcagtcatggatccaagatgacatttacttagcctccaagtttgaattcaagatcaaaatctaattactgttacaagcaacaagaatcaaagagtaacatctccttgctacacaggttagaagactccttattgccacacagatgaattcttgactagcaaatgcacataaaccacatccctacccagtgtgagtgaaaaaggaaagggaagattagcttgtctaagtatcgatgtaaatgtagtcagtaactctagctgtattttaaaaggattttaacatctctacaatggaataaaaacattaacggatatccttcttcctagaaaatggctaatgctttcctacaaaaaaagacacatatgagctccaaattgttcttcatgtgggtgagaatggtctgtcattatttatacttgttcacagtgcttcatctgtcatccatctttgggctgtaattgtgagcttaaaaataatcactattttccaccacctgcagaacataatctgcactttgagctcatttcctcagtgttccctacagagttccatctgctttacataccttatttctctacacatgattaaagctgctgatgctacctgaactgcatacatagctggcattatggaatgcctcaaactaccacagcgtgctgtggtgagatgcctttcctatcagagtctaggcttacaaaaatgcatgaagtgtttctcatatattgcatatttggggtgaaaaaagacaatgacagccaatttttaataagttatgtcagggagatcataattattgatcttctaaacaaaactatctataaatatatggtcttcaacttatccaccgggaagacagatgaaagtttcaaatggatcctcttacaaatgactaaaaaacactgcatcataatctaacattatgttgagtctttttgcctgaatgttttctaaacaattttgtagaagttagttaatactttaaataactagacattgtaactaagaaattattttgtaagttattcaggaaagtacacatagctcttataaaatgaccagtatttgttagtttcttttataaatctgaatgtttatataaagtttacctgaaataagatacatcttgctttcatatggaatatttcatgtttgtttccaatagccaaattaagaaatataatttcaaatataaaattaaagcttatgtaattttctttctttttttttttttttttctgagacggagtctttctgttgcccaggctagagtgcagtggcctgatctcggctcaccacaacctctgcctcccaggtccaagcgattctcctgcctcagcctcttaagtagctgggattacaggcatgcaccaccatgcctggctaatttttgtatttttagtagaggctgagtttcactatgttggccaggctggtctcaaattcctgagctcaggcaatctgcccgccttggcctcccaaagtgcaggaattacaggcgtgatccaccacacccagtcaagcttatgtcattttctaattctactctcctttctcaactcttagaatattttattgatatctgtgttcttaaactttacaaaagtgacatcatgcattaaatgctcctcttacttgcattttctactcaatgttctgattttgaaattcactcatgtttcataaatatacttctaattgttttattttcaaatattttataacaattgtataaccatagctcaacttattttccactcttgtcggctggccttttatgttgtttttatttactattgcaaacaatatttacaaaatatttaatgttcaagaattcctttaggatatataactagaaataattattattatgggatattctcatcttcatatttactttttattccaaattattttccaaaatagctccaagaatcagggtataggtgttcatatcctcaagaactctggatacagccacatttttaagtatttgccaacctgacaaacataaaataaaacctcattgtagttcttctttgtatttccctggttactgtgaagatgtgcatctccctgagttgattaaccatgtggtttacccatttgtaaattactggtctatgtttcttgcctatttttcttttgcgttatttccgtttctgttaactacttgtagaagttctttatgtagctggatactaatatttgttagacatatatcttacaattatctcttctactcagtggcctaaaatttcacattctttatggcatgtcgatgaagaagagagctgaattttaacaaaaccatatgtacccatttctcccattagagtgcttttcttacactttctttaagaaataatagaaaaagccggatgcagtggctcatgtctataatcccagcactttgggaggccgaggtgggcactttgggaatctgaggtcaggagttcgagaccagcctggccaacatgatgaaaccccgtctctactaaaaatacaaaaaattagccaggcatggtggtgggcacccataatcccagctacttgggaggcagagacaggagaatcgcttgaacccaggaggcagaggttgcaatgagccaaaatctcgctactacactccagcctgggcaacagagtgagactccgtttccaataaaaaaagaaataatagaaatgttattttgtgctttcctctatggattttgaaggtctgtgtttcattaggccttgaatccatctggaacaatttttatgtagggttaaagacagggatctaattttattttttcaatatgaataaacaattttaaatttctcataaatatctgacaacaggttgcatttatgtcaagtttacatatatacacagactttgctttaagtttttaaaaatttgttgcattattttaattggctgtgcctgtaccaaacctgctttaatcatgattcttgataggccaattgtctctgcattgttcttcaacaatgtcttggctattcttagaccttggctcttaaatacaaattttttccaccagttgctcaattacatttatatacacacacaaattattgggattatgattgaaaatggaattaatttatatactaagttattgattcttccagtctttgaatatggaatattcctttatgtgattcttctttaatattattcattaaagttttaaatttctcccaataagttcttgcatatattttgtgagattttgttttattacatcataaattctatttttaaaatattgtattttctcattagttattattggaaatataattgatttttgtatattgttcttatattgaataatcttttttaagctgtagacttttctaacaggtttgaaaatttatcagctccccatcttctctacaattcttaggataatgataatgattattattattatgttttactttctttttctaatgactaagaccccaacataatgttgactagaaacagtgattataagcatttctctttctgatgaaaaaaaaagattctaatattttgtgactaattctttgaaccttctattataatgaagttcttttactcttttacacatatataggggaattacaatttattcctatatagctcattttattgaaattattctttattatttctggtgccttttcttaatgtactatgttgcattaatttttaacattaaactatcttagtctaaacactccaagtataaaccaaacttgaataactcaagtttctaaaattaagaattcaagccacatgtgatggcttataactgtagtctcagtaacttgggaggccaaggtataaggattgcttgaacctaggaattcaagagcagcctaggcaacatagggagacacccatctttatcaaaaaaaaaaaaaagaaaagaaaaaagcctgatttagtagtgcacacctgcagtcttagctacttgggaggctgaagtggaaggatcacttgagcctgggaggttgatgctgcagtgagctataatcatgccactgcactccagccactccagcttgggtgacggagaggagcgagaccctgtctcaaaaaaaaaaaaaaaaaaaaaaaaaaaaaaaaagactacatctccaccaaaaaattggccaggcattgtggttcatgcctgtaatcccagcacgttgggtggctgaggcaggaggagttcaaaaccagcctaggcaacatagtgagaacctgtctcaaaaaaaactgttaaaaaaaaagaatgcaagaagatataatttgtatattacgataatcagaatatataatataactgaggcagtacaatgtaaattcaacaaaccataggcacagttctcttgtgaagccataattgacaaatattattggcaaatccatctttattggatcattcttatcagcatacaaatacattgtaatgattgcccttttaaaaatagaaaacgccatcacttttgatgaaagaaaatggcttgaaagaaaaatcgtttttttttcttcctactctcccttcgagactgatataatcagtctttctttcacatcagaccatggaaaccctcttggaaagatcatattacccatactttcgataaattcaataattaatttagtcctcattttacttaacattgaaataccacttaagtccgttgatgactctctttctgttgaaactgatcatgtggctttctctgattttcctcccgcctcctggtctacctagtcttggtctctttattggctcttctatttcccacaatttctcccacctcagtaaatggtaccatcatttgcctggataaatattcagtccaaaattctcacaataatccttgtttcatttttttttccccctgataggtctcatccaaaacatgaccagatctttctggctgtatctttacatgatagatttaaagtctattttaaaatatttaaaacaaattatattttttaatgtatttccacttctctgtcacctccactgccaccatccaaagtctaagtgaccatctcccattagctaaagtagtagtttacaagtcatctctgtgcttccactcttgccctgctactaattattgaccacacatgagccacaattacaactaaaagcataaatcattcaagtcacactactgcttaaatctctgctgtggctttccataacatgtaagataaaatctgaagactttaatatgccttacaagaaactacaatatctgttccctgcctttttgtcttatatcatttcctactcttttctctctttattgtattctggcaaaataatctgccagattattcctgcttcatggcctttccatttgccattagttcatcttagattactcttcccattgatcttcatatcattccgaaatttgctcaaatattaggatctcccttaccaatctgcctgaaatggtctctctcactcctcaatcattctccttccacttaccaagctttttttcacagaagatataagtaagtaaaataaacgtgttagatatttgtttgttttctgcttcccatgtttgaaactagactgtaagttgcctgagatgatggattttatatcgtgctcattgccgtacctctagaactcagataaatggtaagcatattatgagcaactagatatatcttttcaataaatgcatattgaagatgttcttgagtttgaagaaatgatttttaaaatatgaagtaatcttttatctccacaagttttctacacccacgcctacgatcgtgtgctagacctttcaacctatgctgcaatcttatagcccactattccagacctttccatttctgactcatccagatcctttatttccatttacagaatccctcttgtctccagggtgtgtgttctgagcaataagaaggataaaattgctcttatcaccttctccttcttcatgcgacacatccccattcatctgtcatggttcacgacaaatgctctgtcaccagcttgctccacagctttctcaagctgggttatatggaccttttatttggatacacaatatatctctgttttagcacttgtttctattttgtagtcttaagcttaatgtcctctaactgccactggaccataagctcatagaaaacaggaaagcaagtctttttcatctttgtgtccccagagcctggcactactggaccagatcaggaacttaataaatggcttgtggatgcatgaatgattaaattatattaccaacttatgacattttttatgtaataggctatacattgttgccattttaaaataatattttaaaaagtctaaaatagtatctgcatattgcccctccccacccaaaatgagtgccgtgctgtgagaaagacaataaaaattttatgcttggtttgccaccaagcataaccccactgagtcaaagagatgcagggtagtaaggtaaaaacagcacgcaacccagaattaggaaaacacatttctattattttgccactatctcttagtattgtttggtgtaacccacttttttctcctaagacttgatttcttattctctaatagaagaaagtcaagatgggtgccctccaagatcacattattttgatattatttgatagtcaaaaattttcacataagaatatagcttcctttaagtggtagggttgcttcctctggatacatgcttgtataagactgcaaagctttgagttttgaaaaaacagttcttattaatgctatagcatttaattggaaatcctagctcacatctttcttatagttagtgttcaagtgctgattgattgaatcaggataataccattaagacttctatgcccaaagaaaacagacaaaattattaagatacagttgctaagatgcagaagaaatttaaagatatagaaaatggaatttattcgttttattaagcaagccaaggcttatacgcaatataaaagatcttaagaatatgtcataggttactacctactgtgttgctatgagacctgcactagaaagatctaatgccacctgtgaaaagtaactatagtagaccataaggcagctaaggaattcagactacacattgtatgttggccacacccagtctagcaagatttatatatacattttaatttagaaagttcataatattccttttgtaaaacaaggatcatttcagagaaaatatgaaaaaaggtggaaaaaatctctctgattaacaaattgcacattaactggtacgatgacatggtttgaaaaacaaaaataatacttagctgcaaatacaggtgtataggacacatataaaaatttttcattagactcagctcatatacttttattaaaatgtgcataatgtgaacttcagactgtatatgaataacatagaaaagaatcaggaaacagctataaaatgtatatatatataataacagctattatatatataataacagctattatatatatataataacagctattatacacacacacacacacacacacacttatacgattaagaaactggttacattctggaaggaattgttttttgcttttttttcactggtcattttccagctttatcagtccctggccagagctccagccatgcaaggaattgagttcttgagaagtgaattacttgaggattacagatatgttgagaatatggggtcagtagtggaggcagcagagggatttttctaatgtgctcatgtcaacatgactacactggttaatcttgagggcccgttattgccagagacaggaacaggtctccagagtatgttccatacatgcccagtgtttcaaatataccattaaatcagcagtatttacaacaaaataaattgtgacaatttaaaaataggtgattacatgatgagacagatactaaattctcagtagttccacaagacattttcataacatagtaatccaaagacagtatttaaaaagcattagttaatccgtggcttatttgtgaaatgaaacttagaaatttaaaatttgctatatgcagtagtttctgtttgcattatatgcataaatgataacacatataaacacactaaatatgggaataagattcttaatttttctacttatgatactagcaaaggaaaatctgtagagtgtaaatacatgttttgttctagatggtggacacatgaaaaattgttcatatccatttgtcacttaagatttaatggctcttccactgccctgaagggtgagtcccggaccaggcagtattcatcacaaactgacttgagagccgtgggccttaagggaatattggagataggctagcaatattccctgtggcccgttgtggtgatgaccacagggtgacactccttttcctttggaaggagagagaagagtgggaagtgctgcatcttgtggcttgagtgacagctcagccacagtacaacagaacaggtggagttctgaggtttttgactctggtccctgattgctggaggatggcaactctggacctacctgggacctcgggtgactcgccaccctgaagggaaggacataggcctggctggctgtgctacctgatgattgtagaaccccagagccttgagcgaacataggcagcagccagggagtggttacagcaggtcttggggcaacacccagtcctgtgctggctttagatctgacccagcacaatcctagtggtggtggccaaggagtagttgtgtcactccacccctagctttcagtggctcagaacagagagagacactctatttgtgtgggaggaagaagaaagagaacaagagttttcgtccagtaatccataggattctttcagatcttgtccaaggccatcaaggtagtatgtctatgagtctgcaagaaacacagcattactgggcttggggtgccccctaaagctgttacagcttagatcacaatacccaagtccttctgaatatctggaaagctttgccaagaaggatggggacaaagaaggtgagaaggtgaagactacaataaatatctagctttttaatgcccagacatccaagaacatctactagtatcaacaccatccaggaaaacatgacttcaccaaatgagctaaataaggtaccaggaaccaatcctagtgaaacagagatatgtgacttttcagacagagaattcaaaatagctgttttaaggaaactcaaatttaagataaagcggagaaggtattcagaattctatcagataaatttaacaaagagattaaaataattatatattaattaaaaataactaatatatcatataattatatattttttaaattaattgaattaaaaagaatcaagcagaaattctggatttgaaaaaggtaattggcatactgaagaatgcatcagagtcttttaatagcataagagatcaaacagaagaattagtaagcttgaagacaggttatttgaaaatgcacagtcagtgaaaacaagaggaaataataatttttaaaaatgaagcacatctacaggatctagaaaatagcccccaaagggaaatctaagagttattggccataaagaggaggtagaaaaagagatggggtagacagttaattcaaaggtataataacaaaaccctagggaaagatatcaatatccaagtacaagaaggttataaaacactaagcagatttgacccaaagaagactagctcaaggcatttaataactccaaaaggtcaaggataaagaaaggattctaaaagcaacaagagaaaagaagcatatagcaggcaatggagcttcaatatgtctggtagcagacttttcagttgaaaccttacagaccaggagagaggggcatgacatatttacggtgctgaaagaaaaaaacttttaccctaaaatagtatatctggtgatgatatccttcaaatataaaggagaaataaagacttttctagacaaacagaagctgagggattttatcaacaccagacctgtcctatgagaaatgctaaagggagtacttcagtccacaagataaaggatgttaatgagcaataagaaatcacctgaaagtacaaactcactggtaatattaagtacacagaaaaacatggaatattataacacagtaactgaggtgtaaactacttcatcctaagtaaaaagactaaatgatgaaccaataaaaaataaaaagtacaacaatttttgaagacatagacagtacaataagatataaatagaaacaacaaaaagttaaaaagcagaaggatagaggtaaggcatagagtttttattattacttgtgcttatttgtttgtttatacaaacagtgttagttgttatcagcttaaaaaaatgtgttataagatagtatttggaagccccatggtaaccacaaaccaaaatcaaacaatggatacacacaaaataaaaagcaagaaactaaattataccaccagagaagatcaccttcactaaaggaggacaggaagaaagagaagacaaaaaaacaaccagaaaacaaataacaacatggcaagagtaacttcttacttatcaataataacattgaatgtaaatgaactaaactctgcaaacagaagacatacagtagctgaatagatgaaaaagaaaaaccatttgatctgttgcctacaaggaacacacttcacctataaagagacacatagactgaaaaataaagggatggaaaaagatatattccatgcaaatagaaaccaaaaaaagaaaaagagtagctacacttataacagacaaattagatttcatgacaaaaactataataagacacaaagaaggtcactatataatgataaaggtgtcatttcagcaagaggatataacagttttaaatacatatgcatttaacagtggagtaccgcgatatataaagcaaatattattagagctaaagagagagatgggccccaatacaataataactagagaattcaacacctcaccttcagcactggacagatcttctggacaggtaataaacaaaaaaacatcagacttaatcttctctttagactgaatgaatttaacgcatatttatagaacatttcatccaatggctacagatcacacattctttccctcagtatatggatgattctcaaggatagaccatatgttaggtcacaaaacaagacttaaaacattcaaaaaatgaaaataatattaagcatattctttgaccacaatggaataaaactagaaattgataacaagatgaatttttgaaactctacaaatactggaaaattaatatgctcctgaatgaccagtgggccaatgaataaattaagaaggaaattgaaaaatggcttgaaacaaatgatgatggaaacacaacataccaaaaaatctatgggatacgataaaagcagtactaagaggaaagtttatagctataactgtctacatcaaaaaagaagaaaaacttcaaataacctaatgatgcagcttaaagaactagaaaagcaagagcaaaccaaacttaaaattagtggaagaaagaaataataaagatcagagcataaataaataaaattgaagaaaacaatacaaaagaccaatgaaacaaaaatttggtttattgaaaagttaaacacagttgacaagcctttagccagactaggaaaaaaagatccaaataaataaaattggagatgaaaaaggagacattacaactgataccacagaaattaaaaggattattggtggctacaatgagcaactatatgccaataaattggtaaatctaggaaaaatagacaaattcttagacacatacaacctagcaagatttaaccaggaagaaatccaaaacctgaagatatgaatatccagtaacaagatcgaagctataataagaactctgtcaataagaaaagcacaggaactgaaggcggaaatctgaaagcctttcctcgaagatctggaacatgacaaggatgcctactttcaccactgttattcaacgtaatactgaaagtcctaagctagagcattcagacaaaagaacaaaataaagggcatccaaattggagtggaagaagtcatattatccttgtttgcagatgatatgatcttatatttggaaaaacctaaagactccacaaaaaaactattagaactgataaacaaattctgcaaagttgtagtatacaaaatcaacatacaaaaaccagtagcatttctatatgctaacaatgagcaatctgaaacaaaaaaatcaaaatgtaatcccatttacaatagccacagataaaattaaatacctgggaattaaccataaagtgaaagatctctataatgaaaaatataaaacactcatgaaagaaattgaggagaacaccaataagatgaaaaggtatttcatattcatgaattgaaataatcaatattgttaaaatgtccgtccttcccaaagtgatctatagattcagtgtaattcctatgaaaataccaatgacattcttcacagaaataaaaaaaaaaattttaaatttaaaattaaaatttatttggaaccacaaaagacccagaataaccagatctatcctgaacaaaaagaacaaaactggaggaatcacattacctaacttcaaattatgctacagagctagagtaaccaaaacagcatggtacagcataaaaacagacatgtagatcaatggaacagaatgtataacccagaaacaaatccacacagctacagcgaattcattttgacaaaggtgccaagaacatactcttaggaaaacagtctcttcaataaatggttctgggaaaactgaatgttcatatgcggaagaatgaaactagacttctgtctctcaacatatacaaaaagcaaatcaaaataaagacttaaagcaaagacctcaaaatatgaatctactacaagaaaacactggggaaactctccaggacattggtctgggcaaaaatttcttgagtaataccacacaagcataggcaaccaaagcaaaaatggataaatgtgatcagctcaagttaaaaaaaaaacttctgcacagcaaacaatcaacaaagtgaagagacaccccacataatgggagaaaatatttgcaaactacccatctgagatggtgttaataaccagaatattatataaggagctcaaaataactctataggaaaattttaataatatgtttcaataattggccaaagacttaaatagacatttctcaaaagaagacatacaaatggcaaacagacatgtgaaaaagtgctagacatcattgatcatcagaaaatgcaaatcaaaacaacaatgaaatatcatctcaccacagttaaaatggcttatatccaaaagacaggcagtaacaaatgctggtgaggatatggggaacaggaaatcctcatacactgttggtagaaatgtaaattagtacaaccactaagaagcattcagaacttccttgagaagctgaaaatagaactatcatatgatccagcaatcctactgatgggtatatacacaaaagaatggaaatcagtatacggaagaaatatctttactctcatgtttattgcagtactgttcacaatagccaagatttggaagcaaccaaagcatccatcaacagatgagtggataaagaaaatgtggtacatatacacaatggagtactattcagccataaaaagaatgagatacagtcatttgcaacaacatggatggaactagagatcattatgttaagtgaaataagccaggcacagaaagacaaacatcacatgttctcacttatttgggggatccaaaaatcaaaacaattgaactcatggacatagggtggaaggatggtttccagaggctgggaagggtagtgaggggttgcagggggaagtggggatggttaataagtacaaaaaatagaatagtaagacctactattaggtagcacatcagggttaccatagtcaataataacttaattgtacattttaaaataactaaaaagagtctaattggattgtttgtaacacaaagcataaatgcttgagtggatggatacctccttctctgtgatgtgatcattacacattgcatgcctgtatcaaagtatctcatgtaccccataaatatatatacctatgatgtacccacaaaaatttaaaatttaaaaatattgtatggttccaaaggagttattgcaatgtgtaatatacaagtgttacaaaataatttgtaaaatgcatcaacagtaactgttctatttcatcaaaatagagtttatatattattgtttgcatgtgctcacaattaccaaaaaattattttaaaatgtcaattaccaaagaaattgttttaaaatgtcatggcactggacttggtgggcaagatggcagataggagatagggctaatgtgcagttctcacctggatgaactgaactgtgtgtggagactcacactgtgatctgttgctccaagaaccaacaaaggaacataccaggaaaacctgaaggattcccagatcctttgaaagaagcagcacactactacaaatttcatgaaacaggtgaaaaactgagcattcccaaagtgtgagagaaggaaaacctgcctccaaacatacatttctactgggggacctgaaaatccagatcatgagattatggaagaaggatttaacctctcctggagttgaaatggatttagggagtcacatgaaatataaaagtagaagtagcagcagaaaatgccttgcaggcagtcccagtctccagctgaagcccagggaagccatctctgatgatatcttataggggcccttggggaaggcagccagaggaattgggaagtagtcacagtgcaaaggaaactctgaactgaaatttgtagttgtttcaactgggcacaaatcttctcaggtgaagtccaggagacaagcaggagtggctgcagattcgagcacaggagccgcagccaatggagtgggcagatgcaaaggagcaagggccatgcttgcttttttagtggggaagtctatgtcctcaggcaaggtcttattggggcactgtgggagtgagactggccttgccaattgcatgggggggtgggttaggcctctcactaatggctattccccacttctctggtgaactatatgacacagcagaggcagccaagatgtcttttggcctgagaaccaccctgcatccccacagtggctatagcaagccccagccaaggagaggctgagctcagacctgcataaccctgccctgacctgataggatttctttacccaccctagtagctgattacaaaagataaactcttgggagctttatggccctgcccatcacctgagaaactgaaatacttaccctggccaagttagggcaagcttagatccctccactaatactgcagctgttgctgtcttggaaacaccaccttctggttggaggccaaccaactcaggccattacagcaactcatggtagaataaccctgatcccaggaaggagaagacaacacctaattccactgcctacaagatactggctaaccagagttcctgagcgtgtccctgtgaaaacatcactgctagcataaccatcattcaagaaagccagcacactaaacatatctacaaccatggactctcacagagtctacctcacttcgctgccacctctaccagagcaggtgctggtatccatgattgagagacctgaagatggatcacatcataggactctgtagacattccccagcaccagtctagagcctggtagcccagcttggtaaccagacccaaaagagcaataacaatctctgcgttccagctctcaggaagccccatccctagggtaaggggggaagcaccacatcaagggatcaccctgtgggacaagaaaatctgaacagcagatgttgagtttcagacctctccactgaaataatctacgcaaacgagaaggaaccagaaaagtaattctggtaatgtaacaaaacaaggttctatagtatccccaaaagatcataccagctccccagcaatggatccaaaccaaaaagaaatctctgaatagccagataaaaaattcagaaggttgattattaaggtactcagataccagagaaaggtgaaaacaaacttaaagatattaaaacaaggtggggcatggtggctcacgcctgaaatcccagcactttgggaggctgaggcaggtggatcatgaggtcaggagttcaagaccagcctggccaacatagtgaaaccctgtctctactaaaaatacaaaaagtttggtgtgtggtgggcacctgtaatcccaggtacttgggaggctgaggcaggagaatggcttgaacctgggaggcggaggttgcagtgagccgagattgtgccattgcactccagcctgggggacagagcgagactctgtctcaaaaaaaaaaaaaaaaaaaaaaagatattaaaacaaaatacaggatatggatgaaaaattctccacataaatagatgtcataaagaaaaaacaatcacaacttttggaaatgaaagacacacttacggaaatacaaaaagtgtagtgtgggaagtttcaacaatagactagaacaagtaaaagaaagaattttggagctcaaagacaaggctttcaaattaagccaatcagacaaagacaagaaaaaaaaaagaataaaaaagtgaacacagcctccaagaaatttgggattatgttaaatggcaaacctaagtatagttggttttctggaggaagaagagaaatttaaaagtttggaaagcatatttgagggaatacttgaggaaaacttccctggccttgctagagatcaagatacccaaatacaagaagctcaaagaacacctgggaaattcattccaaaaagatcatcacctagcacatagtcattaggttatctaaagttaagacaaaggaaagaatcttaagagctgtgggacaaaagtatcagataacctataaaggaaaacctatcagattaatagcagaattatccatagaaaccttacaagacagaaagaattggggtgtcatctttagccttctgaaacaaaataattgtcagcccaggattttgtatccagtaaaatggagcttcataaatgaaggagagataaagtctttttcagacaaacaaatgctgagaaaatttgccacaactaagccagcgctataagaaatgctaaaaggggttctaaatcttgaaacacaccaaaatagaacctccttaaagcataaatgtcaccaggcctataaaacaataacacaattaaaacaaaacataaggtattaaggcaacaactagcatgatgaagaaaacagtacctcacatctcactgctaatgttgaacgtaaatggcctaaattctccaattaaaagatatagaatggcagaatggataaaaatccaccaacaaaatatctgctgtcttcaaaagactcacctaacacataaggactcacataaacttaaggtaaaggggtggaaaaagatattccatgcaaatggaaaccaaaagcaagcagcagtagctattcttctaccaggaaaaaacagactttaaagccaacagcagttaaaaaaaaaaaaaaaaaaagacaaagaggaacgttataaaatgataaaagaattactccaacagaaaaatatcacaattctaaatatatatgcacctaacactggagctcccaaatttataagggaattattaccagacctaagatgtgagatagatggcaacacaataatagtgggggggcttcaatactcctctgacagcactagatagttcatcaagacgagaagtcaacaaagaaataacggacataggccgaccgctgtggttcatggctgtaatcccagcactttgggaggctgaggtgggtggatcacctgaggttaggagttcaagaacagcctggccaatatggtaaaaccctgtctttactaaaaatgcaaaaaattagccaagcaacgtgatgggtgcctgtaatcccagctacctgggaggctgaggcaggagaatcacttaaaccccagaggcagaggttgcagtgagttgagattgcaccactgcactccagcctgggcaacaagagcaaaactctgtctcaaaaataataataataataataataataataataataataataatagacataaactatactctagaacaaatggatttaacagatagttacagaacgttctactcaacaactgcaggatatacattactttcttcaacacacagaacattctccaagatagaccatatgatagcttacaaaacaagtcttgataaacttaagaaaataaaaagtatatcaggtattctctcagaccacagtggaaaaaaagtggaaattaactccaaaaggaaccctcaaaactatacaaatacttggaaattaaatcacctgttccttaatgatcattgagtcaacaatgaaataaagataaaatttaaaaattgagctgattgatgatagtgacacaacttatcaaaacctctggcatacagcaaaagtggtgctgagaggaaaattcatagcattaaatgccctcatcaaaaagtctgaaagagcacaaataaaaaaatctaagattatacctcaagcaaatagaaaaacaagtacaaacaatatgcaaacccagcagaaaaaaagaaataacaaagatcagaacagaactaaatgaaatacaaacaaaaaaatacaaaagataaatgaaaaaaagtgggttctttgaaaagataaacataattgatagaccattagcaagaataaccaagaaaaaaagagagaagatccaaatgtcaattagaaacaaaacaggaaatattacaaccaataccacagaaatacaaaagatcattcaaggctactatgaacacatttacaaactagaaatctaatgtagatggataaattcctggaaatatacaaccttcctagattaaatcaggaagaaatagagattctaaactgaccaatgacaaatagcaaaattgaaacagtagtaaaaaaaaaaaaaaaaaaaaaaagccaacaaaaaagtccagaaccagacggattcgcagctgaattctaacggacattcaaagaagaatcgacaccaatcttactgaaactattccaaaagacagagaaggagggaattctccctaaatcattctgtgaagtcaatatcaccctaataccaaagccaggaaaggacataacagaaaaggaaaactacagaccaatactgctgatgaacatatatgcaaaaatcctcaacaaaatactagctaaccaaattcaacagcatatcaaaaagataatacaccattatcaagtgggtttcgtaccagggatgcagggatgatttaacatacacaaccaaataaatatgatgcatcacataaaataattaacaacagaagtcatatgagcatcccaatagatgcagaaaaagcatttgacaaagtccagcatccctttacgaataaaaccttctgcaaaattggcatagaagggatgtacctcaatgtaataaaaaccatctatgacaaacccacagccaacattatactgaatgggaaaaagttgaaagcattcatcctgagaactggaacaagagaaggatgcccacccccaccacctctatttaacatagtactggaactcctagctgtagcaatcagacaagagaaagaaataaagggcatcagaatctgtaaagaggaaattaaagttgtgctgttcacagatgatatgatcatatacctagaaaaccctaaagattcatccaaaaagctcctagatatgataaattaatttagtaaagtttcaggatataaaatcaatgtacacaattcagtagcactgctatacaccaacaacaaccaagctgagaaacaaatcaataactcaatcccttttacaacagcttcacaaagtaataataataataaaatacttaggactatacctaaccaaggaggtgaaagatctctacaaagttaactacaaaacactggtgaaagaaatcattaatgacacaaacaaatggaaacacaacccaatgctcatggatgggtagaatcaatactgtgaaaatgaccatactgccaaaatcaatctacagattgcaatttccatcaaagtaccatcaatattcttcacagaactataaaaaacaatcctaaagttcatatgaaaccaaaaacaagcctgcatagccaaagcaagacaaagctaaaagaacaaatctggaggcatcacgttaccctaattaaaactattctacaaggctatagagaccaaaacaggatggtactggtgtaaaaataggcaagtagaccaatggaacaaaatagagaatccagaaatatagccaaatatttaaagccaactgatcttcaacaaagcaaacaaaaacattaagtggggaaaggataccctattcaacaaatggtgctgggataattggcaagtcacatgtagaagtatgaagctgcatcctcatcgcttaacttatgtaaaaaatcaactcaagattgatcaaagacttaaatgtaagtcctgaaaccgtaaacattctagaaaataacatcaggaaagttcttctagacattgacataggcaaaaatttcatgacaaagcatccgaaagcaaatgcaccaaaaacaaagataaataaatgggacctaattaaactaaaagcttctgcacagcaaaagaaatagtcagcagagtaaacagacaacccacagtgggagaaaatctttgcacactatgtaggtgacaaagcactaatatccggaatccacaagaaactcaaacaaatcagcaacaaaaaaccaatcccatcaaaaagtgggaaaagagcatgagtagagaattctcaaaagaagatgtacaaatggacaacaaacatatgaaaacatgcccaatgtcactaattatcagggaaaggcaaatcaaaaccacaatgagataccacctgatatggtggttcggttgtgtccccacccaaatctcatcttgaattgtagttcccatgatccccaacccagtgttgcgggagggaccaggtagagataattggataatgggggtggtttccctaatcctgttgtgatagtaagttagttctcacgagatctgatggttttataaggggcttttctgcctttgcgttgctctcattctctcttgctgccctgtaaagaggtgccttccaccatggctgttaagtttcctgatgcctcctcagccatgtgaaactaagagtcaattaaaactctttcctttataaattacccagtctcaggtatttcttcatagcaatgtgagaacagactaatacagtaaattggtactgggtagtggggtgctgctgtaaagatatccaaaaatatggaagcaactttggaactgggtaacaggaagagactggaacagtttggagggctcagaataagacaagaaaatgtgggaaagtttggagacttgttgaatggttttgaccaaaatgctgatagtgatatggacaatgaagtctagtctgaggtggtctcatatgaagatgaggaacttattgggaactggagtaaaagtgactcttgctatgcaaagagactggtggcattttgtccctgcctcattcaagaggaagcagagcataaaagtttggaaaatttgcagcctgacaatgaggtagaaaagaaaactccgttttctggtgagaaattcaaacaggctgcagaaatttgcacaagcagcccatcccatcacaggcccagaggcctaggagggaaaaatcttttgtgtgttaggcccttgggacatggtgcccagcatcccaactgcttcagcgccagccttggctaaaaggggtcaaggaacagctcaagccattgcttcagaggatgcaagccccaatccatggtgactttcacatgatgttgggcctgtgggtacacagaagtcaaaaaccaaggttggagaacctccacctagatttcagaggatgtatggaaatgcctggatgtctaaacagaagtttgctttgctacaggggtcaagctctcatagagatcctctgctagggcagtgcagacgagatatgtggggttggagcccccacacaagactttggacttgagcctttgggttaatgctggaataagctaagactttgaagaccattggaaaggcatgattgtgttttgaattgtgaggtcatgagatttgggaggggccaggagaagaatggtatgccttggctatgtccccacccaaatctcatcctgaattataggtcccataatcctatgcgaggaccagatggagttaattgaatcatggaggcagtttccccacatcttgttgttgtgataataagttagttctcataaggtctgatggttttatagggagcttttcctcctttgctcaactctcattctctctcccgccaccctgtgaagaggtgccttctgccatgattgtaagtttcctgaggcctccccagcaatgtggaaatgtgagtcaattaaacttctttccttcataaattacccagtcttaggtatttattcatagcaacatgagcatggactaatacattaccttattcctgcaagaatggccataattaaaaaatcaaaaaataacaggtggcatggatgtggtgaaaagggaacacttctacactgctggtgggaatataagctagtacaagcactatggaaaacagtatggagattccctaaagaactaaaggtagagctaccatttgatccagcaatcccactactgggtatctacccagaggaaaagaagtcattatatgaaaaagatacttgcacacacatttttacagcaacagtatttgcaattgcaacaatatggaaccagcctaaaagtccatcaaccaatgagtggataaagagaatgtggtatatatacaccatggaatactactcgtcataaaaagaatgaaataatggcattggcagcaacctggatggagttggagactattattctaagtaaaataactcagcaatggaaaaccaaatattgtatgttctcacttgtaagtgggagctaatctatgaagacataaaagcataacaatgatataatggactttggggacttggcggggaagggatggggtgagggataaaagactacgtattgggtacagtgtacactgctcaggtgatgggtgcaccaaaatctcagaaatcaccactaaagaactttatgtaaccaaaaaccacctgtaccccccaaaatactgaaatgaaataaaaatttaaacattgtgctttctcagaaaaaaaatgacaagacgctgtaaaaatttttaattattttataaaatagatacatacgtgcatgtgtatttcttttcaaatctttccaaaatataattttattgaagaatagtatatcaataaataagttacagcatgctacttttctgctcaaaatcctccaatgccaacagttgcttgttttcctttgactacaagccagatctcttactatgacacagcagactgctggtcatgctcgtcccatgcccaaccatttctaactcccgcttcttcctattcttccttctgtcactcagtggactctttgtatacctgaatgatgccgggaaaattccagaattagaacatttgcatttgtatttcttctgtctggaatattttccccaggcattcacatggcttgctggataactaccttacacattcaaatgttattttctcagtgaagccttttgcagcttttgctgtatttgaaaaggcaatccccattcacagggtctatacttcccttccttgatgtagcttttctcccagccattatcactggcaaactatatatatatatatatgtttaattttaattattttgcttacgatctgtttttccgccactagaatggaagaatataagctccaaaactttttttttttaatcgaatttttaaaactaactttgagacagggtcttgctgtgttgcccaggctgatcttgaattcgtgggttcaagtgatcctcctatctcggcttcccaaagtgctgggattacaggcatgagccaccacaccctgcccaagctccaaaaatgtataaatgcttattgcactgtggtttccttagatacattccctagatctgtatctgtcatatcgtaagcactcaataatatttgttgaatgcatgggtgtgttacaaaacaaacatataacagataatgcataggggtttgatagagaaatgtttgtggtgagaggggcagaagtagagtttagggctgagaagtcactaggaacaaatcagtagagactcttcaatctcagcaaataggtaatatttttaaagttaatgaagttgtgtaagatagagactgtaaatgggtgaccatttggttttatttgcttaaattaatgcttgcctttatgaccattatattgaaaagacgtttatgaccctttaaagaagacatcaggtttgaaggctattccatcatgagtcaaagaaagatttggagtactactgcaggacaaggctcttgatagagatttgtgagaaaaaaaataaaaaatggaagcagtgtcagacactagaaagttttatgccagaggctgactgtaacagaaaagatcaaaaccaatctaatttaattaatgtatctttaattaggtgaaggtaaatctgcaggtctggacacaaatgacaaacagtttatcatcagaatcatgtcagaaagtgacagaattactaaaatatgatgtggcttctttgcttatcagaagaactaaaggaaggcagttacaaagaggctaaaggtaaaactggaatatatttattctacagaaaatatattaccatgggggacactgtaactgaacttttctgattgattcaagaagagcaaactggaaagtgctctagcagagagggatgttgttatagatgaaaggggtttagagcctagaagatgaagtcacttgtctagagtctcacaggatagtcctgaccaagccagaactgggaccaaaatgactttaaactgttcctagattgagtagcttggatctatttaacttttacttttttatttttttattttcctttaagttcttggatacatgtgcagaacgtgcaggtttgttacatagatatacatgtgccatggtggtttgccgcacctatcaacctgtcatctaggttctaagccctgcatgcatcaggtatttgtcctaatgctctccctcccatttaccctgcaccccccaacaagccctggtgtgtgatattctcctttctgtgtccatgtgttctcatttttcaactcccactcatgagtgagaacattaactttcgttaattcctctttctactcaactaatatttctgaagccctactatgtgccaattattgtgcaatctctgctttcttaacttttaatgtggggggacagactttaaaaaaataaaatgtgtgcaagtaaaggggagatgaatgctagggagaaaattaaagcaggaagaggaggcagagagcagctgtagaataggaaaggaaaggctggcactggaagagaagaaggagtgggtcctgagggtgccgaggaaagacaaaggaagcagcaggtgcagaggcactaaggagggaccctgctgatgtgtttgaggaatgaaaggtccatatggctggtgccaaaggagcaaggagggaggattgacatgtgagggcatagaggcggggaggagccaggtcacggagggacttcagctgttttaaggacttgacttctactggaacaagacccgctgccattgaaggctttgagcagagtatcagaatctcacttatatttgaaaaacctcaccctgactcccgtgttgagtgtagatgtgaggaggcaagggtggaaagcagcagactggttaggaatcaggatggctttaaccctagtagtggtggtgggttggcaggaggcgtgttcaaattttggaaatacactgaaggtagagcagagaggattcatgggcaggcttgatgatgaatgcagaagaaagagaggcattaatggtgactcctgggttttgtcttgagcacctgaaagaatggagttgccatgtaccaaaataagaccaaatgaggaggaagttcaataagtctcttttaatctacagcacgctctctcttgcgctctgtctctctctcaccacttctttcctctctacccacttcctttgcaatttatcagttgataaaactatattggtctatagagtttcccacgggcagggatttcatggagtatttccctgtgtgctatttaatatgttcctctctcccttataaattctggaaatccagaatttaggtctatagacttggtcaaattcatgcttgatttttatcaatagtacattacgtgtaacattgattgtgtattttcatccaaaggtgcatcatgtgtggtttcacttgtggttatattagcagccattgataatcattgcttagatcctactaaatttgtcagaagttaggaaatcatgatactctaatcccaccatttagtcttcttttatgagctgaaatatctccataaagacaatatttggtttcattaaggttcctataacaaagaaaggccaaaggcttgattcttctctttattcgccaatattcaaaataatgagttggttacctagcatcttccaaaattaaacatttttaacaattttaataaaattaaggatttaaatatatttgatatgcctcaatccattgcagaatattcttgttgatgttcagattggcccatctttggccctgggtgtttttgaactgccctcagtctctaattgcttctttttttctactgggatatgttcctggctcatctttcatcttgcacatttccagccgtagaagccatcatttctccagggatcctagttttatcttagaggaaatggtatttagtgatcacagtctggtgcacgaggtcagtccttgtgtaggagctttttcagtgcacagaggcaagacatatgccacatttaaaattagataacattatcttaggttcttagagatgcttctaactaaaatttaaaagtatatggagcttttatttaaccttatctattttatatctgcttcttttctcgcagtgaaattttcagggtcaaaatcaccaagataattagtcacttgctttattccacatgtacagaacatttcaatagcagagaatgcaatgtctaattttgcctaaaaggtcagtgtgaagagaacatttgttgacaagatgaggatacatattctgatgagagcaaacaccatgtaggaagactcagaggcttgaaagagagcatagttcatttaggaaagagaaaatcctgttccaccagaggaatgatggatgacaaagtcagcaagaagttgggacataatgagcctgatattcaatgctgcagatgttagagcaccaacaagatacaaaagctttttttttttttctttttttgccttgctttcaggaggtatcttgcatttgttttcaataaaaatattactttcctactttgtcctcataagcagaacttagggatgagcaaagagcagggggttttaaggattgctctccttaacactgttctacaccagctcagtaaaaagaccatttaagtgtggctcaattattttctgacatttggagaagcatttgcatactaatgatccagggtcctggttgtttttctccccacagaggacaaagtgtggaccatagtgtctcatgacttgcagatgcagacgcctgtggtcggctacaacccagaaaaatactcagtgacacagctcgtttacagcgcctccatggaccagataagtgccatcactgacagtgccgagtactgcgagcagtatgtctcctatttctgcaagatgtcaagattgttgaacaccccaggtaggctgagaatggaatgttacttttaatcactatctcagctggtgcttagaattgcctaaagaatccaacaggtgtggttcattatcttatagtctagtcttcagtaggaaggaagctgtaaataagtaaaataaaatcattgggcttgttttctggggaatgaagctaagaaagaatgattttgaggaaaaaatagtccattgttttaaacttacggatttttaaattgtatgtgcatatatgtttctagtgcttaactgtcagtagtggctgtgggacaaagtttatcagagctccttgtgaacattcaagcaattccctttgagagcttcaggtgtctttattgtaaagatgaaagcattctaaaaattgtctacagccaaataggatatagaatagcgatagaatttagagctctttcttcccagtagttgcttcacagtacctgtttgtctcaagaagtctagcctgattttttgttttcatgatggccaacttttagcatgtgctagtgtgtgtgtgagtgtgcacatgcaaacacacatacatgtgtgcaagactgtgtccgggtgtagagaacagagagattccaaaagatatactggaaataactttactgcaacaagttccatatgctctgggagtcttggcagtaaattcgagatgttgtcagaaaactgcatctctgtgtctgtagtaaaacacagtggaaataagtcaaagaaacatgagctcataatttccaaccttaccacttcccaagtatgtgactttggtggagtgagttgacctctttttaaaattttaccttaattgacaaaattgtatatgtctttcgtgtacaatatgatatgatatatatatatatatagtgcaatggctaaatcaaactaacatatgccttgcctcatacatttattattttttgtgaagcaaatacttaaaatccatgcttagcagttttcgagatataataaatacattgctattaaccgtagtcaccatgttatacaatagaccttttgatattaagcctcagtttccagcgactttttctgtcaaggagaaattataatgcctacttcagggtgattgggagaatttcataaggtaatatactaggtacttataagacttgatacacttaaggacatgataagtagcaagtagtatattgattttttaaaatcatgttaagcaactttgtgctatgtcagagaccaatgggctgttggatgccccaaaacagcaatgaattgaaagcaatgttgtagggagcagtttacagagaagagttataagcaaacagtgataaggctccgatgactgaaggaacaccaaggttcttaatctcacgcagaactggataaaacgacatggacatacgtggagtggttttaaggagaggagagtttaacaggcaagaaagaaggaaggaggaaaaaaacagctccctcatacagagacagagagaggaagggattccaatgagagaaaaccctgtgtgtggtggtaaagtggctgcttatatgaggaggctggaggaggtggtacctgacttgcatagggctcagggaattggtttgaccgggcacgttattcacgtagcccagggggaaaactggccctcccaccctagccttttaatatgcaaaggcagggcgccatgatgctctacccacatggagatatgtgggggcggccatgttgccaggcacatgtgagggcaaggaagaacagggcaggaatcgccatgtttgggtggacccagtttctaatggccggtatttgcacatcaaagcttgccggcctggctctaagagcgggggctttcctgctagacaagaaacattttggagctgctttaaaagaccccttttcccctctatgtgtctaaaataatttcttaataatttcttaataacttctataacgatagtacacaatattgtgaaaatgtgagtgctttctatgtgcaaagccttgtgctagaattatagacagagtaccctctaagaaataaggttggaaaggagggtgggagtaaactgggaaggaaagtaaatgctgtgctgtggagttgggacttcatccagagggccagtacttctcagactttagtgggcattacaatacctggtgagataataaaacctgctttgctgggctccatttcctgagtttctgattcagtaggtctcaggtggtgcttgagaatttgcatttataatgagtgctatggactgaattatgttcccccaaattcctgtgttaaacccctaacacccaatgtgactatatttggagatttggctttcagtaagtaattaagattaaatgaggtagatcataatggtggggtcctagtccaataggattggtggcctcaggagaagaaacagagctctgtcatgtgagggcatagcaaaaaggcagccacctgtaagccaggaagagagccctcaccagaaacagaatcagccaaaaccttgatctttcacttcccagcctccagaactgtgagaaaataaatttctgtcattgaagccactcaatctatggtattttgttatggaagcctgagcagatgaatacaatggggttccaagtgatgctgatattcctgctctagagaccatgctgagaaccagcacaactcttttttctgttcactttcacttatcataggtgtgtgtgtgtgcgtgtgtgtgtgtgtgtgtgttttaactggattctgtttccagtgccaggaaaagtcaaagactgtatgtagaagaccaagggcaataagagccactaatgaacctcatcagcttgtcttcactgtttcatgagcggctgctccttattgaagcccttttcacagattccagttaattagtcttcagtcctggggtaggggtggaggtggggacaaattcctgaccagcaaaagaaccttggtactctcagctttatgttctttattttctttctttcttgtattaaactccaaagtcagctttcagtttttgaattttgctctggtaattaaaaaacacagtatggcttccaaatatgttcaacttacggttgaggtaccaggagaattagactagaggtgggaaaatagttcacctttagtgctcctggtcttgcagttcagcatctttctttccccctcattgacattccttgtctcttcccctcggccaccgtgaagcctcacacacataaccactctcctttacaaaacataaaatgtacaaaacatcaggaaaaatgggataaacttgttattaagcactctgttagttgcatttcctaataatgagatgaagacatttttctttaacctctagatacccctttcacgagaaaaactgctaaattgaaatcaagagtaaacttttaatctgaacagtaaatatatcactttctttgtatttctagacatctagacactgggtttcccatcatttgtagattattattgtacataataaataatacttcaaaaatcagtttctcataagcttcttgcctgtttggacattctatatatatatcaaatctttggttcacataggatttgtacttaacaaatgtttgctgattcaaatgaaatgaataatatatagctttaagtgttacctcacccaaccttggggcagtggtttaagcaggagtgtgcatcaaaatttttaggttgcttgtcaaaatgtggattgaatggccttactcccaggctttgatagagcttggttggggcctcagaatatttgcttttaacaaacacccatgggtaattctgtgaatcacacattgagaaacactgtctttaatttatggcatgaaggtttctcatgttggaatttaaggtgttagtccttcatgtgggagaagattaaagggaatattagggcttgtctgacccattgaaataaaatggcatacatagttacctccttcagctaaaataaattggcataataaaaattttaaatccttctgatataccagtctctaaatatcgtaaagtgaatttcagcttacccttctgagtcattttttacactcccaattttcattttccaggcctactaatctgcagaatagctgacgcaaggaaaaggagtggttgagacagcaagttccttgtattgttatattttgcatatgtcaaaacaagaaagaacacaatttaataaaaatctttaatttgtgttttaaagaagctaatgtttactgtaattgatttttttttcctccttcatggtaacattcaattttaaatatccatttacttattcttaactaagactgaaattatattagaacttctgtagtagtacttgtgacatctgttcaaatacaaagtatattcattatagtgattgcaattaaaatgaatatcaaatgagtttgtaatagctttgcgcttaaaatgttattttttattttaagagctttacgctcaagagttcatttggggctctatagtttctaatgatacttatgataaagagttgatattcatatggacctcatttttattttgataaatattcttttataccataccattagctagtaaatgtaaaattacccattattagtatcttccaatttttacaaggatagtaatacatgccttgtaatgtgctctcttttattactacaaaacttaaaaatggaaacaaattaaaaataatgattttgccagtatttatggtcatgtccattctcgcaatgtaactgttacttcagttgtcctcagctttacaaaatacacagaaatggaaaaataaaaagttattttattttacgtagaaaagcctgcttagaatgaggcataccaatttgggaatcaccaaattagttctacccaaacagagaaaaatcattaatggtcatccaaatggatgtctacatgatttatatttatatccccggatttgtaaatgtaatattaccttaacttatgaagggctaaattagtgaacagtgaaatctacttctcaaataagtaccataagaacttgaatttggccgggtggggtggttcaggcctgtaatcccagcactttgggaggccaaggcaggtggatcacttgaagtcaggagttcaagaccagcctggccaacatggtgaaaacccgtctctactaaaaatacagaaaattagctgggtgtggtggcatgcacctgtaatcccagctacttgagaggctgacacaggaaaatcacttgaactcgggaggcagaggttgcagtgagctggtatcatgccactgcactccaacctgggcgatagagcgagactctgtcgcaaaacaaacaaacaaaacaaaacaaatcttgaattagataaatcaagcactgagggagttcccttagagcctacttgagtagtcttagtcaacaatactaatacttttagataaccaaaatgtttctctgtatttggacaagaactattatgctgccattaaaatgtttatttgtgtatcttacatacattgtagtcatatatttattttacaaatcatattacactttctagttaagaatttttttgctgaagtattgattccttacatatatatttatttaattgtagagataaaaagttatcttccctatttttctggctatatttagccctgttttgttggtttccagtgtttttcctcttttaatttttcagtgttggctagttttcatgaatgatactttttactgcttcttttgttgaaagaagcaatataaattatatatatttttggatagtttactattagattttgtatctattgaaattgaattatgcttacaatttttgcctataaagtaagctgtgtaaaattcagcatactttatgatactaaactgtgatttagtggctttgaaaagacaagaaaacatgactctggcattgtaacatataatctatttttagcaagaaattctaaactttggtgcggctatcaagcaaatgaatttcaagttatgctgtgcattataagaagctgcagcatttaactcttaagacgacatggataaatcaattccaataaaagatttttcagtaaataaaatttattgtgactaatcagtgtattaatcagaagattatttacttaattattatacccactcattgtattaaaattgggtgatataattaaatgagacaagcaacgaggatagtaataactaaagggtaaaattagaaaattgtatcgagtaatgtttcatactcagacaactagcatctgcatgatgggcactgtaattgaaggggacagagggattgcagggagaagagtaagcaactatttcaacaatatggataggagttgatgagaacctcaactggaataatgagtaggagaataagtcaacaaatattttttagttttgcctgtgtatcaggaagtgtgacatataagctgatatgggaaagattcatatgagttaactaagaaaaaaatgagagaaggattctgggttagcgatgtcagcatattcaatgattcagagatggagatcaagagacactaatttgaaggaagtgagaggcgtcagaatggctggagtagtgaacttgaaggtgggagaggcagaaaaatggaaaccggaaattaattcagagtctctacctaatgttgaggattttatttgaatggcaaacagaatgatttcaagtagggaagttctggctgttccatggatactggagtggaggaagcagaggtggtgggaagagtctgtccgcaccagagtgcacatggactgcatgtctgggaggccagctgggacttgagagaaagtttgttgttgttgttgttgctgttattgtttttaagtttagatgctggaatcaacaggagttgtgattacttatatatacaggaggaagaaaattcaagggtgactcaagtttctgacttgaaaaactggccaacagttctaaggcttaccttgtttattaagaaaaaactggagaattggtggtcacttagctttaacatgcaaagtgatggcactaggaatacaggtttttatgtgatctgtgatggctgatggcatagtgtaaaatccttttaactgacatcaaaagattaatgaattaaattttttcttccttgaaattttcttaaacatactctacaactaaaataaaatggaagaactaagagtatcatcagaatcctaatgttttccattcttgtatttatattgaaagatcagaaaacatatagtcaagactgacctatctcaattatgtaccaattttttttttcctcatgcaaagcctcctgtattgcttcagcttcctgggctgccttggtttcatggcacctgcatgatgtctgaagcaagggaggagcaggctgcaaacctaagcgcagacaattaaatactcctgcaaggaagtaacacgttgtgtgtgtgtacattttatggaccaaagcaagtcacatgttttgctgggcctaactttagaagaggacaaagtacaatcttcccatgtactcaggagcaaagatcacgtggacttattgaatagttgtaatgccttcttaagatgactcagagaggtaatgggaggagaaagaaaagaacgcagaagaaaagaaaaatactaattttgtttatttgtttgtggatggaatgttattatgttcactttttttttttttttgagacggaatctcactctgtcaccaggctggagtgcagtggcatgatctaggctcactgcaacctcagcctcctgggttcaagtgattcgtgattctcctgcctcagcctcctgagtagctgggactacaggcgcatgctgccacgcccagctaattttttttcttttttttttgtattttagtagagacagggtttcaccatgttgcccagactggtctagaactcctgagctcaggcaatctgcccgccttggcctcccaaagtgttaggattacaggcgtgagccaccgcgcccggccagttcacttttttttttttaacgagggtcagagataaagagagactccactcaaaggccaatttcaatgtaagaggacacccttcttttacagattaactggtaagcaaaaaaataaaataaaaaataaaaatactggtactacaattatttgcttccttatgaaactttctacaattcttacccacggtgatcaccattttttctgaatttctgtttcacttagggcctaacctctatcacttagcagttgattatgggctattcatggcttttcttgctcttcattgttttctggtgttttaatgggctctttcttacaataacacaaggtctttgaggacaggggccatatcttagtatcttccatcatgcccagcttctagacatctacctagatagtgaataaattagaaaaacactaattttaaaaggggactaaagaagaggatgcagctagctaaaggaactgaaaagttattaaacagtaggaagaaagaatcagattaggaaagtcctataattgggaagctaagggagatgggtatttaacaataaacaggcaagcaagtaaaaaaataagcaaaagcaagaaaattgaggtatggtgaatggtgagacatcctagagaggaagccatcccctgtcattatctgttgggaggctgctggagtttcatgtcagtggagtttggtggattgagccactgaagactgcatggggaaaggaaagagcaggggtaagttttcaaaaggttgatggtacgaggatggctacatgtagaaaagctgcttaatcagatgacaaagcaagagtaggggtttaaaaatgtttgatatttttagggatgaggagttgtaagtaaatttataaactgagaaggagacattggagaggttcagattaaagatgtaagacagaaaaggaataataggtcccaggagagaaagaagagtgtagaatttgctttggtaaagaacaaggacacctgtttcaagaagggagctaaagacaagggcagaagttctcattaaatgtcttgaacaataccattctagacatttatctcatttaactctcaaagttacgcaaagtagattttattatctctgttttgcaaaataggactcagaggaataaacttactgaaggctaccatattagttcattttcacgctgctgataaagacatacctgagactgggcaatttacaaaagaaagagttttaatggactcacagttccacatggctgaggaggcctcacaatcatgatggaaagtgaaagacatgtctcacatggcggcagacaagagagcttgctcagagaaactcgcctttataaaaccatcagatcttgtgagacttattcactatcatgagagtagcacaggaaagacctgcccccgtgattcaattacctcccaccaggtccctcccacaacacgtgggaattgtgggagctacagttcaagatgagatttgggtgtggacacagccaaaccatatcagccatcattgctggaagtggaaaaactgagtttcaaatgtatatctatcctattaaaaacctttctgacacactgaagaaactgtgaacatggagaagtcaatgcttggccaccaaagtgagtatagaactaatcccggcaggaattgtacccaccctcatctcttcaaccactatgaaagaacgttttccctcttgtcattttcttttttgtgtgcatgattagaaatgctatttaccaagtgacctttggtcagttccagtatttctgattaataaattaatcttaaggtaaattttattaagggtagctcgagttgtactaaaagggtactgctagtgcctttcaagtggcagacttgagctttgaggtgagactttgattttgtatgtagcttagtctttaaaataacaaatataaggatgaaatggaaactctgtgaggttatccagtcactctgtagagcttgaaaatctgccttctcatgtctttctgtttaaggtagactctaaccttttgattctgaaaagccatgttcaaataaatacttattctagtatagaataatcataaagcaaagtgaaaatgcaaagactgcatgagaattatgggtttcatgtttatttctccttgtagttatctggctatatgttttcttaagttttcagacgggataccacactgctgttaatcttttttaaacaaagattatatattaaaatgagagcaacttagaaattacaccaaagctgaattttctttgaagatgatcacatcttaatgaacggatttgtcctaatttatgagaagtatgagtttatagagttgcatttaaactaaacttcaatatattaaaagaccataaagccaagtttttaaaatttgcattttagtttattatattataaaagattgtaaaaatgaagaaacggctattatccaattcaaaaaattaaaaaactacttttggactatttttcaaaattccatactacttactctgccattctgaataaaaaaagggataatcataaaaagtcttctaaaaagattggatagataaaaaaaaatgtactttaaactttgtgaaggataaaataatgtaacaaaatttaaggagaaaatttttaaaaagtactgacaattttattatttatctttatgaatattactctctagtttttgcttccatctgtacatactttcacagaaacaaaactggaatgaagttaatctgatagtcttttctactgacattaaatcgtaattttttccagttcatatattttccttaaaattatccactttaattacatcgtaaaatgaagataaacttaattcatcacctgataaacctaatcgtaaattatttttgaaaatacctcccctaaacaagatactgaaaaaaagcatcagagttttacaataaacttctcttggaaatacctaaagtattactaagatattgctcagttattcattctgcaaacatttattgagtataaaatatttagctgggtgctatgagaatacaatgagggtaaaaataatacagttgacccttcaacaacatgagtttaaactgtgagggtctgcttacatgtggatttcttctgtctctaccacctctgagacagcaagaccaacccctcctcttcctcctcctcctcagcctactcaacatgaagatatgaggatgaagacttttataatgacccacttatgcttcatgattagtaaacgtatgttctcttccttttaattttcttaataacattttcttttctctagcttactttattgtaaggatacagaatataatatatataacatataaaatgtgtgttaattggctgtttatgttatctgtaaggtttctagtcaacagtaggctattggtagttaagtttgtggggagtcaaagatgtaggtcaatttttactgcacagggggttggtgccccaacccctgagttgtttactggacttttaaatagcatttgccttaaaatatagagtgaaattttttttatgatgacaataaaatcattttgtataagacttataaatactgaaaaaatcttaactagtatgtccatcatggataaaagactgaataaatttagaattcataatgacttccaaacattttgatatgtgtattttgcattaggtaattctgcctcccctgtttgaagaggttatatttggaggaaagatgaggaaggcttaggaatgggagaaaatagggtctcagagtactattagctgggatatcagttcaggttcaaccggagaaacagaacaagtagaagatatatttagagatttattgcaaggaattggcttatgcaacagcggggcctggcaaggcaagtcggaagctggggcacactatcaggaaggaaaggctggaactgccagacacaaactgaagctgatgtccacaggaggtagttcttcttcaaggaagtctcagctctattcttaaggcctttcaactgattgaatcaggcccatccagattatctagaatatgctcttttacttaaactgtaattacatttacaaaatgcctatgcagcaacacctggaagagtgtttttttgaataactggaccccgtagctaagttgacagataaaaccgaccatcacagtcaacaaagatgacttttaatatgaactactgataaatctatttctagaatagcaatgatttattccctcatttgtatcacatatgcctctctaggtcagcatagtcaggtgagatccacctattacaggtatggagggatcttccattgtcctatcttttcatttctaatgaagatacagtttggttgagtgtcaaattgccaaacaaagttagaacaatggcaatttgagagaatcaagtagatcaactcagggagataagtcaaaagacaaagactccttttctctgtgttgtttcagaaaagttggctcagaaaagatggcttcattccacattttaatgaatatggcatgtgtccattaactcctcattctcttatctaaagggaagcacctccattgagccaaatacaaacatcctctttctacaaccttcggaaagctgcaatgtagccctatcttgccatcaacattcctctgcaatgttttctaacttacagttgaatcaagttccactaccatgcatcataaaggtaatgttaaagatgctcagagaaatacggttgaagaaactcatccttacagaagcacctatgaataaaataatccataaattttatttcagagactgtatctttcccgagctagtattttcccaccaatgaatgataagacttctctgaaatactagtaacactgatggaagttggattctattacctattgtttgcttacaatttaccaacaccagtggctgggtaaatagtttttataggacaatgaataatgttgcagagtgttagctgactaggaatgccacagccattatgaccttcatcccgtatcttaaaatctctataaaaacatgctcaggtattttttctctcttggtattggacctgaaattcaggcttaaaaatatattgtcatctatatatctagataactaatgcttaataattatctccaaattagatcatgatataaatgaagggagaggaaatagcagtagtatttattaaaggttcacctgggcattttatatatattggctcattccgccccaaatctctgtgagttgtatatcggaatttctattttatatctgaggaaacataactttagaagggttaattaattcacccaaggaaaaacagtaaataccgtgctgagagtccaaaccaagattaaaatctaggtttatgtacctctagactctatatattttctacctcaagaagttagaaaggaaggaaggggggaagaaaggaaagagaaagaaaggaagggagggaaaggaaggaagaaagagaatgaggcaacctaataagttaatcagttggggaatttttaatttcttatattgaaacattaatatgggcttccagcatagttaaagacccaaactttatttttttgttgttttgttaagtagtaggccaaaagagacatttataagagctgcacaaacttctttctgaaaaatcctacctttttatgttttttcaatatccactattggccctgacaagtatattaaaaaatatggtttatataacaatttgtttgaaatgatattgaaaaacatttgatgtgaaagaaacgaaaaaaacatgcctctctctacagagcatttgactttcatgtttttaatatcaaggtatttcaaatagaacatatgaattgtatattgattaaatagaaaaatgctgtaaaaggttatccccttcttttcagacataagatatggaaacgaaatgttgatgttttctttctttcttcttcttcttctttttttgatcttttcagaagaaactcttatgtctaagcctaacacaagtgacacatccagtgtttcattcttaccttataaatttgcttttgatagagttctccgagatcctgttaaaacgagaaagatcagaaatcaccagcttggcagagcccggtgggcagcacctggggggatgaacagcaggacactgatacagacatgaaattcaactatcagagatattgagacttactccattagggtagggacttgcttcctgtcaaaaacaaacaaacaaaaatatgaaatcaccctcagttcgattttgtaagtaggagggagagcagactagaggaagaggcactaggggaggaaccacgctgaggagcagaaaggagggcactgggtgtataagcagaggggagggaggtcctgcgcaggaaggcaaggccctggtggacagcaacagcaactagaacaaacagtccactctgcaggtctgttcagccagcctgttggctatatttagtatttcataaattttataaactcatgttactttagttggctcaaatgttaaaatcaattaatctttctctttagaaggcagatatttaagcctacctagaaaccaaacatattttattttgtttttatttcaaaatctcaaaatggtgaggtaatcaaggcagcaaaattaagaggatcaacattatgagacgttgaagtataccaaaagaagcttaatatgtaaacgaggacaaacaggtttctgctccattaatcacagttataaatttgcataaagagaactgggagaacaatttataaggttctaatgtaaatataagaaatcttaatgaaatggtatcaaccaaagccgagaaaaagtgtgtacctcctaaatgctggttatgctacataggtctcttagattttcacaaatgacttgaattttggaataactagacaaatgttctccaaactaataaaagatggccaaaaggtagattaatatagtaaaaaattataatatacttttttggcatcggaatgttctaaaataattgtttaaatataggtgttagcaatatccaaaaatatattctaaacctgatgacgaaggtataagataatcaatggcaatgatttgtctcctccttctatccctgagcaatttcttattctttttccttccagtctgggaataaaccactttctttgtttagccataagaaacaactcatccattaaagttttatcatgagattgcagcaattcagttacatcttcagactccatttctaatgctaattcttttgttatttctattacattcgcagtgacttgctccactgaagttttgaacctctcaaactcactcatgatgtttggaatcaacttctttcaaactccttttattgctaatatgttgatttcctcccatgaatgtttttaatggcttctaggatggcaaatccttaccaggaggttttcaatgtagtttactcagatccatcaaagaaatcactatccatggcagctatagcctagcaaaatatatttctttttttttttttttttttttttgagactgagtctcactctgtcgcccaggctggagtgcagtggtgtgatcttggctcactgctgcaacctccacctcccaggatcaagcaattctcctgcctcagcctcccaaatagctgggattacaggtgcccgtcaccatgcccggctaatttttgtatttttagtagagacagggtttcaccatgttggccaggctgatctcttctgacctcaggtgatccacccgcctgggcctcccaaagtgctgggattacagacgtgagctaccatgcctggcccatatttctttttcttttttcttttttcaaggcagagtctcactctgtcacccaggctggagtgcagtggcacaatcttggctcactgcatcctccgcctcctggattcaagcaattctcctgcctcagcctcctgagtagctgggattacagacacatgccaccacgcttagctaatgtttgtatttttattagagatggggttttatcgtgtttgccatgctggtctcgaactcctgacctcaggtgatccgcccatcttggcctcccaaagtgctgggattacaggcgtgagccaccgcgcccagcctattttttaaataatataacttgaaagtcaaaattactcctttgtccatgggcaatagaattcatgttgtattagcaggcatgaaaaaacattaatcttgttcatctccatgagggctcttgcctaaccaggtgcattgtcaatgagcagtaatattttgaaaggaatatttattattttttctgggcagtaactctcaatgggcttaaagtattcagtaaacctgttaaagttgtaaacagatgtgctgtcctccaagctttgttgttccatttctagagcacaggcagtgtagagttaacagaactcttaaggatcctaggatttttgcaaaagtaaatgagcactggcttcatcttcaagtaacctgctgcattagcccctaataaggggctgtcctttgaaggtttgaagccaagcgttcacttttcctctttagctgtgagtgtcctagatggcatcctcttccaatagaaagatgtttcatctagattgaaaatctgttgtttagtgtagccaccttcatcaattaccttagctggaacttctaggtaacttgctgtagcttctatatcagcatttgctgtttcactttgcactctcacattacgaagaaggcttctttcctaaatctcatgaaccaacctctggtagcttcaaatttttcttctgcagacttctcacctttctgagccttcatataactgaagagagttagggccttgctctggattaggctatggcttaagggaatgttgtggttggttctatgcagaccactaaaactttctccatatcagcaataaagctgtttcacttttctatctttcatctgttcactggagtagcactttcaattgcctttgagaatcttttctttgcattcacaactttgctagctgtttggcgcaagagggttagcttccagcctatcttggctttcgacatgtcttcctcactaagcttaatgatgtctagcttttgatttaaattgagcgatgtgtgactttctttcactcgaatacttagaggccatcttatggttatgaacagggctaatttcaatattattttgtctcaaggaataagaaggcctgaggagaaggcaaaagatgagggatcagctggtcagtagagcagtcagaactcacataattatcaattaagtttgtcatcttctatgggcacagttaatggcactccaaaacaatgacaatagtaacgtcaaagatcactgatcacagatcaccataacagatgtaataataatgaaaaattttaaattttgaaagaattaccagagtgtgacagagagacacaaagtgagagcatgccattgaaaaaacaaacaacaacaaaaaaacccgatgccaatagatttactcgaagcagggttgccacaagccttcaatttataataaagcatatgatctgtgaagcacaatgaaatgagaatgcctgtgtatatctgaagtcacccaatggaggatgtatcagtgcctatgtctctgtgtgggaacataacatgatgtgtctgtgtgtgtggtttaaatatataaataacacacacacactcacaaacacacactcgtggtttcaaaaagaaactactcaagcacaattcttctactcaaaatgtccctgaagtgagacatttagctctgatgaacttctatactatgtggggcagacttcttgaaaataacaatacacagagcttatttgaaaagcaaacaaatcagattacttatatgctataggtgtttgctattaaatttgaaaataacatatgtggggagaataatcaggctgtaggtaactaaaagttgactgtcatcactaaattaactacaagtgaatccaagattaaaagtgacagaggcagaaaaaaataaaaatgaagtgtaatgtcatacagctgaaaccagagtaatttaccaagagcagatacaaattcaatgggaggggttggcttcggtgaaatatgggagataaagatctaaggtaacatagactaaatgtaaattttaaaaaatgatctgaggtgagaatgttgtggaaatatgtaaccaatatttttaagaactgtttttttccatcaattcaacattgctgttatcctgtttctagtttcaccttaatatagaaacaaagcaattccagtaagatatataaaatatgtgcaggcatgattcagaggaatagaaaaaagaatgaataatttgaggaggaaaaatataattggggttatatatgtaggataaaggtatataaaacaagcccttaaaaataatgttaactgccttgaaaatgttatttttaatgagaaagtagattaatgaagacattggccttcacttgtattagaaaggatttagcagagattttatctgaagcaacttcttagcatagtgtaaatgaaatatttgcctgagtatcgggtttagaagtttcactgaaaggaaaagaaacttgacttgctgcctcaaattctagtagctgaaattatatgaggtgaagtttccaacgctgtctcttaagatagccgacctggccgggcgcggtggctcacgcctgtaatcccagcactttgggaggccgaggcgggcggatcacgaggtcaggagatcgagaccatcccggcaaaaatggtgaaaccccgtctctactaaaaaatacaaaaaattagccgggcgtagtggcgggcgcctgtggtcccagctacttgggaggctgaggcaggagaatggcgtgaacccgggaggcggagcttgcagtgagccgagatcccgccactgcactccagcctgggagacagagcgagactccgtcccaaaaaaaaaaaaaaaaaaagatagccgaccttaccttaatgaattttccacaaacctaagtcagattctttgggcaaaacttgacttatccacagactctagttcaatcacaagcataatcacagtctgtgagactgaaatccataatcaaaatgccattaaattaacttaaaacaagaagactaactgctaaagggagaggagggtctggccaccacactgtgtgggtaaggtatatggagagccaaattgtaaactaggatgccagtgtattaatttgtaatgaaaaagtgtattgctgaaaggactggacacttctgttctctaccccgccaaatctccccctgcagggctaccagatgggaagccaaattaaaatcagatgcttgcttcttgggcttggaattggaacaagaggagtaaatgataggattgcaagttcagggtaacaggtcatctttggactgtggagccctttctcctaggctgccgatggctatgcacaaacttgatcttgtttactgtgctttcccctccagcttcccactgaccctttgttttttctatagttctgttaatgtactcaatcaggctacagtggggtcttgctggcctgggagctatttagttctctttgtggtaattttgttcccatctttccactgagtgttgatattttagtttaactcacaaggcacaatcttatttttggaactcttcagggaggcccccctcaacccagcactgacgatgtaagacaacagagatgattgcttaaatgttttccaatcctacatctctgtggcaaaaagttttttaacactatattatggcacacagataactgaatttcctttccaaagagtagaaaagacaaaggaaaggaaaatctgggtggactcagaagatgtggcctctataaaactaaatcctcaatcttttctcatttctaagaaggggaaaaatgatgatgattgagatgttggaattcattgtcaggaaacttgaatttttgctccccatggagatcaaatggaatatgcagatggagtactttatttcttggtagcttttatagatattttgatcattttcttcatattagagatttcaatttgaaattgactgtgaagatatagaaacacatgctcagcagaaacgtcttacgacatattaaaccattttctccctggaaactgttgtgataataaatactaccaacatagaggaaaccactggggtggataaaccttattatctatctgtgcattattgttaaaaatactaaaatcaagccatgtgtgttgcatggagttctactggaaagctatcatgtaataatacaaaggaagataagagagaagaaatacaaatgggagtgactagagagtaatacaattaatttatagccacatatattaaatttgtttaatattgacagtagatttacccctgggaaggagaagaagaaaacagaatagattttattttaaagaactcctgaaaccttaccggatgttgcctaatgaggtgatgtaacataaaacatcactcgatgctgtatttgcatactgcctttttcccctaagagattgttttgaaagaataacaaagaaacagaaatgaggtggaaaacaaaataacaaagcataaatattttctcagtgtttgcaaatattcataataatttcctatcctctgattcattagttctctcaaaagcccacctggatgtcctcagaatgcaaactgatacttaattattacattgggatctagattctttatagctatgccactcgtgtgaaaaatatgcatatctatttaagagctgtgcaaagcagtggtgatgtgagttatgccattttgctcaacacaagacaaactcctaaaaacagctttaatgtagacacaaactgttttgataaataaagctaactcttaacaagattgttcagagaagactgactttttcaatgtattcctttgtacccttttcctttcaatgtagaaccttctcttcctgctgcttcctacaaccttttcctcctacagttttctgagcaactccacttatccatagagaaaaagattttggcactctgattttcagattactcttagcccaaggtctacatatctttcccttcttcctcacccttcccaatttcacaggagacccagtgctcccttgtctcgctttaaattcttccctataataggccagaaagactctgacaccagatgcattggatttgttttctaactaaattttagtataaaaacatttaagtctagtgacatcacctcgtgcgtatggttttgcatttagtacccttcatattccattttgaaattggccattcactcattcattctctgaactggtgcatattgatcatctgctctctttaaggcactaagctaacttctatgagaggttaaaaaataagacctggtcccttaaggccagttaaagacaaggcctattaaagatttaatcttctactaaagacatttcaaacagcctttgcttaaagagaagtaagatggtaggagactggttagcctctgaaatcacattatgcctaatattggccctaaaaatatattttgttgaggtctttgttaagggagatatggggatatggggcagatgaaatcacagcatactcttcctctgtcagaattctcatgcccccctattgcacacccaccaacccaacaaacacacacattaagatataattacttatacccagacttctgtttgcaaggggctgctgtcctgcctatggctattgaaaacctatttctccatgatgtacctatctttcctgggccctttacctataatatgcacttccctcctcttccagtcatgtagtagatataatcctccagttaacccagcccctaacttcagtgttttattttgtctcaaaaatccaaatatttccatcgaatatttggtgtactttttagagaatgccgtgtcatttttttttgtaattcttcttttctaaaattcttgaattttaattttaagcggtgcatttttatttctgaaaatcaaatttggctaatgaagtgtttagcccaatccagtgaagctcagctccctctttgagccacagtctgtgctgtctaacgaaccttcactgaactcatgggtagtacaatttagtagtggtatttcagtagtacctgttgtatgcctcgacaaggctttggagaaaattcctctgttctgatttccaaattcagctcttttctctgctaattgcttcttcttcttcttttttttttttttttagacggagtcttgctctgtcacccaggctggagtgcagtggcatgacctcggctcactacgacccctgcctgctgggttcaagtgagtctcctgccacagcctcctaagtagctgggattacaggtgtgtgccactacgcctggctaatttttgtatttttagtagagacggggtttcaccatgttggtcaggctgttcttgaactcctgacctcgtgatctgcccacctcggcctcccaaagtgctgggattataggcgtgagccacggcgcctggcccattgcttcttgatataagtactagctattctacagcctgcaccatgacgtagccctacctagtagaaactttgagttagattgcagtcatcaaagccatttgcccttcctttgtctctaataaaattaccaaggacctctccttaagtagtctatcatcctaaactctcaggagatacctctgagtcttggttttctttaaggtttgcaagaaaggccaatcactcctttcttagaacatttaataccactttttaacttatttcctataataccaagatggcacacatattaatcaaaaacacaaaccctcccgatctgacataatgtagatgcaacattacacactttgcccagtaagtaccctctccacctcaaggatcctttgccctttacaaaccatgtttcaggttctccatctctatcacagcctgaagggcaatgtcccaatgtattcaggaatcatttagactatgatgggatggcacagtccctacatctgctaccaaatcaaggagctgattaacagtgcattgcagctcttggcaagagttagagtaggaaataaaattaaggtgtaggggttaggcaggaaattcagataaaactacttgggaaatgtagctaagcaagatataattatctaacttataattagactagaacatcaggcctcccatccctaaaggcttctttttgcaaagagacaagtgataccatcaggtagcagatggtattcttgtatgggtgcgagtgagtgatgaacacttcttaccttaagaatttggttgtaggaattattcctactggtgataacttgctagcttaatagttcattatttctgtgtcttccattcctttgggctagtacacttattaaattagaaaggtggggtggtctgcaaaatttcagtgacatctctacaggctagctattggcctctgccatttgatcatctcaaactatctagcaaattaatacaaccaacgaaagccgacagactacattgatttgaatataactccaatttttttattgtatttcttaaaagttctatgacatactttagtttgcagaaaacagaaagttacttagttttagagcgtgattttttttgtctcactggatgtttctggtttgtttgtttgtttgtttgtttgtttttgagaccgagtctcgctctgtcgcccaggctggagtgcagtggcgcgttctcggctcactgcaacctccacttcccgggttcaagtgattctcctgcctcagcctcctgagcagctgggattacaggtgcccacaaccacgcccggctaatttttgtaattttcgtagggacgggtttcaccattttggccaggctggtctccaacccttgacctcgtgatccacccgccttggcctcccaacgtgctgggattacaggcgtaagccaccgtgcccagctgaatgtttctgttttaaagatccttgcatgtggctctgtatgtaaccctgtccttgcaaagttgttagaaaaagataaatgaactcccattggtttaaggaattgactgtgaagagcgtgatgtaatctaaaaatcagaacaccaaaacttgtttcctctttggataagtagaattggtcaaagaacagagtttatgacttctcttcacataaaagatgacattatctatgatgaaagacctagttcttgattttcttcagattccacatggacatcttacttgctaaaagcaacgtggccaaacaatttctgcctgtagcaaattgttttcagttatgtttcctcacgaagtagtatcctgaaattaccagtttgcatactgtttgcaattattactacaaatgcagtttagcttttgtgtaaatgaatgaatttttattgtatatatttaaggtatagaacatgatgttttcatatatacatacatagtgaaataattactgtagtccagcaaattaatatatccaccacctaatatttagcttttaaagccctttaatttctaaatgtggaattggttcatttatttacttatttatccattctataactcattaattctttgtaccaacatttgctgaatatgtactttgtgtaagtcactttgttaagctctctggaaaataaaaacaaagttcaattttctgtgtagtaaaacgtgtttaaccacaagacattaacagagtactaaattaatagaaatttttcatgtcaactagtgcattattttgttatggcttccatcactaagtaccatagactagatggcttaaacagcagatactggttttctctcagttctcccagtgtgactatcaggattctaatcctgtttttgtatttgtattaaaaagtgatagaacgtatagtcaagacggatggattaaattgttcatctcgcccctaagaattaagagtttttgttggtggtggtttgtttgtttcatctctggctgacaggaagagtgaagaagagaacgctgtttcctcgtagccccaaataacatttcacctacttctaaagctgctgtgaggtatgcaaggtcttacataaagagaaaaatctgtctcaaaaatctgcctcaagattgtggagtcttgctctccttgcattcttttggtttttctgccacaattttgagacttatcctaggaattcagttcagcctttttttcgccttcaaaataagcacatttggctgcttattttgcagcagccaaaacgaagcattcggagatgttattgttgttgttcttctctatcggtccagtacagttccttttcttcttttattcctaggaaatctctttgaatctactctgtaaatagaaatggcttcccaccacacagtgaaaaccaaaatccttatcttgactttacagggtctttcatggtctggccctgcctgtatccggcctcctctctcactcttcctcttgctacgtggctagaagcaagaaaacagggaatctaatctagttttatctggctctaaacccactgctcttaatcaatacactgcaatgcccttgtaagttatttacctctctcccatacagtacgtgccaggtggcccatagttctagctcctatctccaacctgaaaccaattattttcacaaagtcacattgattaaagtataatatttacagaggtatgtgtaagagttgtagatgcaaagtttgattgcttttcacaaagtagatgccactgcataaccaaaatccagaccaaatttttacctgtgccccaatgaaccccttataaccctttctgaaacctaccccaccaagtaaccactattctgacttctgaaactataggtgtattttcctgtttatgaagtttaactcttaatttaagagtattagatatactgttttgtgtctagcctgttttgcttaatattaaatttgacagattcacctatgcagaagatagtatagttcattctcattactgtgtatgtgagtatattacaaattgtctcctattttaccgtagatggatatttgggttgcttctagtttggaagaaattcaaatactgccactagaaacattcttgaatatgtcttgtggtgaatatatattcttttccttcctcttatttttaaacttctattttaagtttagggatacaagggcagaggtttgctacataggtaacttgtgccatgggtttgttgtacagattatttcatcaccgaggtatttcatcaccttagtacccattagttatttttcctgatcctctccctcctcccatcctccaccctctgagaggccccagtgtgtgtttccctctgtctgtccatgtgttcacatcatttagctcccacttataagtgagaacatgcagtatttggttttctgttcctgtgttagtttgctaagaataatggcctccagctccattcatgttcctacagaggacatgacctcattcttttgtacggctgcatagtattccatggtgtatatgtaccacattttccttagtcagtctattattgatgggcatttaggttgattccatgtctttgtgtattctaacagtttacatcactatcagcagaggatgagaatattagagttctcattactctgtatgcttctcagcacttaatagtgtatctatatcatttgagccattctcatgagtatgtcataacactacctctttttatagaccttatttttccttaaagtaactaatttattttagctgtaggacgaaagcagaaaactcagacaaaagagaaatattacctttagcaaaacaatcagaaatgagatatcaaaaatcacccgaaatatactacctaaagaagactaataacatttccagcgttagtcggttagacctttcctttgtttgtgctttcaagtacagtcatgtgctgcataacaacatttcggtcaactacaaggcacacgtgtgacggtggtctcaggagactacaatggaactgaaaaattcttaacacctagtgatgtcccagctgtcgtagctgtagcccaccacattactcatgtgtgtgtggtgatgctggtgtaaacaaacccactgtgcttccagtcatataaaagcatatcacatacaattacaagcagtatataatgcttgataatgaaaatcaactatgttactggtttatgtatttactatgctatactttaattgttattttaaggtgtattccttgtacttctttttaggtttgctgtaaaaccgtattcagtgttatgccagcagcagcctcatacatcccatgtttactgtgtctcttgactgtatcatgttcttttgtgcttaatttaattacacattattttattcatcacggtccttaatcatcaaaattcatggctaatgtgtcagaaagaggccctgtcctgtgattgacctgaaagctaaattaaaagtgaataagaggtacaaagatggaaaatcagtaatggttattgctcaccagtcaggtctgtcccattccaccatagccatgatctcaaagaatgagaacaaaatgatggaagctgaaaagatcttcttcattgaaggcaatgagactaacaacagttcaggaagagcctatatcagatatggagaaacttctaatgacctggaatgaagaccagtcacagaagtgaattcctcccagcaccatgatgatcacagccaagcaagaagtttgttcgcaatgttgaaagaaaaggctggacccaactacaatgttgaatttactgctagctctgggtggtttaaatgattcaagaactgtttttcattacgttatgtgaaagtaagtggtgagtctgcaagtgctgatgtgaagacagctgaagaatttctgaaaactctagttttcagttgattagtgataagttgattgtgagggggaattacttgtcagagcaaatcttcagtatgaaggaaacctctgtattctggaaaccaatgccttaaagcactattatccctaagggggccaagtcaatgctggatgtcaggtttttaaggacagaataaccatctcactttggagaaatgttgcaggctacaaatagaaacttttaatgatatggcacagtgacgaccccagggtctccaagcatatcactaaacacgcactgctggtaaactagaggagccataagaagtcatggatgacccagctcctttccaagacgcccttctgaattactatgccagcaaaatgagaagtactattggagaataacatacctttcaggatttgcttattgttggtgatggtcccacacatgctccttttattggtgatctccatcccaatatcaaagtaatgtttttccctccaaacaccacctctttgattcaaccattgcatcaaggcattaaagcactttttaaggcctattacctgagaaggacttttacccaggctgctgctgcaaaaaaaaaaaataataaaaaaaataaaataaaaaaataaaagataccaatgcaattctggaaggattacgacatctctgactgcaccaagaatcttgcttgggcttggggtggtgtcactaaggagtgtataaatggcagctggaagaagatactcaagaggttcatcaatgacttcaaatgatttgctcaggatgagcaggttggaaaaatcaacaaggtggtggttgaactggcagacaacttgaacgtgggtgtggatgaggatgacatcgaggagctcctggaggttcttgagaaattgactaatgaggagttgttggaatagaacatatagctgaagaagaggcaacagaaaaggaaactgcaggagaagaaaaggaaaacccccaaggaaattcacagtgaaaggtttagaagtttttacagacctcaacaaactccttaaaaagtttaaaaacgtggaccccaaaactgaatggttcgttcatagaggaatgttcatagtgcattgtctactgataagaaaatctatgattaaagaaagaaagaaacccagcaaaacttcataaacatatttctgaaaagagtgacacatctttaaaaagagccttaagcaggtccttcaggagccattccagaagcaggcattgttatcacagtagacagcagctccatgggtgtcagtgcccctgagaacgtcccagtgggacaaggtgtagaggtggaagacagcagtagtgaccctaaccctttataggcctaggctactgtgtgtgtttgggtcttagtttttaacaaaaaagtttaaaaagtaaaaataaaaaattaaagattgaaaaaatatttaaaaatcttaaggtaaggatataaagaaagaaaatatttttgtacggctgtttgtgtttcaagctaagtgtgataaaagagtaaaaaataattaaaatttataaagtaaaaatttataataagctaaggttaattatcaaagagaaaagttttctatatatttagtgtggcctaagtgtccagtgcttctggcatctacagtagtgtgcggtgatgccctaggtgttcacatcctgtcaccactcactgactcactcagagcaacttccagtcctgcaagctccatttttgttaagtgccctatataggtgtgctttttttttatcttttatattaatttttactgtattttttctatgtttagatatacaaacacttaccattgtgttacagttgcctaaggtatccagtacagcaacacactgtacaggtttataacctaggagcaataggctataccatatagcctagctgtgtagcaggatataccatctgggtttaagtacattctatgatgtccatacaaagatgaaattacctaatgatgcatttctcagaacatacccccactgttaagggacacaaaataagattttacacaaaatcttgttacttcatataacaaaatgcaacataaaactttcaaaacaaataaatacacttatgccccataaatgttaatgtgaaaatcatatttcatcaaaaatctatattactatgttaaaatgaacagccttgtaacatatctttgcataggtccctaattaattttcttaaaataagtcccaaagtggaattcttgtgtcaaaaactatgtattttgttacagctttcgaagactactgttagacaatattgtaccctgaccaactatatgctaccaccatcctacatttttacccaagctggatgtgggaattcttatttaggtcattgtgacactagtttattggtagtcgttactggtagtgaaacaatgactccaattcacttcccagccagccatcctggaggggctctgggtgcccgggcaagccccagcctctcatctgcatgctcaattccactcttcttttgtttcccattggcaccaccattgtccgcctcctggactcatctcttggtcttctccatccttccagctattccagctatcatatcatgaccatatcaggcttggactcccccctaatatttattcgctaccataaactaaattatgttttccatcctaagcacaaacatttcactaacacccgtcatctgtttgtgaggcagcagcaggagcaggtaatccacggttctgctttctctgtactcttctagaaataggggagcttagattctccctggatcccatcttctagagatggcattactggtctcatattctattttctttcatgtattgaaacttttgttattaatagcttctgactaaagtgaaaatgtcaatgtgtaaaatatgtggggtaatgtgttccacaatatacagagaaaagctctgaaacagtctcctgtaattctggattttctgttttcttcttgttttttaaatttccgggttcttgagtccatgtggtctaagtcctgcattaatcctgaacacatggcagcagggataaagggaagacctgaggtccgtgttccaattcgccagggatgtgaatgccctggacgttctccttctgatagggacaggaggcagagaaattctaggcagaaaagggtggatccccaacaaaaccccaccctcaagcctgggaacacagtccaaagtgagaacttacatctctgtttctggctcaaatatttccttttccaaaaccatgtgtggccctgccccatcctgtgcctataaaaacctcatactcaaccagcagagagaggtgaagcagctggacatcagagactgtggctggatgttggagagaagtggcttgacttcagagggagagcttgacagcataactttggagaagaatctggccagagatggccagacgtcaggggaagattaccttcccattccatttgcttttcagctccccttccaactgaaagccacttccattggcggtaaaatccccgacagttgccatccttcaggttgttcatatgacctcatttctcctgaattccaggcaagagcctggataccactagtgtggataaaaaaggctgtcacacttgccctgtgcccctgctggagggcagccacctcatgtgagtaggcagagggacgactcagctgttaacactcaagccgtccacggatggcagagctaaaagagcactgtaacactccctctggagcttcaggggtcatgggcatcacgccagactctgccacggggcctgcatgaagtttgctcctgctggtgcccaaaagcactggctctcggctcctgcctccacttacccgtgtgctccttcccatgagtggtggagcacagcggatccgagtgagtggagctggctcctgcctgcgctgaagcagccagttggttccagtgtttgcgcactccagttctcacctcgttcatttcatgctctttcctgcaaggagttgacggctgtgagctgggcaaatgaggcacccggttgcaagttccatgaaaggctcggggaaatatcctgcttcacttccatatggagctagtgctttgtaaagtgcactgacaataacaaagtgtagaggaggaccggacacaggctgaactgagcttcttgaaaaggctgcagctctcagaacaacgctgagaaaactggtccttcagctatagacacagagtcaagaactccatttttcaaattatatctcatgaaaagctggtgtccagtgacgtttatctgagaaaaagaaatttttttttggccaaaataactagatagatttttgttagactttataatgagaattatgaatttcctgaaagtgggatggaatacagaatgttccccaaattgtttccatggaacagctaatagcacatagagcatgcgtatttgctgtgacatgataaagctcaaggccagagatgtcttgtggggctcccaagtactctaacctcaaggtgcatgccctccactcactaattggctcctctggctgtgatcgagctccaaaagggaaggaggctaattcaaatgggatggccccaaaataagaggaatagtgtgcatttaaaccaggatatgggctatacctgcttacagtaccctttatgcaatctccagttcattaactctagtagatattgtgaagatactatcaaaaaaaggttatgttcccccaaattagggaagccctaagggattccgtatctcctttttgtacagagtttgttagaaaatcagatactggtctgagaaaaatgctgattcagatggtcaagagactaaaaaaaagtactttaaaacatcagaatgaaatcactgaaggcaatccttagctttatgatgtgctgtactcctggacaagatggtgtaagttgagatgatatgtcaaatctgatttttctataggaaaaaattgtactttagggaggtatagttctagccatgttcttaatacccaaaagttaatcagaattaccacaaatgatctactcattcaaatataagtagcccacaaataccatgttaaactttctaaatttgaattgtttaaaaaagcaaagttatagaaaatgacatttatgacccattatcagaagctttagatccaatattagaatattagaggcttttgtgctaaactcttttctttcttataaattctagcctttatttatctattttaggagggcatgtggcaaagcatggcagggaattctttcaaaagtggaatccaggaagaaaattccttgggaaactttggactggattctcaacaaacccttcagagagacttaaagccggtaaaagaccttttgcaaaagtgatccggggggcctccactttgtttctctggatatttctctgttgaaatataggtgtcaagcacgtcccattttagatgctcttcagacttcaaaacattaccttcctgctttcagggagccatttcatcagcttttgtactgtgtattcactgcagaccctgctgttatgcaaggtaccaccatggctaaaaattcacaagacgattcttagttgcactgattttttttttatttgatctttcacaatgttgctgcttccgtttcaaaaacgtctcaaagctttgatttgattgcagctggattcaaggatacccaaagccaagtttgatcctgaattccccaaatcaaaagtatttcatttcagatgtatgttctatacctggccataataatgaacagcaaccattactggagcatgcttttgatttttttttcattaacagtcatttttatgatttggaaacataattagaagattcctattccagactacaaatcaatggatttgattctactacacatttgccaataaagagcaatggtatcaaatgaagcatttgacctgtctttaaatttctttcattctgtaaattctacatgaggtatgatatatggagccaactggctcctctgccacactgctgcagttcagttgttggtattgtctggaaggaaaaaacgaagttgtggaagtgtgtgagttagttggaggtaattaccatgtaactgattatcattcatgttctgagcgctgtgctattacatacattattttatttcatccttgcaacatccttattcctatttttcagctaagtaaaaaatgaggctcagaatagtgaagtaattatccacggagagggaagatcagcagtatagattaagttggaataaatctaaagctcatcctctttcactatagcatgctgctttctagctatataagaaaaaaacctcattattctattaccccattgagaaagtactgttctctcttgttcagctgtctgctttacttagctccgatgaaatctaaattaaatgctctgctgctgatgatgttggtaacactctggtggtactaaccatagttctggggagtgaatgggaagaatggccaagactggagatggggacattagattttgagacacagaccaactgaaatgagactgtgttttctgttaataataggaatttaaatgaatcattgaaaaatcagagaaagttttctgaaatataggaagcaaatgctacctatacttctttatatctttcaaattaaaaaataattttcaatacatgttaaatggtacaaaaatcagtggggcttttttaaaaattcaagctttataagaaaaaataataaaacatgtgccaaatatgtctgaatactattaaatgtaaatggtgtatcattaaatgcactggctgtttgggagaggtgtaataaacaagagacacattgtagctatgaccgtgacgatttactttttttaattctggaggaaatttcaaactgtggaatatataagcagaaaggaaatgaataatgcatctaactagcatgcgatagtaagcctcactcccgttgtggacagacaatatacaagaaaagattttggtggaaagatgtaggtgctatttaaggggaggatattctttattgaaaacatatccagcaacatctgaatgccaaataaaagtctttacagtttcatctctccttagagagcatattttttagttgttgttttgtttgggagaaaattgcagtttaagatttacaaaccacttcatttgcaaactgctattactatagtttctgcctctgaaaatgtttaaagctgcaggcaatgaaaagacatattattagagcttttccttataaagaaagctctcattctattgtaaaaaatgagcgtataaaaatacaatattatttatagagttatttatataagcagcattttgatgtgccttcctgaggcttggagatattagaaagcagaatatctgagaaaacatatttcacttcgttgtttaaatgcaatagagatcaagagattatcttcatcatgataagattcaaagaaatttacactggtaattggagcttgtccatagaatttattccttattacaatatagactataggttgttacatttttttccttaagggaggtaaggttagatttttcactatttaggttgagactctttagttgataactgaaagttttcttttagcattcaatttgttcttgaattattttttatttcagcatatctttctaaaaattatgcatgatcagctcttttttttttccattttcctatcagctgtttatcttagatcttcattcatggatgtgttagtttcccaggattgccaaaacaaatcaccacaaactttgtgtcttaaaacaacagacatttattctctcagcagttctagaagccagaagtttgatatcaaggtattcataaggccaaacctccttcaaaggctccagggaaaaatccttccctgcctcttccatattctggtggctccaggcttttattggcttttggtggtatcactccaatctctgcctccgtcttcacaaggccttccattcagtgtctcaaatcaaatctcttttctcttataagaacaccagtcacttgacttagggcccacccaaatccaggatgattaattttgagatccttaacttaaacatatctgcaaaaatccaacttttcaatttccgaataagatcacatttccaggtgctaaggtatattagtcagggttccccagagaaacagaaccaaggggatatctaaatgacccttatgggagaccactagtgtcgatcctggttcaactctaaaggcctgaaaatcatgagtgctgatatctgagggcaggtactcagaaagaagaaatttattctttctccaccttgttttaaattcaatccctccatggattggatgattcgcacattggtgaggtggtcttctttactcactgtactgattcaaatgccaatctcttctagaaacacttcacagacacacccagaaatgatgttttactagctatctaggcatcctttagcaccatcaagttgacacataaaattaaccatcacacaggggttagcgtttgggcatgtattttagagggattcaggtgaatgtattacaagatgtgaaaaatagactttggagttaggcaaaactgagtgaaaaacatggatctgccactcacattgaggaattatgatcatgcccataattctttagagcacaagtttcccccttttaaaaataacgatattttaataattgtgatgatactagcttcacacatgttgtattagataatagcgtgcattgtaagataatatgtataaagcaattagctccctgctttgccaataaatggccattgttaatttattgattatatggattttatttttctaattagagtaattccattgacttcaatttctatagagttcttctttccttttatgcagcagaagttacaaaagagaatgtgacatgaatcatatctgtattgaaaatagacatacgatgactaattttgttctaaatgaagaatgttttcttatggaattattgtaagaattaaatggaaaaaaatgtatgtgaagtacttagcagttagcatttagtgttagctactattatcaacaattccctaaaacctgctagggttacagtaaccatggcaacacaaactctattttatttagtaatatatttatttgctaattgacaaacaaaattgtatttgttcactatatataatatattgttttgaagtctatatacattatggaatgactaggtctaggtaactaacatatgcactgcctcgtatagttatcatttttgtggatattttgcattcattctcttagcattgtttaagaatacaatatatggctaactatagtctctgtgttgtatgatagacgtctttaacttcctcctatctaattgaaatttcgtattctttgaccaatatcttcccaaccaccatccaccaactaccccagcccctggtaactaccattctattctctacttatatgagatcaactttttaagattccatttatgagggcaatcatgcaatatttgtctttgttcctttggttggtttgtttcacttaacataaggtcctccaggttcatccatgttgtcacaaataacaagatttcctcctttttcatggctgaatatagtattccactgtgtatacatacagcattttctttatccattcacccatcaatggatacttagattgattccatctcagctgttgtgaataatgctgcagcgaacgtgagaatgtagatatctctttgacatacagatttcatttcctttggatatatactcagtagtgagattgctggatcacttaggagttctgtttcattaatttttttttttttgaggaacctccatactgttttaaatactggctagtttacattatcaccaacatcaggcaagttctcctttctttacatcctcaccaacacttgttctcttttgtctttttgacgttctgagaagtatgaggtcatgtcacattgtagttttaatttgtctttccctaatgattagtgatgttgagcattttttcatatagctattgaccattttgtatatcttgtttagagaaatttagagtcatggctcatttttaaattgagctatttgttattctttgtttgttctgccattgagttgtttgagttccttgtttattttggatataaaccccttatcagatgtgtagtttgcaaatattttctttcccccattctgtaggttttctctttactctgttgattgtttcctttgctgtagaacagctttctattttgatgcagtcctatttgtctatctttgcttttgtcgcctgtgcttttgaagttatatccaaaaatcgttgctcagaaaaatgtcatgtagcttttttttctatggtttttcaacgagtttcacagtttggggtcttatatttcagtttttaatccattttaagcagatttttatatatggtgtgagataaggatctaattttattattctatatgtgggtatccagttttcccagcaccatatattaaagagactctcctttctccatggtgtgttcatagtacctttgttgaatattattagttataagtgcataaatttatttctggagttcctatcttgtctcattgttctacacgtctgtttttatgccagtgttgtgatgttttggttactatagctatgtagtatattttgaaatcagggagtgtgatgcttccagttttgttctttttgctcaatatcacacactcctttctaaacctcatcatcgtttagggtatataatacaattaataaatgcatatataattatatgtcttttcaaataattgataacctaaacttgataaccaatcatagttttacatactaactggcagttcctttctatcttgccctgaatcttattttatagacatacatttccaggatgttacatgagccttcagtttagctcatcaatactcagctatccaaaattcctcattgccttgcagcagtttttcccaataccagggccatgttcttagctggctttgaaaaatgttttgaagaggcatcttctccagaaatcttttgagactgatctccccaaatatgaatggtgctaggattattttactaataattgaaccttctaatgcttttctctttgttattgatttcttttgtggcattaatttttaaagtgcttgatttcccagttgattatttgctatattaatcatatgtctttcaaggtcttggctttgttaatactgtcttaactgactacagaatgaagacttctaactttcaggtaaggattccgcgttttttattcaggacaggtccaaaaaatggcaagataacagcaaggggattcatttgcctgcaggcagtttggttaaaattctcccttagttctcatatacacattataatttgcattttaattttactgtcttcacaaccacgaaagcatatttaggtaaaagtgctaattagatctttgtaaacaaccatatgttattttggtttatgaaatttaaagagcaattaaaaacacatatatttactacttataggtgggagtgggaatgactttaatctgaaaagtgtaagtgaatctgaggaaaaagctaaattagagatgtgttgaatgatcttttggaagaaactaaaagaaatttgaaacttttcttcagaaaaccatagggccacacaatgctacacattgagcctcaccataattaaatcaaaatacttgaaaattatatttcaaacctcttttcaactactgtacttaccttagagaaatcttcaaaagaaatctgtggtatgtttattgttaatgaaagcatgtcattctttctctggtgacttatccgtctttatcagtttcactgtgaagagcagagtgatatatgagtgtgataacttaagatgacatcttatagtgcaatccattatctgaaagatttaaggaaaaagctctctgaaaaaacataattaagaaaataaatgtttttagaaatataataaagatcttttatggttttggttcaggaacatccatttctataatatgatacactaaggaaatagtctgccaatcatctaaataacacttgtattttgatttttattggtttggcttctccacaaagaaactaacaaatcattaacaaggattaagaacaaaaaagtgtctaaagtttttttagaaatggattgaggaagtagattaaaaggagactcagagaaaagagactgttttctaaaaatatggccacgttgtaaatgtgtgtttattttctcaccaataaaaataggcaatatgttgtttattgcctggatagttggacttgacttggtttttggctcctgatttttggtctgagtctaatgaaccaataaaaatctcttgatgtgccacataagtaactcccacttgaccccattccaggagctaaagaatctcatggcttcaacaaattctcctgaaccttgctttggaattatattgtttatttgtaatagttattttctctttgccttagttgatttaagaagtctagtatcacgtcaggatcataatatatagatacagaactccttaaaaataaaccccaaatctaaaatcaggattgaaaaaaggacagaagtgaaatcaaccaaagtaaatgtttaaaatatgcattcttagctgtgcttattcaaattggtcaactctgaatatcttcgtttctttttttttttaattccactggttacagattccaaatttcatccattccttcttgccttaaactgtgatctgtaacctgtgccttcactcaaattaccatttcagctcttttacaaacatcaaatagcaaagggcaatatggatattttattagacttgcacagatcagaaacaaaaaatgtgcacacaggttcaggggactatgtgcagcatttctgtaaggaaatagtgggtgtgaggtatagagagaaaactttcccatcatcaagttcctggacactatggtactgcacttgtcccactataattcctttaaagtatagcgactacttttcacctttgtaataactacggtacttctaaagggccactacaatagcaatgagaatatcatctgtttttcttggaggtggtagttttcatcaagcatatcaagacatatgagaagatggtatttaaaatattcagccaacaatatgtcctgggcatggaccagaatgaacactggccgaagtgctaaagcaatatattggggccccggctgtttctgagatgtggggacttttgtgaggtctaccctagtgtacacccggagtagattcaggaaacctaagccgttgatgtttaccagttatacaaaagtatttcaatacctgaactgctgtggctataccagggcatgttcactaaatatcagccatggactttgcaaatttaagcaagcagacataaaaataagtcatacagtcattctgatgttcttgccattgcacatgctctctctctctctgtctccctctctatatataatttattatacaatacattataataaatagtatgtataataaatagcataaactaatacctacaaaatatataataacatattagtcatattagacatattcttatacccaattaaatttttattaatagaatagacataaggctggagtgcaattaatgcaaaattaatatatacgttatataactcatgtataaagacagaatatttaacattagaatattttgttattcttgtttggcattgctttcaaagtccatttctgttccacataaagaaattcatttcaggttttcatagtcgtaacccacatatttgaaaggggaagtttcatgtgtatgagatcatagaccaaagagcatatttgtaaccatcattggttgtttttgtctgtttcatttagtttttatagaaatagaacggatttggaagcttactgtaaacactgtgaaatggtgaagacttaagaagcttttcttaaatctctaaactgctgagagcgtcctagtatgacaaaatggtgccgtcctttagtacttaaataaatatcattcttcctgaaacactacagttaaactcagtgggtcacttttgtgctttggggtgtaagaccccaaatattaacctgaggaacctaaaagcacaccagaactttctgaaactttttcccccatgctagatggggtttggtctaggagaaaagttttgcttctcttcccagtgggtcttgttttagaactctctaaagcaatgagcttctctggtttatcttccatcttgtttattgtacctagtctctgacatgcagaaatgacttaataaaggttttctgaattcgtgaaattcacctcctgaaaattaccaccttatgatctgaaaaaactatctgctcaacagaaagttactcatatatctgcttctatagatacagtagtctcccttacccatggtttagctttctgtactttcagttaactgcagccaactgtggtctgaaactatcacagtattttgcaagagagagagagagagagactacattcatgtaaattttattacagaaaacatggcatatatgggacttagtgctatctgtggtttcagcatccactggggtcttggaatgtgtcacccatggataaagggggaattactctgctagatttggtaaaaaggcagactagtggagagatcttctgaaaaaaggagataggaaatgttactgaagagaaatagaaaatattgtattaatttattaaaagtaaaggttattagaaggtattaaatttttgatataatgtaggtgacagtgtgagtggggaaagacctgtaagtgcaacaaggggatgaaattccctatcttctagccatactccagtacataaacggcttaaaaataatgtatatcaaagcaatgtaataaaggattaccgtgatgaattttatgagattaagctgcagttaatttccttatgcatttaagattaataaactgctaattagaatatgcaaataagggtttctgaagcctaaaatatattccctagcatcttacccataaatcttattcagtaactattttgttatataattggggaataacagattgatgagccaatctaattatgtgaaatttacatgtgtatggtattttataataaaggacatgaactaatgttaaagtagtggaaagtagttgtaacattcattatagttattaattacaaaatttaacttagtttgaaagtactttgtgccatataagctatcagccacaccaagtactcttactacacatctggtgcataattgtcgggtgagactgagcccatcagcaattacagcaattattgggactcttacatttacagctcacacacatcacacccaagcacacgtttctggaatattgctgatcatccagggacctagataacaactaattgcctcattatgcaaagtggggaaagatattcgtatttcttacatcttctgttctacattatacacatagagatgcctgtttgacagcaagcaacagataaaagaatattagaattatttttgtgcccagttaaggttttttgggtttggcttcgactttttcataaagaaagcatcttcatgaggctggaggacataaagcaatttgaaagctattatgggtaaaaaacatctaaagggtttacacacacacaaacacgatgaaggaattaggaagggctctaatgatcctactatttactactttggcaagataccaaatggaataagaattaaaattctattgaaaattaattcaactgagtggacagaatgctatgaagtattcggggcattttctttcatataatatataacatttactaatatgttcaagtaacaaaagttacctttatacagttcacctgtactctgtgtatttgtccaacattcccatgaaggacaaatgtaattaatcccaatttaaacaggtaaaaaatgaaactttgatatatgcaaactgcaatttgtaatcaatagtgagaaaatggaaactgcagcctttgcaatccagttctgtgttctttatacctgtgtattgccagatctatgtgtgtaaataaaattcaacaaagaaatacctgataagataagttttgtgggcatttatagcacacttagtgaaaatatataatatcaccaagcccgccatattagaccacttttaccttatttttcttactttaatcaatatttcattaaatttgacttaactttatgtgtaaagatactggtatgaacaacaattaccttgtccatattattatctcttccagctttttcagagcagtttgaacaaatgaataaaaacttgagaaacataaaagatgcctaactaatacatatggcacatgcattataatattaaaagggaagaattctcaacttgttatgtacacactcaagcttttttttttttttttgagtattcaattagcagaataaccctacagaatccgtcaatatcctgtcttcactgtgaacagaatagaaaattcctcttcttttttttttaatgactgccaaaatctagggcacttggtgttgatgcatgactaattactaatgtttcaacagagtaagtcagattcaaattgtaaaggcacacaagtgaatttaaaacctactttttcattctttgataatttctctaccaatggaggataagaagagatgatgccggtttgaaattcctgacaaaaacttaaaactgcttttaccctgtctggtatactattattttattctaactgtgagaaaagtagtaatgagatcatcctatttcaactaccgtgactttaaagagaacatgacagatacaatttttcaacaaattaggctgttttctgaaatactaacaaagtttgccttttcagaataaaatgttacaagagctgcttctggccctaatgtgcccttatcagcgtgtgtgtttttaatgtggttaaggtttaacattcattccagcttcacctatagcttgttggtatgctttatcaccatggattttaaacacactgaagaaaataatttctacccccaaaattattaaagcccctacaaggaactttacactttcaaaaaaataattattttcaaatataaacacctctttatatcttgacttttagatccctataaaagccaataagacaaatttgattcaatgggaattctttgtactggcaaaaaatattacatgaacgataatataggagaccctctgttatgtaaaattacgctatttattactttagcaagttccaatagaataatcgttgatggccctgaggtgtcacatgatcctgaattacttaattgttacatatattcaggaaaataataatgttaactgcatcatgctctagtctaagcttcaagaaattggtaatacaaatattctatataatctagcattctacctaaatatttgatcatttgtgacaactacattgaatgagagtttaccatacttttttaacaaaagaaaaaatatagcttagttagctattgatgagacctactagaagaaattaaaactcatatcttatgatttatcacaaagcatttgagcacaaagcatttgaatttgatgttaattcaccttggctgtgactcactgagaattctgggttttacagatgggtagatcacttccttttcatgtagctttttttaatattgttgacataagagaatctgaagtatcatttcttcacatcctatttcacctgtcattgtcatctcaaaaatctattttctcttgcataaaacctcagtgtttaaagctataaaagcaaacacagcagtgaggaaattttcccctgggtctatttgccatatgctttaaaacagaactatttgaacaccaaaatcagcattcctgaacttgcgtatagagacgtttgttttcttttcccacctgcataagggtaaagaattcaggcttgcagaatatcctttgaattctaaaaccttgctgaaaaatcatttttatactgcagagtgatgactcttgctaccttcttatgattggaagggtttccaagagaaacaagatggacttgacttctcttggaaatataactcagagtgtttgagagatttagaagttattcttctgttactttctagatattcacttttaattataagtaaaatatgtttcagatccaaacaatggtgacttcattcattcattcattcaaaaaatgagtgtattatgttttcactgtgtttccttcacagatattcttggcacatcagataacacagtgaaaaaaaaacagatgacaaatcgtcaccttctaaagcttatattctacagggggaataaaaaaacagaaacgtatacatacacgcatgcatatacacacacataaatttaatagcatgacagatggtaatactgctatggaaaaaataaagcaagaaaaaggaatagtgagtttaggatgaggtttggagggttaaaatttgaacagaaatttgaaggagatgagagtacagatatcatgctatctgtggggaagattgctccaggttctaggactagcaggtataaaaggaatttgctggggaagagcacggaggaccatgtgtccagaaagagaagttaagtaaccaggagtgaggggcagacttattgaggctgtgtgcaattaaaggggatgttgactttaagtgagagggagggccattagtggcatttgagcagagcaatgaaatattctacttaaaaaaaataataagctaactttagctgctatacacaaggaagcagaggtgccacttaggagattattgagtattttaggaagagatgagagtgtctcagacctgggtgatagtgatataggtgatgagaatcagacagattctggatatagtctgaagtttgagacatttggcttttgtattcaatatgaaatatgacagaaaggatgagttgaaggtatttgatttgagcaaggaagaagttgcatttattaagatacaaaagaatgcagaaaaagaaggcttgggggaaatgtcagaagttagctctagactcttgaagttttaaattcaaaataaatatccaagtgagtactactcaatctattgagtagatgattgcatatctaagtttgaatttcagagaagaggtgtatactataaatatatatgtggattttgtcagtgtggaattggtatttaaatccaggggtccaattaaaatcaccaagagagtaatgtagatagagaatgggagatgtttgaagactgagccttgggatatccaagactcatagtttgtagagatgagaaaaaccacaaaagaagactgagaaggaacagccagttaagtaagagtaaaatcagaagagtttaggctgtcctggaaggaggactgatgtttctgctaaagtgatgcaatgatattgcaaatgtaatatacttgaaagacaccaagaggagaggtattggaggcagtacatttttgcttaacaaaaaagcaagggaaaaggacagtagatagagagggatagtgtaaaaaaaaaaagctgtataatttttaaagagagggttattaatgggtacaaatttacaattagctagaactgtaaataagacccattcaatagctcagaagggtgactacagttaacatttatctattgtatatttcaaaataggtaggagagaataaatcaaatgttactagtataaataaaagataaatatttaaggcaatggatattctgattaacctgatttgacctttagagattatatacatgtatcaaattatcacttgtatcccaaaaatatgaacaactattatctatcaatttaaaaagttggctaaaatagcagtacttttgttggaatgaattcatagaaaaataaatgataatgtatgtgaatgaagaatttctggagaattaaatttctgcaagtaatgatggaatatagtatacaaatgggtgcattgccttgtatacaagtaaggatagtttatccagagtgataggagaggtctatgggctcattcacaggtcagtctgtgaatattgtgatgaaggctttgggatattttttctgattcttttattttcttaatgaagtaagaagctgagaatgagaaagtgtagaagcttaagaaggaaatgttaggcaatagtaatcaaggaaaagaaggagagtgaatgaaatagatgtcagtagtagaagggcagatggcaacagaggctcacatgggtttaagggtcatgaagaccatgcttcatattgttaatgtttttctagagccatatttgaccatgggtaggaggagtaatttaaccattgtatagagattctccaactgtatataaggcagcaacagagtagcaaacacaagtaaataaatgtaatgaccaattatgggggaggagcaaattaagagcatgaggaagagagagaaggcaaggggcagaatcagtacactgtaagttctaatgctgaagttagggtactaagagtgaactctcaccttctctatgataacatccatatttacataaaatctgtacacaaacattctgatacagtatagcatcttccattttccattgagaatgattctcatccatttgtgctattcccattttgcaaggaggaccttcttatgttgggaaattttaatgattataaatgctctgcatataatccctgctgacggaatctatgcttcattgatggatgaatgtactcaatcatgatgcggaagagggctacatggtaccttccaccaacagctactttttctattcctctctctctctctttaaatattttgcctttaaaaaatatatcttcttaccatttgacgcattcctgggaaggctgttcttatcagcagacattgctggaaataaagagagaaattgtagaaggaagaccagttattaaagaacaaaatgtcgatagccccaaagagaggtttaattttaaaaagcaaagctaaaaatagcaaaaatagaaaaaacacaaacaacaaaacctctaaaactctgaaatgcgtgaaagagtacttttcaaatgcaagcatgcatgctaacttcacatttccacccctacttatctctcccacacttgagcctcacagctcacatagccgcctttctcctgagtatgacagctcaactcccagaacagcctatcaggtcacaaaccataactgatcatttttgtgtgcttcttagattctgtttgcctggaagcagcttttcttttaacattatttttctcctacagatggaaatggaagagaggagaataaaaattcaagtctaagactgagaggttccataccagcgagcctggcaccaggttgagcatgtatcatagggaaaagttagagaccacacaagcctctgtggttatactatgctgcagagaagagggcaaattaaactggaggtccaccttacaagaattttgtgaacagctgaatgttataactgttatgaatacctgcatcacctaacttaaccacatgaaactcactcgtgaattccctactgtacacatgtcagcattctgaggttttagtgattttcttaaacaccagaatactaccaaggggtcactcaaaatgcagtgctgggaatgttgtaagaaacagttattccccttatttaaccaaattttctgtcacaagctgcataattccaagtttctggatcttatttaacccttggggaaaaaccagtccttgaattaaaattaaatataacattattcctgaagtattacaggattttttttttatttcttgaaagcggagtattcataattactacttttttttttttttttgagacagcgtcttgccctgttgcccaggctgaagttcagtggcacaatctcagctcactgcaagctccacctccctggttcaagtgattttcctgtgccagtcccctgagtagctgggattacagttacgcaccaccaagcccagttaattttttgatttttagtggagacagggtttcaccaagttggccaggcttgtttgaactcctgacctcaagtgatcctcccacctcagcctcccaaagtgctgggattacaggcgtgagccactatgcccggtctcataattactttgatctccctctcatataattaaagaaatcattctatcatcttttctatcacgttattctctttacacatttgtccgatttctttctgctcctctgtagtgacagttttaaaatcttcatttgttattgcgttattatatactgatcaaaacaccaaaatatactttgtgctaaacatttcattgtgcactatggatgattacaaaatcaagtaaaaacacagcttcagctctgaaggtatgatacagataaataccactgtgaaaattttgtgtgattaaagataagtgagattattgaagaaagtaggttttcctagagtcaggatttgaagtaggggttattcacagaaagaataaaaaaaaaatttcaaattgcaggagacagtatgcagaaaagctggatttgaccccgatgacttgtccccatcccttttatttcagcaatattttcctttcaactaaagcaccaatgcaaattataccagttttttctctctgtagattgtgtggcttgaggaactacggtgtaggaaccaatcagtgccaagcctccctccccaaattccgcctccagtctcccttccttcctttcttcctcattgtctacagagggtgcccagaaaagaatcttattgcctccttttccaatgatttacaggataaattccagatccttagcatggcccacacttttctctgtgttgtggccctgtttcactaacgttaccttgctcggctggcagtttcatttctccaaaatgacttttttccctgtccaccaggcaaactgcctaatatttcaagacgtaactctgataccaccttctatacaaagtcttcccttaggcaaaatgtctaatcttttctctacttctttaaaaccaaacaggtttctttcattttattgcatttctgtgtagctttcctctgagatttttgaagtcaggggctcttcactcagcattacatcaatacatcattaccgaccaatgactatatctcagacattgtaccaggcatttacgatgatggtgaccacaatcatacatagactcttgcttcatgaagtttatcgagtaacaaaaaaggtatccacaaataattacacaaataattaatcttaatatatcataaaggaaaattacacagcaatatgaaaacagatcaaggagagcaaatagattctggactgttggggtgggaggcaatattaggagtcacagtttttatgtatatatgcttttcttttgataaattagaatcatttataaaacttttaaagtttttctttcaattatcattgtatatttgaataatacaattaatcatccactttgagttgtattgaccttaaattgtgtattttgattctccactgtacagatgaaaaaattatattgtatttgcaatgtaattattgcttattatacttccccctactctgcctcaaaattttggttagttatattattatttcagcttttctagcagttatctttatatagcggtgaacttgtgactggcttttaagtccaaatccaaaataaattttggttgataatttgtgtctgttaatgagtaaaacaaagggaaaacattgaagatgaatgtcagaacttcactcattcatcaaagatataaatgacttaatcatagatcacattaattcaattggattaatttgattaattaattcaattatgattgcttgatcatagattaggttttaagttctgaaaaaagattttctcaattttttgtactattctatatgtaatgactgtaggcacaacacacttttaagtttcatctgtattattaacattttttccgttctctcttcagtttgacagtcaaaaaagcagtaagtcaaaccctgatttgcagcatttgtcaatttccatggtataaatattccctgtgtggcttatttaaagcttccagcctaccctcatggaatgcagagaagagcacagagagataatacatgttatttgaaagactcaatattatcacaatatctactcttcctaacttgatctacagattcaatgcaatccgaatcaaaatctgagtaagctattttatgaatgttgacaaagtgatcaccagcagcataccacaatgtaggatttcccccacacatttgcggtgtcaagagcatagatactagtaaagtgtagtaaaatccgttaacttatttacttgcaaatgtatatgcttaatattttcaataagctttattttattatcagagaagttttaggtttacagcaaaattaagcagaaaatatggagtttccatattccctcatcttcacacatactcagactcccctactatcaacatcccacaccagagtggcttgatttgttacaatcaataaacctacacagacacatcattatcaatccaactccacagtttacattagggttcacccttgctgttgtacatgcgtgggttttgacaaatgtataatgacatgtgtctactactgtagtatcacacagaatgttccactgccctaaaagtcctctgctctggttattcatcattccacttctccagattctgacaactattgatctttttactgtttccatggttttgccttttccagaatgtcatatagtctgaatcatacagtattgccttttcaaattggcttctttcatgtaataatatgcatttaagcttcctttgtgtcttttcaaggctcaatatctcatttcattttagcattgagtaatttgtcattgcaatgtaccacagtttatttatccacttacctactgaaggacatcttgattgcttccactggcaattatgaatgaagttactataaacatccttgcacagacttttgtgtgaacataagttttcacctcctttgggtaaataccaaacaacactattgctgtatcctatggcaagaggaagtacaggtttgtaacacactaccaaaaactatcttccaaagtggccataccattttgcattttcaccaacaataataagagctgtcattgcttcacattcttggcagcatttcgtgttgtcagtgttgcagattttggccattctaataggtgtgcagtagtatctaattgtcattttaatttgcatttctctgatgacatgagcattttttcttatgcttatctgccatctgtatatcttctttaatgaagtagctgttaagatacggaccatttttaattgagttgttttcttattattgtgttttaagagggcttttttcggtatagtttggatgacactcctctatcagatgtcttttgcgtaccttttcctctagtctttgacttgtctttttattctcttgacatgctccttcacagagcagaaaatttaattttaatgaagtctagcttgccattttttccctaaagtgtgccttagatgttgtatctaaaaagccattctgacaccataggtcgtctagattttctcccttgtcatttctaggagttttatagtttagcattttacatttaggtctataattcattttgagttcattgttgtgaggggttcaaggtgtatgtctagattatttatttagttagttagttattttgcttgtggatatccagttgttccagcctcctttgttgaagaaaactatcttttcttcattttagttccttcgtcaagatcacttggctatatttacacagatgtattcctgggttctttgttctgttcagctaatctatttgtctaatcttttgccaacaccacactgtcttattactttagttttatagtaagtttaaacttggatagtgtcagtcctccaactttagtcttctttaatattcttggctattttgggtatgttgcccctttacataatctttaaagatcactttgtcaacattcacaaaatagcttgctcagattttaattgggattgcactgaatctgtagatcaaagtaggaagagtagatattgtgataatattgagtctttcaaacaatacatatcagctgttcatttcgttctttgatttctctcatcagagttttatagttttcctgttatagctcttgtgcatattttgttagtttatttctaggtatatcattttcggggggcgctgatataaatagtattgtgctttgaatttcaaatcttacttatttattgctggtatatggtaaagtgattgactcttgtactttgaccttgtatcttgcaaccttactacaatttcttattaactcagatagtttttttgttgttgttgttgattctttcagattttctacatagacaatgatgtcatctgtgaacaagcacacagttttatttcttcctctccaatatgtataccttttcttttattttcttgtcttattgcattagctaggactttcagtacagtattgaaaagcagtggtgagaggggacatccttaccttgttcctgatcttagcaggagaacttcaggtttctaactattaaatacattagccgtagattttttgtgaatatattttatcaagtaggaagctcccctttattactactttattgagcattttgttatgctttgttttttaatcatgagtgggtactggattttgtcaaatgctttttctttatctcttgatatgatcatgtgatttctcttccttaacccattgatatgatggattacattaattgatttttaaatgttgtaccagtcttgcatatctttaataaatcacagttgttcatagtatacagttctttctatacattgctggattggatatgctaatattttgttgaggatttttacatctatattcatgagagataatgatctgtagttttcttttcttataatgtctttgtctggttttggtattcctcaaagtatgagttaggacatattctctctgcttctaccttctagataagattctagagaattgatataaatttcttctttaattacgtggtaaaatttaccaataagttgatctgggcctgctgtttcctgatttagaaggttattaattattgattcagtttctttaatagatacaggcctattcagattgtcaatttattctcatgtgagtttttcaaagaattggcccatttcatctaggtcatcaaaatagtggatttagaatttttcacagaattcatttgttattcctttaatgtccacagaatctgtagtgatggcacctctttcatttctgctagtagtagttgatgccttctctctccttttttgtcagttatcctggcaagaggcttatcaatgttactgatctttttgaagaacctgttttcagttttgttgattttctccatcaatttcctgtttccaattttattactttgtgctctaattttcattacttttttttctttgcctactttggaattaatttactcttctttctttagctttttaaaaaactaaggcagaagtttatatggctgattttagatctttttttctaatatatgcatttagtgttacaatttccctctaagcactcctttcactgcatcccacacattttgataagtttggttttcattttaatttagtgcaaaagatttttaaatttttcttgtaatttattttttctaaataacacatatcttctttagaagtgtgttatgtgatccccaaatattttgaaaatttccaactatctttcttttattgatttctcacttaattctattttggtctgagagcagacactgtatgatttgtattcttttaaatttgtatgtgttattacccagaacgtgatctatcttgttgaatattttatgtgagtctgagagcaatgtgccttttgtggctgttggatgaagtagtttataggtgtcgactgtacctagatgatctagtgtttttgagttcagctatggccttactgattttctgcctgctggatctgttaatttatggatgaagggtatcgaagttgccaactataacagtgggacttaatctaattctctgggcagttctatcaatttttgctttaagtatttttacattctggccggcaccgtggctcatgcctgtaatcccagcactttgggaggccaaggtgggtggatcacgaggtcaggagttcaagaccagcctgaccaacatggtgaatgaaacactgtctgtactgaaaatacaaaaaatagctaggcttggtggtgcatgcctgtaatcccagctactctggagactgaggcaggagaatctcttgaacccgggaggcgaaggttgcagtgagctgagattgtgccactgcactccagcctgggccacagagtgagactccatctcaaaaaaaataaaaaactaaaaaatttttaaaaagtatatttacattctgttgttagaaaacagacatatatattaagaattgttatgacttttggcagggaggattgacccctttatcattatgtaatgctccactttcctgacaaattttcttgctgtgaaatctgctctgtctgaaattaatacagctacttccactttcttttgattcatgttagcatgatctatgtttctctatccatttatttttaatccatatttgtctttacatttaaagtgaatttcatgtacaacacatattgttaggttttggttttttattcagtctgacaatctctgtcttttaattggggaatttagaccattgacatttaaggtaaatatcgatgtagttcaattaatatctataatacttgggtttggttttgattttttgcccttgttctttgttcctgttttcatctttcacacatttgctgctttttgtggttctgaggattttatatgactctatcctctctcttttcttagtgtctcaattatacttctttgtttttacttcttaagtggttgccctagggtttgcaataaatatttgcaactaattcaaatctgctttcaaataactgtcacaggtagtgcaaatactttataataacaaaatattttgaatccctcctccatatacatagagtacattattattattatcatgaacaacctgttgtctgttagataaattaagaataagaaaaataaaagtttttgttgtgtcttcccttaatcattctttagcgctctccctttatgtagatctagtttctgacctatatcatttttgtttcctctgaataacttcatttaacattttttttgcaagtcagatctactggcaacaaatttcctctatctttatttgtctgagaaagtccttatttttccttcacttttgaaggatagttttgcagagtgcagaattccaggttggctgattttttttttctcccaacaccttgaatatttaactctactctcttcttgcttgcatggtctctgaggagatgtcagacgtaattttataagtgaagtgtttttccctccctctggcttatttcaaaattttttctttatctgatttaatgaggtttgaatatgatgtgcctaagcatagtttttaaattttcattttttggcatttatcctgcttggtttcctttgagcttcctatttctgtagtttgatgtctgcaatagtgactgagaatttttccaaattaatgtgtggtttggaagtttctgttatcacgtcctcacactcagagattctctcttcaaccacattcagtctactaattaaatgtcagtcaccaaagccattcttcatttctgttaacagcgtttttattccttagcatttcttttttgttctttcttagaatagccatctctcagctgacattgtttattcgctctgacatgtcttttttttcctattaaagccttctagcatattaattatactttaaaaaaattccttttctgataattccaacgtccctaccatatctgactctggttctgatgctaattcgatcgatctcgccaactgtggttttttgtttgttgcctttattaatgcagcgataagtcatgaggatgattttctgataatttcaacatccctaccatatctgactctggttctgatgctaattcagtctccaactatggtttttgtttttttgcctttattaatatagtgatacgttgtgggggagcggggaagcattctatgattaggtctcagtcttttggtgagcttgtgcctctgggctatggacttcacaagtttccgccaacccctttacgtggcacagggtgactggaggagaccacagctgtgcatttcccctcccctaggtaagtgaggctctgatacaacctcagaagattcagctctggtaaaatagtttctcctctgggtaggccttgttaagaagaacggaaggctgtgatgtatttcaaaatggtaacatttcctttctccctactagaagcaaaagggactcttttccaatatttactgtgagaagctggcagactcctggagaggaaacttgtagaagtgtgaggaccccctatgactgagtgccctggagttttcatctttcaagcttgtccacactcaacctccagaagttcgttaattacagtttagggtttcctaccctggtactggctcataatgagttttctgctcatggatttctgtttggttattaagttgtaattttccgtgtccacctgtctatctctccaatgttgccctgtggtttgctctatgagtacccttctctgatagattcaagaagagttgtaatttttcattttgctcagatttttacttattgttaggccagactgaagatacctaatctccttacatgccagatcagaaatcaggagtttatactttatttttcagttatggctttatttaacaactggtttgcaaatttcctgaaaatttaacagttgcctcttgtgagtttggggtgggaaagagaaggggctccaacacaccactacctttataccattacatcacatatttaaacatctattattgatagatttgttttaaaataatgtcagttaccaactgtctattaaatatgaaaaaaaatcatttcttctttcttcttcccccatccacacttaagcttttcatttcactgctacattttattatttaagtccaaatgacaggacttttttttaagacatggtcttgctctattgtcaagtctagagtgcagtagcacagtcatgctcactgctgtcctgaaccccaggctcaagtgatttccccacctcagcctcccagttatctggggctagaggtgtgcaccaccacactcagctaatttttgtatcttattttgcagatatggggttttgccatgttacccaggctggtcgtgagctcctgggctcaagcagtaccctgcctcagcctcctaaaatgctgggattgctggtgtgagcacattattgaataatatcagaaatactaaccaaaataattagaaaaagtaaataaataaataaataccttagaggaaaaaatcaacaacaacctttcaagtgaaggagtgggacagatctttctaagaaggaaacagaaatcagacattataaagcaaagattgaccaatagaactaaagaagaacttgataaatttgactacatgtaaacactaattcatatgagaggaaaaggggtagtagtgcccttaatacatgcttataacttaatgtttagattataacgatttaaaaaaagaataaatatatataaagggttatctaggtgacttaagcaagctgaacgggttggagttcatgcctcatccccactaaaattctattaaaaaaaaaaaaaaacgctttttaaaagatggctttcataaaaaggaatgagttcatgtcctttgcagggacatggatgaagctggaaaccatcattctcagcaaactaacacaggagcagaaaaccaaacaccacatgctctcactcataagtgggagttggacaatgagaacacatggacacagggaagggaacattacacaccggggcctgtcgtggggtggggggcaaggggagagatagcattaggagaaatacctaatgtagatgacgggttgatgggtgcagcaaaccatcatggcatgtgtatacctatgtaacaaacctgcacgttctgcacatgtaccccagaacttaaaatataataaataaataaataaaaagatggctttaatattacagaaaaatcacgaaggtagtttttcattttatttttaattttgtattgatgtgaaagtcacaaaatataacattaaccattttaaaatgaacaattctggggcaattagtgcacgtatcatgttgtgcaataaccaaaactgtctagtcctaaacatttcatcactccccccaaaatttctagacccagcaagcagttactccccactcccagctccttcagttcccagcaactgtcagtctgtcttcctctctctgaatttacctattctgaatattttatataaatggaatcacacaatatgtggctttttatatctggcttcttgtacttagcataatgtttttgaggttcatccacccactcttcttaatggcttttcaagttctcacactgacaatgtggaaaatgtattattttcctgctttattcatagcctttctttgcttttcactctctgttggtaatgaccagaatcatacctagtcctaagtggggctgaaatttttcccttcgaaggctttttctttcagttccctagttgtattaaaaaagtaaacgtagatatgtagagtaggtactgatatcagtaaggatatgatgctataatttaccatggattaaaatgattcagaaaaattacccagggttaagtatgaattattaacatttagtgaaatacagcttggggccaccagtgcactgttccaggagggctgttcacatggaggcccacagtcatagaaggtgacccaggtgcgtgtaactgcaccagtccattcccctcatgattacaactattttactttattcaactaaattttatacctatccacttcaaattcattcccagaaattgtactcaccatttgccacttttattctcagaaggtaagaagtttaaaagccacaaaacgtatgcctaaaagatgaaagaatggagtcacagtatgagtgctaaattgaagaaatatcagaaggaagaaatgaaatcacaagtaaagtgattgaaacttggaaacttattggtgttttatgaggagacacaattgctcccacagtgctatactgaagaaagtgccagcctccaaatgaaaagctgatataagagtggtgtgaaaccagtgttaagtattttgcctggaagaaattgcttagaatgagagcagtccctaaactccttagtatcatttagtatgtttacttataactattactcatcatttggcccgctgggtctccttttgtactggaacagccctgccaagggactccctgtcgtggactaattctggagagtggaacaccgctgggcagggggtctctgtgctgtgaaatctgaagctaagaggatggatggcatttagttgagtgcattcctccacggatgctcatttaatttttaaaaatgtctctgaactgctgggacggttcttcctggattttttgtagttctcttcagttacacacataactccttagagatgcattttgctagtgaggtctttcaatatgtcaggctcttttcatttaagcttagacattttagatgttggaccattgtagctgaatatttctcttcccttgccttcatgtaaaatgaccctagtgtaaagtataaacctggtttgtttgcaaggaaaatgcactcttcagtttcatgtttctgggtgaaggagtctgtcaaagtgctgcctgtcattactgataactgcagtaggtcagtttgctttactgtaacattaatttatcatgtgacttgtatcatgtaagtgtaagaatacagccaataaaagccataaaaataagtcaactgctaagagatatttcaatttttttagaaattcgctgggtgacttgtcattgatacattttattaaattacatatccaaacagagtatactgtgaagatcaggcgagaaatttgtcttctaacggcttttttcataatttccattaatccatattgtatttggtttcttactggaggctattttaagtagtcttttatcagaatcagagattttatactaatcctaccttttagttatgagcatttagaatattcgttaacaggagttgtaagttctcccaactaaacagacgtggtatattcagtttaacacagagcacatatcagaaaacttcattctagttataaggccgaacttcccttaaacctcaatatcatttgatcctcaaactaaaatcttttgagactaccagctatgctatgctttcattacggtgcggaaggaaccctgttagagacacagtatacctaagttttgggtccagctctctctaactgcctgcatgaatataagcttgttattgaacctgtttccttaactgagggaaaaaggatttgaagtagaacagtagttcttaaccaggagaccatcaaatcactttggttggttttttttttttttttttttttccgaaatatacttgtccatatctctctggcatccttcaaccccattctgatgtaatgaagctggggtggttaatttccagttaagtttgtcttggagagatgacatctctcgtcggatccacctctacaagatatgactctgaaatcacaagagctggggttgcagaatttgcagcagcaattgtatcaatggcatcaatattcttataaaaagtgtttatatctagttctagcaatgaaagtcttgaacagactttctgattaaaatcagaaaaaaatacaactttctgattaaaataaatgggttagctgtttcccaatctgttatgacaacaaacctatttctggaccaaaaatcttgatgtgtaatgtaatgtaagatatggtcccacatatgtttcagtaagaataaagaatatttaaaagtatagtggtcctcactagacttcttctcggtgggaaaattgtacagaatgcgagttctgtaacctctgcttcctttagtaaccccacctgagagccagaagaccaacagttcagaccagaaaaagtaatagaagcagaacttccggaggcttgcagatggagtgttaattggtgatctgaaaaaaagtgcttcatctctcttgtcgttaatgtttgggtctgcaggaaaggctgacttcatgaacatgtggcctgtgtagccacagagggccccaagttcagaaaggcctcgtgctgttgtaatgctctgctgtgatggtcttgaaatccttaatgtttttaaacaagggtcctgcattttcattttgtactgggctttgcaaattaggtagttagtcctgcttgtagcaatgaaactaacaccccctgccccggtaaaaccaagcagttcctatcatttttctgcttctttacttttgcctttaaggatcacttgttatttacattgttcaagcaatggtaagaagtgtcactttccctggctgcctcccacacttgaggcgcatagcaagcctgtcctcttcagttctgatgacctgcccattctaaccactgcgcctgtttcctgaacccttctccatacaccaaccacattaccaacctccccttcccatcgagagaagacgatttgcttcttaattcccagatcactctaattagaacactgcaaaaactgacaactaaagcaagtggccacctactagttctcacacactggactctctaacagtaatgaatttctgtgattatttccttgctactaataaaatactagctggaaaagtggtcaagtgaggagccaccagaattttatttcttcttcaagcatttaatagccaactatagggccctgggcatttactgaaaggcaatttcagttatgttagtaaattgctgtttaggacaacagatcaataaaataaattattaggtctataatttaggtatttacagagtaaggacaaaaaatactttttcactctgtgtattcaaagcagttgatccatgatttttggatacataatagctgtatgtatttatgagatacacgtgatattttgttacatgcatagagggtataatgatcaagtcagagtatttagggtgtctgtcatctggagtatacatcatttctatgtgttgggaacatttcaagttctctcttcttgctgttttgaaatatacatttttgttaactgtagtcaccctactgtgctactgaatattagcatttattccttctacctaaatgtatgtttgcactctttacccaacttctcttcgtctcgctcccccatgcacacacccttcccagcctctggtaaccattattctactctctacctccatgaggtcgatttttcagctcccacatatgagtgagaacatgcaatatttgtctttccatgcctggcatatttcttttaagataataactccagttccatccatgttgctgtaaatgacataatttcattcttttttattgccaaatattaggttggcacagcagtaattgcggtttttgcaatgataatagtattccattgtgtacatacacaacttttttgctgtttttctcaatgactctagagaaacatttattcgctaatacattttctttgtgttctctaacttaatgtcatcttttcatctcgcttgattttcatgcagctaaatcggaaatttgtcgttttctccctaaaaaaatacaataaagttctttcttataaattatattctctgattttcttgtcagcctgcttcaagaaaatccatgtgtgcaaaatacttgctatcagtttgccccataccaaatggctgtttaatccaaatatctgaccagcaaaccaagcaattccttctgaagaaagggtggttggacagccaaagccactgggtagtggaagagaagaccacccatcctgagctccccagtctagtgtgaggggaggacagctgatagctggagatgcagcatttccagatgtcactggtcccaaaccattatcagagtaacactggcctcatagaatgagttagggataattccctcttcttcagtctttggacggtattttcgaggagagctcttgtccgttctttgaaagtttgttagaattcaacattgaaaccattcagttttggactttgctctgttgggagactttttttactgattcaatctcactgctcattattggttcgttcaggctttttatttcttgctgattcaatcttgataggttgtgtccagaattttagacatgttctctaggtttttggtttgttagtgtatagtttttcataatggtctttaattatgtttttatttttgtagtgtcagttgtaatgtctcttttctatttctcatttttttatttgggtcttctttatttcttggcttgtctagctaacagtttattgatttcatcttttaaaaaaccaacttttcattttgttgatcctttgtatttttttaagtctctgtttcgtttagttctactctaatttttattatgtatttccttctattaattggggctttggattgttcttgtttctctagtttcttgaggtgcattagattgtttattgaaatctttctacttttttttgacataggtgtttatggctataaattttccccttagttttgcttccatagttttggtatactacgttttgacttgcatttgtttcaagatatttcttgatttcttccttaatttcttccttgaatcaatgatcattcaagagcatgttggttaattttcatgtatttctgcagtttttaaagtgtcccttgttactgatttctagttttattccattgtgatctgagaagatacttgatataattttgatttttaaaagtttcttcagacttgttctgtttcctaacatatggtctatcctgggaaatgttccatgtactgatgggaagaaggtgcattctgtagctgctgaatgaagtgttctctagatgtctgttaggtccatttggtcaagtgtgcagtttaaatccttttaatttttttgataattatctgtctagatgatttgtctcatgctgagtgtaaggtgttgaagttcccaactattatcgtattggagtctatctctccctttaaatctaataatatttactttctatatccaggtgttccagtgttaggtgcatatgtgtttagaatttttatatccacttgctgagttgatcctttttcatcatataatgatctttcttgcttctgtttactgtttttgacttaaagtctgtgttttctcatacaagtttagctattccgtttgtttgtgatttccatttacatggaatctcttttttcacctctgctttcagtctgtgtctttataggtgagataaatttcttgtgggtggaagagagttggctcattttttttttgtcttttcagccagtccatatcttttaagtggaaggtttaacctatttacattcaaagttattgttaatatataaaagcttattcctgtcatcttgttaattggtttctagttattttgtaatgtcttttgattctctttctctcctattgtttattatagaaaaccttctgtagtggtaacatttgaggttttttttttttttttccttatttgtgtgtttgctctaccagtgggttttatcctttcatgtggtttttatgatggtagatatcatcctatcacttccaggtataggactccctttagcatttcttataggaccaggctaatggtaatgaattccttccactttcacttgtctgggagtttatttctccttcatttatgaatgacaacttttctgggtatgtaatccttgggtggcattttttttttctttcagcactttcaatatatcatctcattcttcctggcttgaaaggtttctgctgagagattcactgttagtctgataggggttcccttataagtgactagatgcttttctcttgctggttttagaattctctctttgtctttgacttttgacagtttgactataatgtgctgtggagaaggcctttaggaattgtatttgtatgggaacttctaagcttcctgtatctggatgtctaaacctcttcctagactttgaaagttttcagctattattttgttaaataggttttctatcccttttgttttctcttcaccttctacagcacccagaattcaaacatttgatcacctgattgtgttccatatgccacaaggctttgttcattctttttaattttttaaaattatttttgtctggctgggttatttcaaaagaccgctcttaaagttcggaaattctttcttctctttcatctaatatattgttgaagctttcaaatgtattttttatttcatttaaggaattattcagtttcacaatttctgtttggtccttttctgtgatatctatctctttggtaaatttctcattcatattctgaattttttttctgatttctttgtattctcttgcatttcactgagtttccttaatatcaatattttgaattcttttttcaaggatttcataaacttacttttgattagaatatattgccagaaaattcttgtgtttctttgaaagtatccttgtttttccatgtttcttttgtccttacattgacatctatgtatctggtgtaaacatttcttcttccgggtttttgaatttgctttcctaaggaaggactctgttaaagatgaatctgtggtttaggttgggtaggacactttggctttgattctggatgcttgcagtagtgtaatcactgtgtgatttatttggctgtaaatagtatcagtggtgtcagtgatttcctcagtgactgcagtgtctgtgatttcctcagtgatttatgatacagtggaggctgtgatgaagattttctggggacagggacaacaggtgggcctgtcctcaaaccccactggtggccagtcacaggccaaacatgcctttccttgggccccagggcaacatatgctaatatacctgtgttagcaggctcaggcaggccattcttgggcctctaggtggcttgcccaggtgctggtagtggcaatggtgggccaggtgggtgggtaggttatcagacctctgggcagcagcatggaatgggtgatggcagtagcaatagtgagacaatcatctagctctgaagtgatttgcattgtttgttggcattggctacaatgggctgggaaggccagtctccagtcccacctgtggtatgtgtacgtgggtacccagtatggtgattgcattgttgtgggcattggctagaatgagctgggcaggcgtgaactcaggaccacagaaggagtaccctggtgctgatggtggtcaacttgggtaggtggtttccaggcccttggatgtcatgtctggacatagagtgggggagagagccaggactggtggacctgtcctcagacctcccagtggtatgagcaggtgccagttgtggtagacaggggtggagtgatccacatgtccccaaagaaatgtttgagagaaggcagcagctgcaaccctgctactggggaaggcaaggttgctttcagtggcagcagctgtatacatgtgtttagggaacacacattttcttcaagcttgaccctgggaacagcagtcacttgcagtgacagcagctgtgggcaggagagtttgttcatggggcacatgaaaatgcatggcagctttgttcctggggatattggggtcacagtcaatggcttgcacttgaatattggctgcaactagctgccagccatgacatgcattggctgcaggtgaggaatgtcaataggacaccagggatgtggtgatgcaggtaccgttggacctcccaggcaggatggtaggggctaggctttcaatatggtgacttgctgtagctgcctagggcttgggggcagagggtgtgactcagcttgagctctctctggagcaatgccttcacttggtctccttgcagcttcctatgttagtcttggggcccactaggtcctagggactctcctgtgtctaggattgcatgagttcatggtgggaacctggactgttgggggtcactcacttacccttttcctccactggggagccagcctctccaggttctcagccaatgctagccaagcaggcagcctcacttccccttccttttttgttttggttgtgtcctgtcacttatctgttgaattctaatgttctttcataaatgatctattcaaagtgtgatcatctattcactgtttttgttcttctctgtgtaagagacacgtagcagatgcctctagtcagccaccttgcaacccctctgccatgcagttaatacatgattttttctacttttggatggaattagataaggcccaagctaagaactccatacagcccattttgtaatatgatccagacacagagatgcactgttcagatcctcgttcaaaaaacgacccaccgcatagctgagagggatgtggtcagctgatgcctccagctgttagatccttcaggatctgtctcagttttcaaaccaaggttacgctcttctctcagtgatctccaggcaatggccgagcagaatgatggtacaagggccaggtcatcaacatcccctacaggacttctccatcaggttatctttactccagaactcccctttgagctggtaaagaattttagatctgcactgagatctgtcagcttcctatgcccaatcccgcatcttacttttttctttaattggttttacttccaataaaactcttgcaatcctaactccatctcagcatctgtttcccagacaacccaacttgcacaatgtccttacagtaatgcaaaaatgaatttcacagagctctttttgtaaagatgctgatacatgaagtctcaaatttcatggacgtgacataaggaaggcaacagcttgggaagaaaatatgagaaatagcacttagattgggtttattctagaagaaaggacacctcatctaactttctagtagtcctctataaacactgttcctctggactgggcgtttgatacataccgagcagccttgttttcaaggttagagtccctagaaaatagatgatgttcagagacaaacctgtctaggtactgagaactctttctacttgatgtctgattgccatctccaacagattatattttgggatgaattattcatctttagcacataagtaatctttcttattttcttattatctttacaaatcagtgtaatgcccagaaagcccagtgtacaatcaaaattttagttgcttatttttttcttttgctcctttatgtccaactagttactaaattatgtttatgtgtctttgaaatcttttgccttttgcttgtcataagatgcccaaaagatctgtcttttggccaaactccatggcagagataggctacagttgtacaccagtttgtacagtgtacaaaattgtacaccaactttgttttctttttctcctgtgcaagataaccagctggcatcctacaaaacacacatgaattttaaatagaatttgtgaggaggtattgtttctgcatgttggagttcctgtaaattacatttacaactctttattggtatcataatgttgatggagaaatagatctcctaggaatatgtgcactgaccattcaactatccccatagctaacattttggatgcattttaagcttcttagcttagcacataaatcccatcataatttatcctctgtttcccaccatcaccactcctgaaacacagcctcacagactatttactctagctataaccagttataatgcttcatgcttcatatatgctatttatcttttcaagaatcctttcttttttgccttctgcttaaagacaacttctacaagccttcaaacctcagcttaagcattacttcctatgtaaactcttttgtgatctcctaatttgactctttttccctaatgcatttatttccattggatctcttttatacttttatcataacattgactataccgttccctaaatgttgctcttttagaactataatcctatattatttgacttcatatataaatgtgctctaaaaatgttgaatgaatatggtgagttttccactttgatatcttcatgctgtcttttaccccagggcctcaaattagccatcagaacagatggcttataagaactggtatgctaaaaagtaggtttaactgtggttgtggacatgcttctttctcaggggttccatttctgaagtggaaattaatttgatgcttctctagagtgatgttcagattaatgttatgccatttgtaaaggcctctaggactctcagatgaagggcatttgatattagcctcattgttactcgaagctgttgtagggttcatctatttgctactcagcaagacatttgacattctcgtaatacagcacatcccaggattaattaagagatttccggaagtctcaggaatacacctactttgacatcaatgtgctgtgaatgttgatcttggtagccttactttgaatagctatagggtatttaaatagtaacctaacttacaattaagactgcttagtccctgtaaggattctgagtggaatttagcaatggataatgaatatattctccggagtcttatactgaatttgaaaagaaacccaaattcctgagctttagtcacttaactacaacatctttctacataaagaccataagctaagaccatagaagagagagctcatgcatacatgagtacagatggttaccaaagtaaggatctaaaattggactctgctgtactcacatcgaagctcccaatgtacgaagggatgaccttccttcaatggctttatgcaagggtcaaaatgtatttgaactctggagcagaaaagcactgctctataggatttccaagtgttcattatttaggaggtcaggaacgatgggagcatgtggcaatccagacagctgcagtccccacagacctaaaagaaaacagctgccagagcagccatttctatacaaaatgtctcatgaccagaagctatggaaataaacggctagaggcagctgtgcttccctcttgctaaacactcaaagattccatttttaacacaggatgtctattattaagacaatcagctaagatgtcaattcaaaagccacaaagttctgcaacataaatactgtactgacttctctcttctgttgtgtgggaccatggcttctttccctgtatgctggggacactacttcagaataatcaagtgaaaatactgcttttttatggtaactctccattcaagaacttattataatagtgttataaaaagactgtaatcttatcataggctgtatttgaaaattaagatcctccacaatctggctctatcctctttctcaaatcaatttctcattactctcaatacaaatgctatccttcaggtaggtaagactcttcattcttgctccacgtttcttactcacgttccttcaggcaaaaatgccctgtcagacacatgaaaaaaatgctcatcatcgctggccatcagagaaatgcaaatcaaaaccacaatgagataccatctcacaccagttagaatggcggtcattaaaaagtcaggaaacaacaggtgctggagaggatgtggagaaataggaacacttttacactgttggtgggactgtaaactggttcaaccattgtggaagacagtgtggcaattcctcaaggaggtagaactagaaataccatttgacccagccatcccatgactggacatataccgaaaggattataaatcatactgctgtaaagacacatgcacatgtatgtttattgcggcactattcacaatagcaaagacttggaaccaatccaaatgcccatcaatgatagactggattaagcaaacgtggcacatatacaccgtggaataccacgcagccataaaaaggatgagttcatgtcctttgtagaacatggatgaagctggaaaccatcattctgagcaaactatcgcaaggacaaaaaaccaaacaccgcatgttctcactcataggtgggaattgaacaataagaacacttggacacaggaaggggaacatcacacaccggggcctgtcatggggtggtgggaggagggagggatagcattaggagatatacctaatgtaaatgaccagttaacgggtgcagcacaccaacatggcacatgtatacatatgtaaccaacctgcacgttgtgcacatgtaccctaaaacttaaagtataataataaaaaaatttttaaaaatcccctgtcagtcctctctgcccacccttttgacatttgatggtaaagcccaatctttcctctgcccacattagtcagtgatttctttaaatttcatttataacgatccctaaacctcataattccgcaaccaattacatgctagtacacgtgattctctaatctgtgtattttaatctcatctcctaagaacacggtggcaagatctgtgttatttactttgaggctgcatcccatttttttcttttgtgtttttttaattgaagtgaaatttgcatgtaataaaattcacccttttcagtgtacatttctatgagttctaagaaatgcatgcagttgtataatcaccactacaattaagggatagaacagttcgaacaccctaaatattttccttgtgactttgtagtcaaacctctcccacctgcagccactgataacctgatccatttcctgcctctatagttttccatctatgaaaccatgcagtatataggcctgtgtgtctagatccttttacttagcataatgcatttgtgatcattcatgttttatgtatcagtagtacattcctttgtattttgggtaataattcattgtatggatacacctagcatgtttatacatttaccggttggagaacgtttgggtaatttccaatgtgggaccataaagccactataaacattctcacacagatttttgtttgaacatacgttttcatttcacttggaaaaatgcctgggagtgggattgctggattgtatggtaagtgaatgtttaaattgatgagaaactgctaaactgttttctatggtggtgtagcgttttgtttttagaccagcaatgaatgacagatccagttgctcagcatcttagtcattctaataggtgtatagtggtatcacataatggttttaattagcatttccctaatgactaatgatattgagcatcttttaagtgctcctttatgttctatattttttggttatttcatagtactagcaaagtactaacaatgtattagatgcttaacgaatatttgcagattgttaaattgcagatcattaatactactctcttttgcatgccatttgcatcccattactagctgttaccatttattgagtacctactgtatgccaagcgctgtagtaagtgctttatatatggcatcttattaatacacataagaaccctatgaatgtgctgggtggtattgttcccatttgataaggaaaagggacaaacagtgctgacttgtgactctccaaatccttctctttccccaggaattttgggtttgcttgttcaggttctggaaggtttttatactactgctaaggatgagtgaagaggtaaatttaaataatccaaaacaggctgaaatgatccacatgataaagagataatttagaggttagtggggccatgaggaagaaagggaaaagtacttgggagaggcaagggaagtatagttgtggaggtagaagagagagaaagaggttctttgtttgtgtgtttgtttttgtttcagtttttgttcaaaaaaaaaagacaagagggagcaagaattgtgaagaagactgaggggttagagggatgaagagagtgtttagtatgctaattatgaaatattctctttttggagtttttttgagtgaataagattaaaacaaggtttttagggaaaaggaattggatttttttatattgatactagtataagccatagagcttattaatatttcaacagttatacacacccttacttgtgcacgtgtgtgtgtactcatgtgtatgtatatgtagttttatgcagtttattaaatgtgtagatatgtgtaaccactaatcaagatatttaactgtaccattaccagaagacttcattcttcattgtgctacttatttacagcggaatctacaccctcatcccttacccctggaaaccattaattgttttctccatatctataatgatgttatttcacaaatgctatatttataaaagtatgaagtatgtattcttttaagatttttttcacccagcaaatttttttgaggttcacgcaagatgttgtgtgtatcaagttcttcctttttcttcctgagtagtattccctgatatgcatataccacagtttgattaattgttcacacattaaagaagatttgagtagtttatgttttggactattaataaaactgctataaaccttggtttatcaatttctgcatgaaattaagtcttcctttatctaggacaaatgtccacatgtataattcctggatcacatagtaagtccatttttatttttattttaaaagaaactatcaaactattttacagagtgactgtactattttagattcccatcaggaatgtatgagtgattccgcttatccacatccttgccagcatttgatgttatcactatttttatcctagtcattctgataggtgtgtagtaatattttgttgtggtttccattttaatttctctgatgactaatgatgccaagagagttgtcatgggctaatctgccatctgtatagtctctttgtatacacgtcttttgtccattttctaatttcatgtcttttgcccattttctaattttatggggtttttttagtattgaaattgagaattatttatatgttctagatactagtactgtgtgagatagatgatttgcaaatattttctcccagtctgcaatttgtcttttcacccttaacaggctcttttacagaatactttttttttattttgatgaggtccaatttatcaacttttcttttaatcatctatgatttttggtgttaagtctaagaactctttccttgtcctgtatcttgaagattttctcctatttctttttctagacattttatagttttgtaagctgcgcacttacatctatggtccatttttagttgatttttgtataaggtgcaaggtttagatcaaggttcatttttatttagctagttagctatttgcctataaatcattgcatcgtcatttattgaagacttttcttcctccatcagattgcttttgctctatttaagaaaactaattgggtataattaggtttttatttctgtgagatgcaacttgtaccaacactggtcacaagagagccagttcttactctggttaaatatggatcaggaaactgaaactcagtttaagtaacataatatagcatgtatccacctactacttggctgtcctttttacaaagtttgtaaatgccatgttgaagttaccttgttttctggggtaatacccaaggtttgttgtcttatgtcacagatatcgaggatgcagacacacagagtgaggttaacagtgaacgtttaataagcgaaagaaagataataggtctctgctacagagaacggttctggaaaaatgggttgccagtccacagtgaaatgccaggggctttataggtgagctggtggtgaggcagagtctgatctacatagggcacaaaaaaactggttaggactaagtgtgccattggcatagggcgcaaatttctggcagctcccaccctaagcttttattatgcaggcgagttctctgcctgagctgagccatgttgccaatttctttctttctgtacatgtgctaaccaaaaagggaagatggagcttccatggtggacatgcctggcccccaggtagcccttttctattgacgcagctaccggcatcccccgtgcaagcttccagcttccttatctatgtttgcagctcgatttttcaggctgctgtttgtcaggaaaagaataatttcttgggctgctttttgttagaagggaagttctgccgaggactctgttgccctcactatctgccgaaataatttctttctacattctgtatcagtattgctaggatcatgagttggacagtgtgttacacaattttttagatatcaaagtagtatttatatgctttattaccacagcaaaactaacccggtgctcagcttgaggtgaactttacattgatacctttcccttctctaataaagcaagtagattgggagctacatgcttggcaaatacataacaatcttcttggtatgtttccaaaatattttgacaacaatatcagtggaattcttggagcttatcaccaaaatctgggtgaagtaggcctttctatttctaaagaaaaaaaaaggagagtcaatcacctttcctttaggtcctatggctggtatttaaaaggctgagtaactatgatttaaatgaaatgtcgtatttttaaaacactgaaagctgcagtgactacaggcctggggaggttcactctgatttgctgcccatcagatctgcagaaggcacacactaattcccgaggcgcagcattgtaagacttaacacggccaacactaataattaggcctggttgaaaagtggcagagaaatgctcaatttaccagcagtatcctcacctaatttcatatatattttctaatttgactttgagttaggcagtatcccatttcatggaaatgggaaccagattcagaggagggaaatagcagagtaaaatggcagatctgtatctgactccatagctaatgctccaccttggggttttatttcttccaatttagaatttacggtgagttatagaacttacactgcaacttaagttaatatcaaatcacagaatatttatcctggaagtaactccagggtctcactggagagtcttaatgttaaaatatactttcatactattgatgaaaaaaattttgaggagaatttaaaaaagcaaacagccagacatgggcagggcggggcacatgcttatagttttagctgctcaagaggcggaggtgggaggggtgcttgagtccaggagttcatagtgagttatgatggtgccactgcactccagcctgggcaacagagtgaaaacccgtctcaaatacataaatacatagcaatgtaaaggtagcgcaaatagcctaatttcctctgttttttttttctgaattcactcatattactataatagtaccaattatatactttattatatctaattgtactcatgtcccttgtaactaaataactccttgaaatcaaggataaattcatagtcatctttgtaatcatattgcttgatatagtatctgatgtatgaatgttaacgtcagcatgattaattgtaattaaatgtgcctagccaagttaatttatttattttactttgaccgtggaagcacagttgtattagccatggaatgctgcctcaaatacctttcatatataggtataggtagggtaaaaagctacacagaacattactaaactccagctttcatagtcatttgtatgagcacgtactacacaggcaattaatgtaactgtagctatttttatacatggaaacactcttaagggaaatgatcagtttcttaattaacttgtgatgaaatgcatgatgttgttggaaaatatgtattctgcctggttttaactgactctataatattattaatttattaatatttccagtttttgcataagaatcactagtactttttaaagtgaacctcttacaaaacaaaatatatttcagtctttagagagttaagtcattagacatagcaagttcaaaaagcaggatttgagatcatttttggtaagacctgttttgctgactcttcttgttatgcaaatggcattttctcagttttgtatcctgggtaccatgtaaatggatagagaatgatgagggttgctcactgttggttcctataaaaagtaattactaaaaaacataccacatagccatttacaaatatgactgctaagtttatattgcagagcagcacttcctgagcccaatgtaataatggcttaatctaattacatacacatatgcttgttaacacatgtaagtttccagtacacaataatagtgctctatatctcaagagctttagtattactattgcactgagacataaacactttttaataactgtcctttaaggattttcaaagaaaaaacaatctatgaaaaactctgttaacagggagttcttaggaagaaaataaggaataatgggcataaagagatgctaatattttgtgattgtcttgcagcaaaatgttattaaaagggatagttaaagaggttattatttcacctttgcaaatactaatgggtgctcttgcctccttcattgaacttttagctctccaaaggaattgcagtggtcagtttgttgcagaagctgggtacctaagcactgccaaatgccccacccacagatctctactccaactgcaaacaagcccaggaaggaatgttttttctctctctctcacattcgatacaactgctcaatctacttctctctggtagacatagctccaaaaaccaatgactgattgaacaaattaaagggaatcctgccactagaataaaaattattctaatctggctggtatttttattaattatattcttacataacaatctggcagaatttgagtgaatctgccagcttctgtacacagacctcattgtctctaaatgattcacctaactgccagtggtcataaatacaataataacaacagcaaccaccggagcaaattaaaatgttttacactggtaaacagcgtaactgtttggctgaaactgtcacttaaaatcttaaattatctcactaggtaggggtatgaaatttcaacacaactagggaactaagtctaagctatttaatatttgaataatattaaaaacaagagtaaaatacttaaccatgctgtaatttcccagcattcctcttgtagccacccgcactgtgacttttgcctttctctcttttttcacttccattacctcctctgtaattgaagcatccacctctttatatttccttcaacagacaaggttttattttccatgtcctttaccactactgtgattgaagatttcctactttctctattcccatcattcacatcaaagttaatatgttcccgccttgtaacacacccaccttgtacattttaattaagacaggcactcctgtattctgtgtgttcatcacctgatcttcactcatattcttctctttctgtttttttcttatactcaatgactattttcactcttccccaagattcacgttttataaattccaattttcccaaagcgaagtgacacacatgttccttttgtctaaactgacctgtatgctaatgactcttaatttcattctaagaaaagaagaaaagagaggaaaaagagcatttatggtatacaaactgtataagcatgcccactagacatactgttatgtctgtgggagataagctgttctaaaaataattcctcaaaagcaaatagcagactctgaaggttaatgtaatatgtacagcattcccatttcctttctttctgttgtgttgaggatcaccaaacaagctaatagccctcaagtgtgggatcacgttaaacaaaaacaggacattttgattcatggatgtgccaagttacaaagtttatcctttcaaaagtttaatgctgagtgatatggttaggctttgtgtccccacacaaatctcatcttgaattgtaaccccgtaatccccacgtgtgaaggaagagaccaggtggaggtaattgaatcatggggacagtttcccccatgctgttctcacgatagtaagttctcaggagatccgatggttttataaggggccctccccacttcactaggcacttctccttcctgccgccttgcgaagaaagtacctcgcttccctttcaccttctgccatgatgaggcctccccagccatgctgaactgtgagttagttaaacctctttcctttataaattatcagtgtcaggcagttatttatagcagtatgaaaaaaagactaataccctgggtatcaaggtctttatggttttcatcaggataccaagttctagcccacagcctgtgagttatagggtggcttggtggcttggtcatgatgacaaaccccatcaattcccaaatatgttgaattaattaattaacacattaattcaacaagtatttatgcagtgccttgtctatgctcagcattctgtgagatactgtctggtaaacaaaatacacctaagacatagtgtcttacctgaaatagaatcctagggaattaggtgggcaggcatacctaatctgtaattgagttggtactaaaatcagtgctggtttctatgttgttgttgttgttgttattgtttggggtttgggcttgggttttgggttttcctgtatatttccacttgagtagtaatgttacagtatgtttgtttatttgtcttgtttgtttttggttttggacttggttgacaaaatcagaatatatatgttatgggtttgcagttttcaatcactttttaaccctgttaactttagtctcaagtaaacaaaaaattactgagacttctataaatctaagcaatgtcaggttcagaaaaagggtggcatttgtggtgtatgccttttcactcccctttgctctagtatctcaggctttcctgtgtcctccaggctgacatttagtcccatggaaacaagacttataaggagcattactctttttcattccattaaaatttaccttaacgttgtgccatttcttccaggagttccctttacatatttctgtcatctaaaaaataaatcagtttctctttaaattaaaccttcctggctcctttgccccattgaatcctggaggaaaacaggaaattaagtatgaaattcaggtattaattaaaataaatgctcatagtgccctattaaattggctgcattttgacaggaacactggttcaagagttacctactctcaactgctgtaatctatatacctccatcatttccaagcatcagtcaagttctgaaacacggacttctaacttcataggcaattgtttaccagcgtttcagtttattactaaacactggaaattataccagacatcttagtcctggatggggcatgcccttctgatcagcaagtctgttcagttataacccaaaacgccatacagtttaaggagaatgaaaacagaggtaccaaaccttttgaggaattgtcttttccacttttagctgtttctatctaaagaactggggctagccccaaaccatcagcgtgccctttcctcatggacagtgtgggagaaatacagaccaatcccttctctttgtggatttcatgcagtcccactcttctaattttatttgtcagtaacatgttccagtttctgagatcacaattaatcttacattaattacattttaaattaaccacaatatgctctttcagcagcacttaaaatgtcatcagcaagacattgcataaatcattgttgagcgtggtttacttgtgaggagatttatgtagatgataattccttaaaaggcacatggattttttaaaactcttatcaaagtatgatatttctggggttcgaccacagttacaggaaggtcatagtgtatccggcagtttgcacagcccttcacctaattttgccaacaagcatatgaagggaaatatattttcttctgtgattatccattttgtgttttgtcagtttcaatgacttctcttccagatttatgaagtttatatggcactgttatgagagacctattccaactctgccttttagtacctccagacccctaatgacacaattatgagctttctcaagtaatgttattgcttaaacctttaaagtctcccaaagctcggagcactatttgcaaatatgtagtaaattaaactgcaacacctgctactgtgtagttgtgtcacaggtcatttcatctctctgggtatcagtttcctcaaatgtcaaaataaagggaagctagaatcactgtaagatcttctgcaagtctaaaattctggtattctctgaacaatgctatagatagttgactttcactttcctcatatcacactgactgattgatgttgattcttatctcaaaaagtaagatttctagctctagagagaccttcaagattgtcagctctaacacctccattttgcagataaaggaaacttagggcttgagaaatgaagtgacttctcaaactttccacagtcagcaagtggctggcactaaatgccaactctcctgctactgataaagttctctctcctctactccatgaaaaaaaaaattcttgcatttttatttaagttgaagatatttcaaagtaaacctgatcaatgaaattcaactgtgaacacgtatgtcagaatattacagtcaggaaacaggaaagggggatgaaaaatggcatgtgtagtaggacccagacagccaaattaatattgattcaaagaaccagaactgcaatgaaataaggacagaactaaagaaattcagaggtttggggaaaagaaaaaatttaataaaaatggaaataagactcagacaagcacagctatgcttttgtcattgacattcagtactattaagttcatcttcatcgggacattggtaaggaaaggcgtgtgatctctttgcagactgatagactttttggccctgtaatgatagactttgtctttttttttttagaactctagttgcaaaactctgcttatacgtgaaaaaaagatcagtctgcatctgtccctgttgctaatagtaaccatctttcaaatattgccagcttttcatatcacaagcattttggtccaactcacttcacctcattcagtcttcgctactcaggacttccttttaattgacacacaataattatacatatttatggggtacaatgtgatgtttcagtacacatatgcattgcctaacgatcaagtcagggtatttagcaaacccgtgacctcaaatatttattatttctttgtggtaaacacttttagaatcctctcttttaggaattctttgtatagtttcaaggcttctgccacctccacagaatgctttttggttctctctgtgatctgcacagtgtattttttctcatttcatctactgcttgtcctacactttcatttcttcatagcactcctgatgtatttcaaaatctttaaaagcattactggtaatcatcataataataataatgaggctataacattttccataccacagtcttagaaatcatctagtttattacgttcaaaaaatttcccaaaagaaggcctaccaaacatgtaataaacctaaaaatgtatcaggcactagttcagaggctgcatacaccaatctgatgctcataaactcattctagctatttgtacaatacaggctttcttctccaaggtttccatagagtcctagaggaattattagaatcctgagccggaattaaatgaaatgagtgttaaactgtgatctggtaaattgaggtagatggtgcaaacagctgattgttaaaggaaagtatcctcaagcctcacagttgcagggtctgttttataatctcatatcctagttttgcctatttggccattgaaaaccaatccaaacagcctctttaagtgacagctagattcaattcctgttgaggtgttgttgtttaaaccctctctccagagagcttcagtgggattgaaaaatacttgttccctggaagctacagtaggaatgctctatgatttgtgcataatacatatgataatctgagctttaaattaatccctaacccttctggataatacgctgcaggtaatttctccttcctatattacactgcggaagctagaattcagaagtatagtcttgctcaccttttaaggataatagagcttcaaaacagtattgcaggaagcaaagtggaataaacagaaaactgtcaaactagatgccactactgtgagttgttgaaaaggttaaatgtcagaagcaaatataattggatgactggaatgaatgactaagtgctttttacactaagttgcttgtttcacaagcaaccctagacccttagaaacagggttgatgaagtcaaagggacggccattctgtcttgtctttccccttctcagatcagcagaaaagcagcagaaaaacatggtgttggattgtagtccctacagatttggtacttccaagactctcccactccagcaaaaagaaaggacactcataacctttcctttttttctactccatggtaaaaatctagagatgggtatagtgcaaaatattcagattttggagaattattatccattttgtacttaaaaaaaagaaatcttttgagaatttaaacccattgtttaataggatctcaaataaagcaattgcactaaaattcaagccaaagaagccattaagaactgatcatttatttggaggaattaatgttattttcctttaaggaaacaaagataagaagcatagatgttttaaatgcagttcttaaaacaatcttttcttcttaatgcttcagaaattgtttatgatcaaaagatgcttctgcgtttttatattaaagccctgccttgggcagggagcaaggagaatatatcattattagtgggaagctcgcaagaaagatgagtgtcccccactctctctcctcctctctggagtccaactgcagctgtaactttggctctgaaatttgaacaagggaggaagaaggctggatctggtgtcaactgtgaacgtgatttcccccaaggcaagagccaccccaaacagggcatgtactttaaattgcttttcgggtaaaggtccgaggtttccattgaaccagtagcctaaagttgtgaacccaacacgagacttcctgtattcccactctgcttctaccacaaaccagttttaggagcttgaaaagatcacagagctgctataggcctcttttctcccctctgtcaagtgaggaactaggaggaggtggcttttagtctttttcagtttctgactgtgtgaaagctatattcttcctgactggtgaaagctttgtatattatccctcacaagggatgttttctttttaacaagaaaacaacaggagataggtaatatcagcaaatactgcatgatttctcgtataaaaaggcatctaaaataatcaacagtatggcgatagagaatagaatggtggaagggcatggaatcagggggataacgagagctgttactcaataaatataaatttattcaagatgaataagttccagagatctcctgtacaacgtgatacctatagtgaacagtaaagtattatatacttaaaaatttattgagagagatcttgtgttaagtatccttgtcacacacacacacaaagaggacacaagaagacttttggcggtgtggatacgtttattacccaggttgtggggatgataatgtaactgaacccaggactggccacttgctacttaaaagccagacatgacagacgagggttggtaggaggaaaatgaggtttatccatagagccagtacaccgcaaagagggtggactatagcctcaaagaccatcttaagtcagcacaggtgttaggctgtctttatgttaagggcagggggaagagaaggggaatctagatcaagagctgaccaataactgcagacatctgggcagcagcaagggtccgagaaggttgagaacgtctttgtcctgggtcaggtcacaatgctcctataaatccttaacaaaacagagttgtttacatacttccccctttaatcccagatttagttgtaaatctgatttacaactaaatacatgatttaatgtaacatcacatacatttctgttacattaggattagagacaagttctatttagaaataacttcaacagtttttatattttattttcacattgaaaatcggtcagacttgcttcagcctcaaagagcatgtttatattataattaaatgagcactggtggtgagctgtagtttctgtttctaaatgggaaatgggttaaaccaaaatgaagttaattatattagtttttttgctgtttcactgttacagtaatgctagtgtgtagacatacatatgcgtatatgtatatgtgtgtatatatatatatatgtccaacctcaacaaaattgtatacattaattatgtgcagtttttagtataccaattagacctcaataaagctggaaaaatgacaaaagaagacagatagcatcctgagtgcctccccaacctacctgaaccccagtagattggtgtgtaggtaggaactggacctttcatctctgtcttcccaatgtccagtacactgggcacttagtaggtattacataaatgtgtgttactggtcggtttaaatcaacaacctgatacctttctgagagtagaatatgagacctagtttaggtaccaggtaaagagattctaacctgctttctctacgtaagactaacctcaccctggccatgttaattccaatccttaatcttttaatctaatgagttaactatcagttgtataatttttatctgattattccaattcatcacatttaattatcttactgtttctgccttccattagtgaggaggagaaaacatttgctaataattttattatgtagtagggactgtagtaagtactttatatatcccatcatattttatttaacagcattctcaaaaacactgaggtagaaattatgacacttattttacaggtgaggaagcagctcgtagcattttagtaacatgtccagattctcatcactaagcagcatcatagctaggactggaaacaagcctgtttccaaagcctgctttttttttttttttcctgcgctcactgcactggagttttcttcccctaccaaataaatcaacattatttctgagattgcataatgggagtatgagggacttggataggaagcagagaactgtctgaaatgacattttctaatattggtggtagattgcattgatccagtgagatgaacatctccatctcactagccacccctatggtcatcaatgtgcatcttgttatgtattttggtgcacctagtggtacaaatgagaccacaaatcttattcttgtgtaaagcatcagattgttttgggctcgccatccatgtcttttgcctcattagagccatattctactcaatccagtgagaaaattgccatagacgacttttcagataacaatgatgaatactactttatatatgtatacacacacaatgtgtgtgtgtgtgtgtgtgtgtgatcaattctttcagcttagtaaaacaaaagtgttagcagaatttttacattcaagttttctgacagtcataatggtaaataaataactctaattctgtttctcaggtgaagcgaagttcggaagttgtcaggctactgaccactctgatggaactagcaaggaaatgtgtgtcatatattattttggaaaaagaggatttttaaactgaattcttaaagttgtgaagagaaaaactgaaacctattttctcctcttggttaccagtgtccatttagcgcccagaaatatcaaatggggatcagagtagccctaaaatgatgccataacacaccttgcaagtttctttcattgtgaaatttgtgagtctgataatacatcttttttcatgtttctagttagcccctttattgcatgattaataaaagcaaagggatgaaggactggggaactcagtgggcaatgtatgcgataataatatctaatcaatttccttctgcaagtttgattacattaagacttctggagaagaaaattgattggactcattcacttgggaacctttcaggaaacaaagtgatttcttttagttttctattgcaactgatattatgggcctagagccaaggaaaaatgaattgtcctatcctaatcaattacttaaatctggtttttataccaagtgttcataaaattggcaaagcattgaatgggtggaaaaatgctaaacaggaaatagaaaaagaacaaatcaaatttaagtaaacaaggatgaaaggaaaattatatgtataatatatattatgtataatgtatataatatataaatatatatttatatattttttgagacagggtcttgccctattgctaggactacagatacacactaccatatctggcttattttgttcattttttgtagagatgaggtctcactatgttgtacaggctgatcttgaactccagagctcaagtgatcctcctgcctcagcctcccaaagtgctgggatgacagttgtaagccactgcacccgggaggaagaatgcgtattaaaggaagtaatttagccttatctcacctcaggtgtccagacatttattgagcacctactatgtgtccggcctttaactagatgttagaagtctaaaggtgaataaatcatcatatctctaactttaagggcctcccgctctaataagaaaacatgcacacacacgcacacacacacgcacacacacacacacacacagagttgtgaaactactagatggatcaatggcaaagatgaggatagggaacaattatagcacaagaaaaggctcctaattcatagaattaggtaaaaaggtatttgctttgaggcaaaaaaaatacatcagagtgtacaaaaaagaaaaagaaaaactgtgtggaccacaggattttgtaattgctgagcatgctgtgtgagacatggaagcttacaacatgaggagcagtgagggtaatagagaagatggattgtagaaaatcataggtgctgctctttgtgaagcaggttgtacttcaggcagtagaaaaccactgaatgtttttaaatggtggacaatatggtcagatttaggtgttgaagggatgattctggcaccattatagaacatgacttttactaggaaaagatgagagaaaaaagaccagtgaggatatagagattttccttgtatgctgcaaatggaattcctctttcaattttattttgaaggatctccactggatttaagtagtcaatgaattaaaaaataagggagtgaataagaaaggaggaattatagctatagccaacaattaatatctatggctatgaagatggaagttgacttcattgagcaaacaggaacacacttttagtatttaggctaatgagttagcacatctgatcatttatcttcaatctgtccacagaagatcttttgaggtaaaggatttccaaagaagtgggcttatgtcaaatgttccaagatcttgaacaattacggtcctttcagaagggcagataaaatccaatcacaggcataattgttttattgggttttgctttattgagcttcgcagatactgcacttttcacaaattgaaggtttgtgacaaccctgttttaagccaaccctattggcgccattttcttgcagcatttgctcacttcatacctcagtgtcacattttgataattctcccaacaattcaaaatttctcattattattatatctgttatggtgatttgtgatcagtgacctttgataatactattataattgttttggggaaccatgaactctgcccgtacaagacaatgaatttaatcaataaatgttctgtgtgttctaactgctccaccgaccagccattaccccatctctccctctcctcaagaccccctattcccaaagacacaatactgaacttaggccagttaatgacagtacagcggcctctaagtgttcaagtgaaaaaaagagtcacacatctgtcactttaaatcaaaagctagaaatcattaagcttagtgaagaaggcatgtcaaaagcaaagataggcccaaaactatatctcttataccaaacagccaaggtgtgaatgcaaagaaaaagttcttaaggacattgaaagtgctactccagtgaaaacatgaacgatagaaaagtgaaacagctttattgctgatatggagaaagttttgatggtctgcatagaaccaaccacaacattcccttaagccacagcctattccagagcaaggccctaactctcttcaactctgtgaaggctcagagaagtgagaaagctgcagaagaaaaatttgaagctagcagagttggttcatgagatttaaggaaagaagccttctctataacgtgaaagtgcaaggtgaaacagcaaatgctgatgtagaagctgcaacaagttatctagaaggtctagctaacgtaattgatgaaggcagctatactaaacaacagagtttcaatctagatgaaacatctttctattggaagaagatgccatctaggacttctatagctagaaagaaaaagtggatgtctggcttcaggacttcaaaggacagaccttgttaggttacttgaagttgaagccaatattcacttactgttctgaaaatcctgagactcttaagagttctactatctctactctgcctgtcccctagaaatggaataacaaagcccggaagacagcacatctgtttatgcatggcttactaaatattttaagcccactattgagacatacatagaaaaaaaaaagatttctttcaaactgttagtgttcattgaccttgcacctcatcacccaagagctctgatggagatatacaagaagattaatgttgttttcatgcatgctaacacaacgtctattctgaagcctgtgaatcaaggagtaatcctgactttcaaatcttattatttaagaaatacaattcatagggctagagctgccaaacagagtgatttctctagtaggtctgggcaaaataaattttgaaactactggaaaggacccaccattttagatgtcattaagagcatttgtgattaatgagagggagtcaaaaggttaacattaacaggagtttagaagaagttgattccaacccttatggatgacttcgaggggttcaagactccagtggtggaagtaactgcagatgtggtagaaataacaggagaagtagaattaaattttgagcctgaaggtgtgactgaattgctgtaatttcatgataaaactttaatggatgagatgttgcttcttccagatgagcaaagaaattggtttctttttttttattattatactttaagttctagtgtacatgtgcacagtgagcaggtttgttacatatgtatacatgtgccatgttggtgtgctgcacccgttaactggtcatttacattaggtatatctcctaatgctatccctcccccccccaccacccccatgacaggccccagtgtgtgatgttccccttcctgtgtccaagtgttctcattgttcaattcccacctataaatgagaatatgtggtgtttggttttctgtcattgcgatagtttgctcagaatgatggtttgcagcttcatccatgtccctacaaaggacatgaactcatcctttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttataatcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcttctccagcacctgctgtttcctgactttttaatgaccaccattctaactggtgtgagatggtatctcattgtggttttgatttgcatttctctgatggccagtgatgatgagcattttttcatcatcttggctgcataaatgtcttcttttgagaagtgtctgttcatatccttcgcccacttgttgatggggttgtttgttgttttcttgtaaatttgtttgagttctttgtagattctggatattaaccctttgtcagatgagtggattgcaaaaattttctcccattgtgtaggttgccagttcactctgatggtagtttcttttttgtgcagaagctctttagtttaattagatcccatttgtcaattttggctttgttgccattgcttttggtgttttagacatgaagtccttgcccatgcctatgtcctgaatggtattgcctaggttttcttctaaggcttttatggttttaggtctaacatttaagtctttaatccatcttgaattcatttttgtataaggtgtaaggaagggatccagtttcagctttctacatatggctagtcagttttgttaaatagggaatcctttccccatttcttgtttttgtcaggtttgtcaaagatcagatagttgtagatgtgtggtattatttctgaggactctgttttgttcccttggtctatatctctgttttggtaccagtaccatgctgttttggttactgtagccttgtagtatagtttgaagtcaggtagcatgatgcctccagctttgttcttttggcttaggattgacttgccaatgtgggctctttttggttccatatgaactttaaagtagttttttccaattctgtgaagaaagtcattggttgcttgatggggatggcattgaatctataaattaccttgggcaatatggccattttcatgatattgattcttcctacccatgagcatggaatgttcttccatttgtttgtatcctcttttatttcattgaacaatggtttgtagttctccttgaagaggtccttcacatcctttgtaagttggattcctaggtattttattctctttgaagcaattgtgaatgggaatttacttgtgatttggctctctgtctgttattggtgtataagaatgcttgtgatttttgcacattgattttgtatcctgagactttgctgaaattgcttatcagcttaaggagattttgggctgagacgatggggttttctagatatacaatcatttcatctgcaaacaaggacaatttgacttcctcttttcctaattgaatgccctttatttctttctcctgcctgactgccctggccagaacttccaacactatgttcaatagtagtggtgagagagggcatcctggtcttgtgcctgttttcgaagggaatgcttccagtttttgcccattcagtatgatattggctgtgggtttgtcataaatagcctttattattttgagatacatcccatcaatacctaatttattgagagtttttagcatgaagggctattgaattttgtcaaaggccttttctgcatctattgagataatcatgtggtttttgtcgttggttctgtttatatgctggattacatttattgatttgcatatgttgaaccagccttgcatcccagggatgaagcccacttgatcatggtggataagctttttgatgtgctgctggagtcaatttgccagtattttattggggatttttgcatcaatgttcatcagggatattggtctaaaattctctttttttgttgtgtctctgccaggcttcggtatcaggatgatgctggcctcataaaatgagttagggaggattccctctttttctattgattggaatagtttcagaaggaatggtaccaactcctccttgtacctctggtagaatttggctgtgaatctgtctggtcctgcacattttttggttggtaagctattaattattgcctcactttcagaacctgttattggtctattcagagattcaacttcttcctggtttagtcttggaagggtgtatgtgtccaggaatttatccatgtcttctggattttctagtttgtttgcatagaggtgtttatagtattctctgatggtagtttgtatttctgtgggatcagtggtgatatcccctttatcattttttattgtgtctatttgattcttctctcttttcttctttattagtcttgctagcggtctatcaatattgttgatcttttcaaaaaaccagctcctggattcattgatttttttttttgaagggttttttgtgtctttgtctcttccagttctgctctgatcttagttattttttgccttctgctagcttttgaatgtgtttgctcttgcttctctagttcttttaattgtgatgttagggtgtcaattttagatctttcctgctttctcttgtgggcatttagtgctataaatttccctctacacactgatttaaatgtgtcccagagattctgatatgttgtgtcttcattctcattggtttcaaagaacatctttatttctgtcttcattttattatgtacttagtagtcattcaggagcaggtcgttcagtttccatgtagttgagtggttttgagtgagtttcttaatcctgagttctagtttgattgcactgtggtctgagagacagtttattataatttctgttcttttacatttgctgaggggtgctttacttccaactatgtggtcaattttggagtaagtgcagtgtggtgctgagaagaatgtatattctgttgatttggggtggagagttctgtagatgtctattaggtccacttggtgcagagccgagttcaattcctggatatccttgataactttctgtcttgttgatctgtctaatgttgacagtggcgtgttgaagtctcccattattattgtgtgggagtctaagtctctttgtaggtgtcgaaagacttgctttatcaatctgggtgctcctgtattgggtgcatatatatttaagatagttagttcttcttgttgaattgatccctttaccattatgtaatggccttctttgtctcttttgatctttgttggtttaaagtttgttttatcagagactaggattgcaacccctgcctttttttgttttccatttgcctggtagatcttcccccatccctttattttgagcctatgtgtgtctctgcacatgagatgggtttcctgaatacagcacactgatgggtcttgactctttatccaatttgccagtctgtgtcttttaattggagcattagcccatttacatttaaggtttatattgttatgtgtgaacttgatcctgtcattatgatattagctggttattttgctcgttagttgatgcagtttcttcctagccttgatggtctttacaatttggcatgttttttcagtggctgttactggttgttcctttccatgtttagtgcttccttcaggagctcttttagggcaggcctggtggtgacaaaatctctcagcatttgcttgtctataaagtattttatttctccttcacttatgaagcttagtttgtctggatgtgaaattctgggttgaaaattcttttctttaagaatgttgaatattggcccccactctcttctggcttgtagagtttctgccaagagatcagctgttagtctgatgggcttccctttgtgggtaacccgacctttctctctggctgcccttaacatttttttcttcatttcaactttggtgaatctgacaattatgtgtcttggagttgctcttcttgaggagtatctttgtgatgttctctgtatttcctgaatttgaatgttgacctgctttgctagattggggaagttctcctgaataatattctgcagagtgttttccaacttggttccattcttcccgtcactttcaggtacaccaatcagacgtagatttggtcttttcacatagtgccatatttcttggaggctttgttcgtttctttttattcttttttctctaaacttctcttcttgcttcatttcattcatttgatcttcagtcactgataccctttcttccagttgattgaatcggctactgaagcttgtgcattcgtcacgtagttctcgtgctatggttttcagctccatcaggtcctttaaggacttctctgcattggttattctagttagccgtttgtcaaatctttgttcaagatttttaacttctttgccatgggttcgaacttcttcctttagctcagacaagtttgatcatctgaagccttcttctctcaactcatcaaagtcattctctgtccagctttgttgaattgctggtgaggagctgcattcctttggaggtggagaggcgctctgatttcatagaattttcagtttttctgctctgttttttccccatctttgtggttttatctacctttggtgtttgatgatggtgacgtacaggtggggttttggtgttgatgtcctttctgtttattagatttccttctaacagccaggaccctcagctgcaggtctgttggagtttgctggaggtccactccagaccctgtttgcctgggtatcagcagcagaggctgcagaacagtgaatattggtgaacagcaaatgttgctgcctgatcgttcctctggaagtttcatctcagaggggtacccggccgggtgaggtgtcagtctgcccctactggggggtgcctcccagtttggctactcctgggtcagggacccacttgaggcagtctgtccgttcgcagatctcaagctccgtgctgggagaaccactactcttccaagctgtcagacagggacatttaagtctgcagaggtttctgctgccttttgttcggctatgccctgcccccagaggtggagtctacagaggcaggcaggccttcttgagctgcagtgggctccacccagtttgagtttcccggccactttgtttacctactcaagcctcagcaatggcgggcacccctcccccagcctcgctgctgccttgcggtttgatctcagacacgctgtgctagcaatgagcgaggctctgtgggcataggaccctctgagccaggtgcgggatgtaatctcctagtgtgccatttgctaagaccattggaaaagtacaatattagggtgggagtgacccgattttccaggtgccatttgtcgccccttcccttggctagaaagggaattccctgaccccttgcacttcccgggtgaggcgatgccttgccctgcttcggctcatgctcggtgccctgcacccactgtcctgcacccactgtccaacaatccccagtgagatgaacccagtacctcagttggaaatgcagacatcacccgtcttttgtgtcacttacgctgggagctgtagactggagctgttcctattcagccatcttggaatcgccccccgaaattggtttcttgagatggaaactactcatgctgaagatgctgtgaacattgttgaaatggtaacaacggattaagaatattacataaacttaattaataaagcaacaacgggatttgagaggactgactccaattttgaaagaagttctactctgagtaaaatgctttcaaacagcatcacacattacagaaaaatatttcatgaaaggaagtcaattgatgtggcaaacatcattgttgccttattttaagacactgccatggccaccccagctttcaacaacaactgccctcatcaattggaagtcatcaaaatagaggcaagacccttcactaggaaaatgtttccaactttttgaaggctcaaataatcattggcatttttttagcaatgaagcattttttaaattaaggtatgtacattttcttggtcataatgcttttgcacactaactagacacagtataatgtaaacataactttttttttttatttttttttttaggtggagtcttgctctgttgcccaaactggagtgcagtggtgcaatcttgggtcactgcaacttctgcctcctgggttcaggtgattctcctgccttagcctcctgagtagctgggattacaggcatgtgccaccgtgcacagctaatttttgtatttttagtacagacagggtttcgccatgatggccaggctggtcttgaactcctgacctcaactggtccatctgccttggcctcccaaagtgctggaattacaggtgtgagccactgcgcccgggcaaaacaaaacttttatatatactaggaaaccaaaaaattcctgtgactgttttgtagtattcactttattctggcagtcttgaaccaagtgtacgatatctccaagatatgcctgtacctgtcagagttctactttgcattcaattacagctattaatctcctgcaagtcattttgtctctctgaagttttttttttttttttcttaaataggagaatactatttatcaactcatttcatgggattattgtgatagtgaaataagaaactgtaagagaaaaccttatacttttacaaatctaattgcttttattatcattattgtgtatgtgtgtgtttgtgtgtgttcactgttaatctcaatgcccttcttactatttttctcccccttaaagcaaccttgttcattctcactttcccttcaggtatcagttttctaataccttcccctcatcaaagtctaagtagaaaaataagatataagctattgacatgttgaataaaaacagtgagtttctactgctaggaattccatatcttgtcttggccctatcagccttgaaactaaaataggaattttcagggttcttatggaaaggtgagtctaatggtttgaggcacacacacatatacccccattatatgatttatttcagagaaaatcatcctagatacagtcccaatacagtcagaagccttgagaagctgaaaattggaaggaaaatgtggatagtgtgtgttcctatgagaatttccatttcatcatacagtaaaagtctatgctggctctcatacatttctataataaaatgtatcatcaatatcatcaatgaaatatatatatgtatttcatgtatttatatatttcatatatatataaatgctgaattaaatataaaacttaagtatattacatatctattgaatactgatttcagcatttttggatttgaggcctgctgggagcactgtgttgactcaatctaccacattgcccaaggctggccatccttcacatagtcttacagctttctctgcccacaactccaggtgtctgtgtagctttgactggcatctctgcagagctgagggggctgtgggaatgctgtctttctccaggcatccacagaggggctggcttcaggtttagtttagtcccatagtccacttgtgggtcagagaaatacattaattaggttagctcctatgtgagttattgcttcgcaggttaaaatcattctgattctactttggtaatatgcaaggattttcaaaacattttctaagagtgtgatatgtgcagcaagcatttaaatttagatatcaaattgtttttattgaatttcaaactcaaaagtgtttctaaatattgtcattttggaattgggcccccaaaaatagtaaaaatagatgtttaggtagagaaacacatttgtgtagcaatgcctcaccctgctacagctcgttcgctgacactgcccaacaaacccactgaggcttggtgcgagaaattacctcattaaataatcttataaaaaaattgtcagatgtaacaaagactggactctctgagcttttctctataaagaatgcattgttaagttgatcgggttaaggttcagttagtccaaggtagggtttatgaataggaagaaacttgtcattcactttgtagatgagtaaagcatgtgaatttaggggaaaatatcatcagtcacttcctcaaattgtttttggaagtagcaaaatgtcaaccatattattaaataaggaaaccatacttcttaaataaacttccctagaagcagatctagagatgaggatttgatttgtgtgcaaggaatttatgaaagggagtgtgctaaggaaacaatggaagcaggacagggaaggagtcgaaggggagcaagagggagggcccaggcagaagtcctcaagctcagggcgtagatctcagccagtccctcaggtgtcctcaggagtgtcagagttttcccaactggaggagaaaaagctagactgccattttcccacccccaatggtcattggttaccagcatgtgtggaagatggcagtcctcaggcacttctggctcctggaggctctggaaggcaaagagaagtctgccaaagaatatcacagatgatggccattggaagctttccaagggttcaggttttcagaactgtttagaagagatgggaagagatttgggtcattacagcactggccgcagcactgtctgctatgtaagtgcatgactagatggaccttgagctattcttcaggtccagataagggatctatgtgtcattttaaacactggcttcatgtacttgcctgaccacaaagggcaatgtcaccaggaatataaagtcaaataaaatgggtcctgtaaaagacaatttgctgctgggttgcagtttaatccatgacctcttttgcttacatgagatcttgaaagaatattaaattaagagttatcttctatgctggcataagaagcaaataattttccataatatggaaataaaatatgtgaaaaatgttaagtttcttgaaacaagagtttaaccagaagttaataaacaactctttcttcaggaaacctttgactcatggtttatacatacttttgtattaagttgtgtagcataaaaataaaagtatagcagtagtatactaccactggagtgtcattcctgagatagccagatgttcagttattttgaaataaccctggagtataacagtaaagctaccccctcaaaaaagttttttgttattagaattcatgatattaatctaagttaatctctccattcctttgtgctcctcataacatgttgtttaaatgtctctacagtactgattccatcctattttatgttattattatcttgatggctgtattagtccattctcatgctgctgataaagacgtaccagagactgggcaatttacaaaggaaagatatttattggacttacaatttcacgtggctggggaggcctcacaatcatggtggaaggcaaggaggagcaagtcacatcttacatggatggtgcaggcaaagagaggagagcttatgcagggaaactcccctttataaacccatcagatctcgtgagacttattcactatcacaaaaatagcccaggaaaggcctgcccccctgattcaattaccttccactgggtccctctcacaacacatgggaattcaaggtgagatttggttagggacacagccaaaccatatcaatggcaaaaccgtataaggttcatctttagatcatccaaaacatttgtcactgttccagctcatgatagatgtttgaaaacatttgaatgcatgaattggcctacaatttcccttctttgaaacatcttgtcttttattataatagccaagtacatttgctctttgaataatgattcaccatacactctcctagctgcttgttaattcttaactttctctcccttgttcctttggaatctgttatcagtgtttcgacaggatgtgcacaagtgtcagagcatatgttgtctgcatatgtaccaaagaaggcatatctttctttccttttctctgcaatattcttctctttaatgcaactataaattcccagaacatacctcctattttgagccaagaatcaggctttgaataaggtttcgctcatgtagagtaggattctggatattcagcttcaatagtgaagctaagaattctacgtatcttttcctactagcttggaaaatatatcttaaactagtccttggctatgactttgccccttctcaggaatagacacagtgtgtttatgcaaaacaaacacagcgttttcaaagatagagcaagagaaaaaagagacttctctaataggctttaatacaagaatgaatttcatggatttatttcagagcaaatcatcctcgatgtggtcccaatacagtcagaagcctcgagaaactgaaaattgggaggacaatgtggacagtgtgtgctcctatgagaatttcagtttcatcacacagtaaaagtctatgctggctgtcataattttttataataaaatttatcatcaaaaatactaacaaaatgttgcaaacccaacacattcacagtcttctatagttttaaacatacactaaggtcaaagccaataggatagtcagctgctttaatttaggagtaacacgagaatgggccagcccctagtagctcctccattacctggtcatatgcgatgtccactatgattgcatcgtagttacactcctgggaaaacacacctgtatccgaaatctcccaaatagcaaatggtagctggaatagggaaataggtggctatcactgagtggaattaagatccctaagtaagtgaattgtagagaagctcatctttgatcagggtcataaaaaatctggtgctggaaggcagggattaggtgaggctgtaaaaccggatgccccaaagcaaatttgctttgtctttctttctcctcacagactcattccttatcttcccaattaatgctatcactgttctcccctggtaccaaagcttaagacctatgggttgtttggacgcctaactcttaccctgcttgtccagtcacgctctggtaattgcgtttctgctttattccggttgccttgatttaggatttcatcttctcccacttagttgagtgccattttctccttcctgacctctcatattttttgtgactttttttttccatctgagcagctagactgacctctcgtgtgttttaacgtcagtcctctcttccactgccagccatctcttcagtcccaggtttatctccatccctatctcctcccccagctccgtggcttctccccactgtctcctcctgtctttgccatggtgatggctactgtggagtggagtgttggttaggggccctggagccccacccttctagtttcgaaacccacctctgccttattacctgtgtgaccttgggcaagttatgtaatctctccaactgtcattctccttatttgaaaaattatactaattaatgcctaactcaaaagattattttgaatattaaatgagataatgcccataaagagtttagcacagggcgtgttatacagtgaagtattcacaattaccattgaagaaatttgatgattagcatttgatatcactgaggctaggagatgcagcaagaacttcagtgggtaaatttctaggcagacaaacaatattactaaaatagaaggtatatgagccatctgcccctttttacaaggtatatgagccatctgcccctttttacaaactacagaacatttaaaattaattcaataagcagaattcctggtattattattaaatatcaacttttcaattgacctggccataaaccatctgttggttgataaagacacacatcctaaacttacagaaatagtaccattattcaactttatatgccagtggttcatttctttaacaaatatgtagcgctctccttcatgctatgctagactgaactaattgttcaggacgtcagaggacaagtttagttcttgctctgagaaaacatcatctgtatgagtttgcaagggtttccataataaaataacaaagattggatggcataagcaacagaaatttattttctcacagttttagaggctagaagcccaagatcaaagtaccctcagggttgttttctggtgagggctctcttcctggcttgctgacggctgccttcttgttgtatcctcatatggcctttcctctgtgcacacctgctagacagagctctctttctcttctaaggacaccaatactatcctatcagggagcatgccccaccctccaacctcatttaactgtaattgcctccttaaaggcccatctccaaatacagacctccaaattggggagtagggctttaacgtgtgaattttgggggacataatcctgttcataacactatctaaccaaagaaccagaaaaatagaagatcaagggacacctagttcaagtttttaggtgaaccataacctacataagttaacataaaaacatttctgagagaaaaaaaagaatactatgttggtactctaactcaaagatcttggactgagaatcaggttgtttgtgttctaatcttccttctgcagtgaaattgcagtttaggcaaatcaatttctcaagtcattctgcctctctgtgactgaatcaaatgaagcctaatgatgcttataaagttgttttaagacataaaagagctctacaaggataagatgctgtcattttcatcactggctttcagctaaaagctcagcctgatatatttttaccatttcagggaaggcaatcttcctctccagttcaagtatgtagcataatatcaaagaatattgatgttaaaatgtggacttcatgatcaacatattgattagacactattttgaatatgttaagagagaaagcttcaacctacacatccctgtcaaccatcaaccaaccccaatcataaacatctttagcagaagactgaattctccttttcttgaaattccatagtgtgtgttgctttattccaattacacgatgtcttaacatgaaactgtaatgcgattttcattcagttcttaatttcagatagccagaatatatttctttataaccaatcgagaaatgtgactataatgaagtcagcattacttggtaaaaagatttaaaacaaaatgctctttctctactagtcgaactaaaacttgtctgcatagaggacatctgtaacgtaaaggaggtcaggggcatgcaatgaatcaattcaggagtcttcacaagcgcaatcattcttttctactaaactaaaattgttaagatccttttcattttgaacataatcacttttatagtttccaagtacaggaatctttaaaatctatagctagagatgtgtagataagaataatatattcaatgaacttctttttcatggggtgtaatctgtataattgtttaacacaaggaaaaccacaataaagaaatcatgcccattctctggggaaacagaataaaagcacacagggtcaaatatgcaggttctgtgtgtaaatagcactgatgaagtgcatatcttgcacattttacctttacgtgcttccttctgtgggagaataacaaactccctgcaggtctatagtagtgacaatgattaaaacttgggataaagcagaagaggatctgaaattgttagaaaaactctctgatccccaatctgtttgctctactgattgaaagataccagatttaccaacagctgaaactgatgctgggcttgaacacaggggagaatcaagcagcaaaactcagctttttctttcttgtgccccttctagtagagacagtccataaatatttactgaaggaacgaatgaatcacacagacggagcacagttgggcaagccagtctcacacgtcttccgctgggacgaggacgaaatatttataagtcgtgatcaataaaatcttccctacctgctacctttctcccttctaccccatcacgacacaaaaacctgctcccagttcctctgcttgtaccacctacaaggttttcctagttatcccatgctacttccctggggaagctttcttggccaccaaaggaaagaataaggcaggagttctcattgacaccaatgggaccaattgttttctcccatcactgctgtggttaccaccccaaccctgactgctgccttaaaatacacgcattttggtaagggtgagagaactccgttctacaaactgcttatagaccagacacatgaaatgtgcacagttttaccacactctctgagaataacataatatgccatgaagatcttcaaagcccacactattttattttccttctagttaatgatgccttgggctttagggccacagatctctcttttattttgctagttcagtttagtttccacctcaggccctagctgagatataaaggtatgcaagtagagctgtggagaaattgtgctgtgtgttctacaagaaagggtcacatttggcttttggttgcaaatatcctatttacttccaactgaaactcaataatacagcattctgttaattctatccacatgaactcaccgaccgcctcttatctatgtcagaaatacaaagtcctcctcagttcctctgaaactaattttttcatctcgattagcacatctaggagtcttcctccttcaatcatgtcctcctttgtgtcttggttttgatgatttttctcatcagtcctttccttccactctcaatcacatcagactggcatctcttcatctttcttctttctttttgtgtttgaaaccacaagtgtttttaggattccaagttgattgaactctactccatacatactccaaaattttcttaccaaattgtatttctattctttttttatggctgagtaatattctcttgcatatatacactacatttttgttatccattcatccattgatggacacttaggttacttccatatctttgctattgtgaacagtgctgcaataaacatgggagtacagatatctcttcaatatactgatttcttttcttttgcatgtatacccagcagtgagattgctggatcctatgatagttctagttttagttttttgagaaacttccattctattttccataatggctgtactactttccattcccactaacactgtttgatcgtttccccttgcccatatccccatcagtatttgtccccatacaaatttatttcttgtgtgattgacaacttaattacaatattatgacccttttctaatcagtctgggacaacttaaagtctgcagtggctttaaggagatttccttgagagcaattaattactgtgttgagccatcctgcccattttgagatgaagcttatcttgcactgtgtgaccctggccttgccagtgcattcctaaaatggaagaacagcaagtgaggcgtcagcagtcaatcacccgcctagcatgctcccatgctgaatgcttttccttttaagaaccataatcagatctaatgatttgcaagatagaaaagaacactctcatttatcttgcagagtgcatcaaggtatgtgggaaggatggagatataaatgcaaatgaccttgacaacaagctaagaaaaactagtcagaactttgaactcaatgatgtttaagaaagattcatgggttaagttgtacattagaagttttttgaagtaaagatatacaaaatagagtcttaagtcactccaaggtcaatggagtgagatacttactgaacatgagttaaaattgtttttttttctgatcatgcacattaagatgtgatgaatgaaaagtgtgctgcatagcatatgagagttgaaaggtaagtccaagacaccccctttgattggaccctttattggtacacttaatgataagtgacagaaccgcaactcaaacttgcttaaagaaaaaggaaattttaggtttcataaaattaagaagtctttagactggcactagtttcaggcacgagtatatccaaggattcacaagatgccattaggagcatgtttttctccctgcacctcaggtctacctgtctttcttgtctttatgctacattcttgtgcaaacatgttaccagcatgcctcccttgaactcagggctcctgaacctaaatttctctacatccaaagggctctgatgggcccatcttgggtcccatgccacttcctggactaaatagtgtgtctacaagatggaatattctgtgtgatggcaggcaggctcacctgatgagaagttctactagaattagggggaatagggaaaggtgctaggcagactgaaacaaaaaggaaggggaccagaggaaacatttcctacagatctgcatgtagggatctgaacaagacataagtcatctacgtggtttataggactgacaatgagtgagaattaagtggaaccttttaggttctgagatctctgtcaacgattggacaaagatgaaatatgaagtaggtttttagtttttgcataaaacaaatgcaattggttatacaatatttggggggaaagaatgataaaagtcaaaagaataaaataaaaatatgtaatctaaccaccataaatgtgtttggcaaatttttcttgcattgtatacaaatatgtgtttatgaatcagaattattcagtatctatactgtatttttgtttaaaatattgagaacattttggcatatgattaaagcagtctacaaaagttacaaaagttttaatggctaaataacagctcatctaatggatgtgtcgtagtccataatcaatgtctgttttacatatttaagtttcccattttttactttcataggtaatattaaaataaatattttgacagcacatctcgtcattttctgaaaattgaatccaactagttaaattactgagtcatagatatgaacatataaaagattttggtgtgtgttgtagcatttctatccataatattactatttttaccagcaatatgtggaacgatccttactgtttcccaaaaatgatgatttttcagctattatattgtgagatatatgaagcaagcattcttgtttcccccacaatatctactcttaaaatcacctagtaaacatttattaaattttaaagaatgggccatagcaagtatatgtttttaattctgcattacaaagccaaaagagagagtctgtgttaatgaagtaaatctctgcttattttaatatcagtaacactcattgttgaggatgtagagaaatgactcttctataaaagcatagtatttcatctggcaattgaagagatgtacatcttaaccccaaaattatttatttggaattatatccaaggagatgtttgatcaaatacacacaaatatatttgatatttatcaatgagatctttatagtatcagaaatcttaaagttatttcattacccatctctatttatttaaaatagatcctagatattcattcagtggatgcaatacagccattataaaggaatgccttgagttaaagttggctgtattgaaatcttgttccaccccagcccaccaaataccagccttgtgcccttgcacaaatatcttgtctgtgactgagttccgtaaaatttattttgagcattaagttggattttacatagaaaaaccttaccaagttctaatgtcaaaatttttataatttttattaaatggaaaaaatgttgatgtgaacaagctatcaaatagcatggctaagaatatcccatttacataaaattatatatgtgtatgtctgcatagagatccagaataacattaatcaaaatatgaattggattatttctcatttggagaacattgggtggtttttgctttcctctttatatttttctctattgcttgaattttctctataagtatttattatctgtatgatcataaaaaagttaataattgcatttactttttaaaaaagtcaaattatgtaagaacttctttagaaaggtctgtacttcataggtgactttcccaaagccatgatgccagattgcttcaggatagcatgagaacaaggtctactaatttttgttcatatatttttgttttactaatttttgttcaagtgcctgctatcagctaaaatgatcctgggcaaaaggaaccagcaatgagcttaggctacaacaattagaaaattccaggctttggctgggtgcggcggctcatgcctgtaatcctggcagtttgggaggccaaggcgggtagatcacgaggtcaggagatccagaccatcctggctaacatggtgaaaccctgtctctactaaaaatacaaaaacatttggctgggcatggtggtgggcgcctgaagtcccagctactcaggaggctgaggcagcagaatggcgtgaacccgagaggcggagcttgcagtgagccgagatcgcaccactgcactccagcccgggggacacagcgagactccgtctcaaaaataaaaaataaaaataataataataaataaaataaattaaaaaaaatttccaggctttgaagaaaaaggctagaagttctgccacaattagctgtgtgaccttgggcaaacctcatgatctcccagatcctgtcttttattttctttttatttccaattataaaataattatctgaaaccttctgtacttttaagaacataaaatgatccgaaaactgatgtatttatttatttagttgctagtaggtggttttaaccaaatctcaaaatactagccttggactaagtatttattcagagataagtggaggaattaggtggttgacgtgaatcttcaaaggatgaatttagttaaaaaaaaaaaaaggaaattagtctttaaaattatagagaatttatgatctggaaagtttgttcaagctcaagatataaatagatttcataaagtttcagataagtatgccataggttactgagattttattgctataactcttaaatttgaatcatgagaggcaatcatcgtcccttaacaccaagatcaagagccagaataaaaggggatgaaatgtgtgcaaacacgagctgtccattttgtgctacacaatagctgagtatgtgttgattctttaataagttcgaatgacgacatcaaaaatatacacagcctatgataatcacagccccgaacttggatatttctctaattatttttccttttctcattttactacaaaaatactaagaaaaatacatcctcttaggtacctgcattatactagttactatgcttaggggttacctgtattacctcatttaatccttacacttgactgctgggatgatgttattcctatttacttacaggagaaaatcaagaccagagaggttaagtgcatatacaaatccacggttggaagcaatcgagctggaatctacacacaggttcttctgattagcaatatgtcatccacagttcctgacatattgagctattgctatgtaatgaaggtcacagtgactactgtggagcatgtgagaaaatataaaattacttatctaactgatgagtctaatgaacaccagacgatgttctctacaatcggtttctttgatacagatacgtaactgacttcctttttaattgaacagaaggaacatattattgactcacataacaagggatactttcagaatgtatagtaatttgttctgtgcaagaaaacctgtttggggccacactttttttctgaagggtaaccttcaaggtattttccctgaaccattttttttctctacagattatagaggatctgaaagactaagataaagcactcccattagaagctgtgatgacagacgaacgagttgaatagtgacaggcagtgttgggtccttttcctatttctttcatgaaaatggaaccgtcgttcattcaaccaggagcctggtcaatacggtgagctcctgtgtgtgtacaggaaggggcctttgataattgcataaggcagacaattcatctggaagctctagaaaataagaggtggaaaaatgagctctcaatgtccacctgggttttgaaaaggtagatatttgaagttgtggcaggctgctttgtaattaaactggtcgctgaggtcagttttcatagcagtccaattccagatgtgatcatagcgtcatgagccatgcctttataaatgttacatttcctgggatcaaattatttgccagaatttacttcctaatttaaagagtttaaatgccacattattttgaatagtattttgctatactggtgtttttgtgtcatggaaaacagtcagagggcatggcatggaatagcaaaaaaaggaaaacctccttccaatttctgtagagcagaattcactgcattcgtatcctgctgtccagttttgattcaactggaccaatttctcttttagctactatgataaatgtagtgtttactgaaaaaagctgatcctattttctactctcttatatacctatcttgaagcgtcagaatgctcctgttatctggaaacataatccattatacatagaggttctttctcttctgtgatttgaacctagtctttaatttatttctattttgaactgaatgtaaagctgattacccatcagagaagaagactggcataatcaagtaagacaagggcaggctccttggaatttttcttggatagcttttctaatagactgaaactaattctgagactctacctgtcactatgcacagcgcctaattcccatgcagctgaattagtttgtgtgaaatactctctttctgaggccctagtcacttagaatttatctcagctctgaagcaatgactgttaataacctgaataattgtggaggcattcccctgtactaaaaattatacgcagactaaatcaccacaactcgattatgatggatgcaattaaaataaattatgtaaatgtactataagaataattagaactagaaatgttgatgagttaattgccatgtctatgtacttatgacacagaaatcgaagaaatttggaaaaaatttagattatcttaaagataaaacagatcaaaaagcatgaaaaataattcggtaatggggacaagagaagtctcttcttgacattcactcaggactttgcaaaagagatgaaggtcgcacaattcactacatggaatttagggacttgacaacctgaaggctgagtgacaaagaggcttcgtacaaactaaaggatgaattaggagacagaagtggctttactgctcaataattagaactttgagggaaatctaaggtcagaaagtaatggttaacgtggattaatatatattcaaaaaacaaacttttaaaagaataggaaacataacatcagtgtgaactcaggcttttgtccctcacttttaagctgtgtccgttgtctgaaagcattggcaaccctgcagccctaagtaccactgcagccctcgtttcagctctaaatacaatactgaggcaaatggtgtcatctaaaaaaaataaaaataaaagacctagaagccagattaaagaggctcctgcagacacaggatgagacaaattgaaaatcaaaaagaataatggctgcaactgattaaaacaaattatcgctccatcatttcataataacactcaaaaaaggttttaaaaatttggagcaatgaagcaaaatgtactagacacttttggaagctgctaaggcaccaattcatcatcatcttaaacttgatagttacagggaagagtaagcttgtattctgtccttttagtagaaattgttctttggactaaccaaaagaacttaagatatcagtgaagttttcaaacaggagaaatggtagaaataggaaagcatcattttgtaacttgcagtgaaacaaatttttaaaaacaaattaaaaggtaaaggtgtagttctgttactgctttcaagaaacaagggatatgtaaaaactaatgcaatgagggaaacatttttggatcctgattcaaacaaactattaaaaatattgtttagacattaggggatgtttgaatatgaatcatgtattagatgagaatatgggtttttaaaactaattttagtaaaagaaataatgcattgtattacataagaaaaaaaattttaattcatattgaagaatttgagtaaataacttgatatttgaagttttattgaaggtatcccagccaaaataaaatgggagcagggagaatagacaggaataaatgaaaaaaaatggcaaaacaaataatgtttatgaggcttagtgacggatccatgtggactatattttcaactcttttgcatgcttagaaattttcgtaataaaaagttttttaaaaatcaaaacactgtttaggcataaacacagagagacagacaatagaaggtaataaattaacgtcaattgccattatctattgatttttatgttccctgagatctttacataaaattcaaggttgtaaactctaaatagatgcctacacatgtagtaaatcgggtgaaaaatgagaagtagcagggagttgtgacctcaggcagaaaaattaaccctgctaacttggatggtgacagcttaagtgtatgagtgataagaagtgtcagggagactttagcatagtgacttggggcactgatcttcctgggcatcacctctgtaggggtgtcagacatgaggtagatttgaagaacaaaaacaaaaaagcatattcctagataatttgtcacatttcaaatgtttactgttcggttctgttctcaaaagatccaccagcgttaatagcagccaggcgcagtggctcatgcctgtaatcccagcactttgggatgccaaggcaggcggatcacttgaagccaggagtttgagaccaacctgctcaatatggaaaacccatgtctactgaaaatacaaaaattagccaggcatgatggcacaagtctgtagtctcagctacttggaaggcagaggcaggagaattgctgaacccgagaggtggaggttgcagagagccaaaatcatgccactgcaccccagcctgggcgacagagagagaccctgtctcaaaataataattaatcataataatattgatagcaaacagtagtattacggttaaagccagggccagcttcgtagccatccagttcgcactggttcctatgcttagaaagatcccacatctggtttagtgctgtgctgttgccatcttgggatttctagaaattttaaacaaggagcctcacgttttcattttccactcgacccttcaaattatgtcaaaagtcctggttagagtggcttatatacaaagtttgtagggagtagatttagtgaacttgatgaagttttatagttcattctcccgaaggagacttgttagtcactgaagagtcgcttcacagtatttatttttctttttaacttcccaactcttttggggacagctaagtaaacacagcctctagcagtatggtattacttgggacaatattagcttcataacaatgacacacaaaagcaacatccaatttcaaaacgtgattgttctctagatcaagaattttgttctgaaatataattttcagatataggtgtgcttgctgatagttctaaaatattgagcttgatataaaggcaaacctgtctaaacatatggaattcttttggtagtcttagccatgctaacaaatatgttttctgactacagcttttttttccccactgataaaggaatattttcaataaggaaatgatagcaagtcttgtagttactctttggtatttgcaaggtaataaccagctaacagcaatgtatcaatgattgcatttgtgtagacatcttgaccaaagtcacacagacagtagcagaaagtcacttgtcactgtgcagctggcactcttgcataataaggattaggatagccgatgttttgtcacagtgccaaagttaatcatggtctaaggacattgaaaaaaagctgagaagtgagtgaattaatcatcattaaaaacagatttaaaaagtaatcctgaaggggaacttttaagaaaaaaatactactttgaataatacaaagttctttcaatattaaaaaaatgaaagatgcttctagaagggactccttcctctaagacatcagtattataactgtaggcaggaaatcattttctagaaattaacctttcagggcaattccatcaaatcatgagtttttattgctccaaagaaataaacccttcatcagaataggattctggatccaagtctctttggcatcctccctttagtgtctttatcagagttagctacagaacattaaagttccagaatacttaagtcagtctgtctgttagacttggagggaggaagatgattatttaaatagtcagatagttgtagcatgaaaacaagttattaaacctctggttgaataacctctgaaaaaatgcaaatgttaactttgagaccgatggaataatgtcaccctacctgtttttaatatttgagaatggacacaagcaaggggacataagggtaccttcctcttgccccctgcaaactggctgccaagggacttgtaatgatggcagctgctttgggacagtcaggcaccaatcctctgcccaaatagtcatttgttcttccactcctaactctttgcttgcctgacattttctgagagattgcactatttttcttttcttatgtttttcactcattttaaagaacgcttttttctgaataagctgtttccttaaagtattcaaagaaacaaaattccaggcagaaggaaatttgcattctgatgttgtttagagttccaaagcctgatggatggctgccttctctgtagctcctccaagtcatttcagatctacaggtgcttcatggcctgtcctaaacctgtaagacttgaagtcttataggcttgacttgtaccttaatttccacctccttccatgtaaataaaataaaaaactaatgcctacattagcactggataatcatgaattgttgtttttgttctttttttttaacgtaagcaaatttaaattttctactcttatttctctcagttggctcttgtgtttctagacatactccatagttggtttccttagagcttcaggtaaaaatcttagcctggatcttaataattatacctgatggaccaagagctgggttcagtcacatattgtaaacaatcaaaagctaacttatgaacatatggcaaatgtaattctttgataagaaacaagacagcaagttgccgtcttgattacatagatgtaataggattattgtctttagctatctgttcttgaagtacatacgtagcactttatcaggaaggcccactgaaaaacaaacatgcaactctggaaagatagatttgcttcaaataattaggaaatagaaaaactgtgatgaaagaaaaatagggaatttatttacaccttcaaagtctcttagaatatgtcaagtaaaattgaaaacgaatcaaacacggaaaagaagcaaaattcttcgctgtaagatttcaggaaatacctagctgctaagattcagcaatttaattacaaaactggcacaaaggcacaatttagttgtggtgaggaaatttaattctcctaacatcagctaaaagtctgtttctcgaaaaattgggacacctgttaactgttttacttatctcaccgaaaatgtatctcttaaaagattactgataatgtcacactctcttttctttagttccaagaagttcatggcagccatcatgccaggcaatgagaggacattcctactgctttctctcccctaagctctggtttagtttctgatgccctgaacatcaaggaagagccaaatatcctggccaaagctagttcagctgtgacagttggggtagggagaggtgacgtagtaaggatccttgaccttggttttcagtaagttaattaaatatcttatgactggacatggtggctcaggcctgtaataccagcactttgggaggctgaggcaggcagatagcttgagctcaggagttctagaccagcctgggcaacatggtgaaaccccatctctacaaaaaaatacaaaaattagctgggcatggtggtgtatgactgtgggcccagctacttgcggggctgaggtgagaggatcacttgagcccaggaggcagagattgcagtgagcccagattgctccactgtactccagcctgggtaacagagtgagacactgtctcaaaaaataagtaagtaagtaaataaataaataaaattttacttctagcagccatgggcatttgcttcaggttattctgaagaacaatgctattctttttctttagatttccttccagaaaggaattcttcttagtttcccgttcaatctctcaaggtaataaggtatattttattaccttatttattgttttctatataataagcttttcatgaaggcttaaagagaaagtacaaattattattgtttttctttgacatttacatccacttactgttcctaaggacaattcagtccctcctcccatgcgtaaacctttctatctgattagatccaggttgttactgatagacataaaattattttataaaaagaaattatgttcaatgtaaaaatagtaatccattttaaattcccttcatttctgcagcctgtttctccagacaactcaaaattgtctgaatcccataagacagtttctctgagcatattgtttaatgagagaaactttagacattctgaataaaacaagggaattactgatgtcccaatgctctttgcaatgagtacctccggtttaccattgtggaggaaatattgcattgactttctaccaaaatccatgtcttatctggaagaatgcctactattcattgaaaatcatttccagacctcagataacacaaggaaccagactgccatatcagactcacaaaaatcagagctcttacaaagtatccagctttcctaataattcaaaggatgcagatgatgataaaggcaattcacaaaaatgtctgcgatcactagtgcagctcctcacatcctgtgccacacgaggatgtgggctggtccagatttaatgtttgaggtttctaagtgatgcatgtaggccatcgtttccacaaggaagccattgtggttacgaaacagctccatttgtttgctccataattatatctttgacctaacattttccactgggccatatcccacaaccccaggagttcttcattcatttgctgtaagcaacctagacagactagatacaccccgtaaaaaggatgccacagaaaagggtctcattacctttctgctagtaaataccttcaggaggcctgattagtatgtttccaaggattctttactgggtcatttctctctctctcttcctctcccttctcttcttggacgtcctcagagaagacacgatgggttactaaataagcccaaaccctttccttctcaagaaccatttctatagcaaatgttattacattatgaccttttttaaaaatgtgtgtgcccctctccatatgatgatttatcatttgtaacacactcagagtgcacaaaccatcagaaatccttatctactatggtaaaatttgagcttcacgggaaaaaaaaaaaagaattgaagaacttccaaagagttttcccctcgtctttgtgactggttgcttttactaccctaggaattaaatgtgatttttccctttaaacgtcagatttgggagtattgctccctcttctgctctcagcattcttactcaatgattagtcttcaacattctcacatactctcagccactttgagtaaacgaagatacatcattcaggagtgagaattaattgtaaacaaaatatttagatttaggaagattaaacatttttaccagagttatacattacagtttagaacattaataaatcattgtggctgagttttacaactgtttcagtttcatgtcaagccatgtagataatttttcctggccttctgctccttagaatgaccaagtcctttgaggctgaatctcaaggcaaatggagaaatttcttggttgaagtcaaaccagctgacttaggtagttcttgttcatcaatccattaattcaacaagttgccattaaaccttgtgctctgtggacagtattatcttagattttgggaatactgtaggaagcaaggcaatcatggttctggtcctcatgattctgacctctttataaagacctatagaagaaatcaagaaaacaaattcaactaaagtaattacaaattgtgataagccaaaggatctttgaactgggctttttatagcagttatattcttatgaggttattcaacaaagataactagcacacagaagaagattgcattatggattccggctgctggcattatagtatatggcttagattaattttcatgagattcccaaagaatgaaattaatcatccagtaccagagaaaatcaataaacttcaagctgctttgaaaatactaacataagaaggttaataccttaattgtaaagttatctgaaatggtattaatgacaaatgttttgtctcttagaatacacattggaaacttcctgaatgctgctgaaactgacgtgaattttttcctttgcataatttaatctttagatagtagattccaatcaagattttctgttccaggtacatctttaagcctaatcactttcctctttcctgcttttctcttcccaactccaagcacatgcctgtgcttataaaaaatgacattcaagttctgttttgaatagagtaaggctttagaggtttccttcaaaacagaaagccccgaagtgcctgtttctgtatattcctcctgtacatcctcctgtgcttcaacaatcaccattttaagtacctgccattaattcatccaacccttaggtatcaagccccagtgctgtagaaggctcaaactaggtggttgggggattattgtcacagatgctgtactcgaggaggatataacttcatggggaatatataaataataatagcaccataagttatatcttatcaggcattgagctgtaagattggagaggatggtaataattgtgtatattcaaagtaacacctgaagatcttttaattaatccacaaagcacagaatatacagttctactcacagattaatgatgatctaatgaatccattaaggctagattttcctctgtcgctggaacaaagaacagattcttcagtcaagcaccaaatagagtgggtggctatgtttatgggctatggcatatgaaaaaaaatacatgcatgttaatgcaaaagtcagtcttagtatattaatacagtattagtatattcatatactaactccatgagagacacagggagctacgatgaagacaaaagtaaacttagaatttccatcatagtctcactaatatttgaagtgtatatactcactgagtagatcatgaacacatttatttttctctaatatgtttctctctctctctctctctgtctcacacacacacacacacacacacacacacacaccattcgggtcaacagaaacaacataagaaaagtttcagaaagcataaattaagtgacatcaatggagcaaggaatatatgcaattagtaatagaaaatagtaacaaagtatagctgaaaattcatatagaagaccatgaatattaagcaaaatttggactatattcagtagtttatgtaaagccactgaagatttttgaaacagatagtgacattatgagtttgctgaaaggcaaacaggatgagttcagttgtaagcctactgaatctgagctgctgcggaggcaattagatgcactcatatctagctactgggaagtcctaactagagatgaaggctgatgagccatttccagatgcttttttttttcaatctcttcagtgcctagaacagttccaggcaattaattaactggaattaactgttaattaactgtgctcagtaattaactactgaattaatagtatttatgatattaaggatatgatgcatacataactaaacactgaatggaagaatagatggatgtataagtggggggagggagggagggaggaaggaaggaggaaggaagaaaaggaaggaaggaaggggaaggggaagaggaggaagggaaggaagggaaggaaaggaagaaggaagtttgcctcttgaatttttctagtctgaacctttctactaaatatctattgtgttgttcgacagttatttgtaaacatgaggtcagattctgggcaactttaggcatctcaaaagtttgttgtatgtgcaatcaagagtaaagatccggctgggtgcgatggctcatgcctgtaatcctagcattttgggaggccaatgtgagcagatcacctgaagtcgggagttcgagaccagcctgactaacatggagaagcccccgtctctactaaaaatacaaaattagccaagcatggaggcgcatgcctgtaatcccagctactcgggaggctgagacaggagaatcacttgaacccgggaggcggaggttgtggtgagccaagatcatgccattgcactccagcctgggcaacaagagcagaaactcagtcaaaaaaaaaaaaagaaaaaaaaaaagaataaagatccatgagcagccaatgattgcagctgtgattgaatcactttagttatgagatgcaggctgtttggtggtgaaagctgtggtgttgggagaaatgagagggagaatacgatactttacaaatttttctttttttttttttggagacggaagtggcagtaggaattagaagagcatcttagcagggcatgccttctgacagttgcaaagaagagaagcagctaaaagaagactaaaggtagaacagctctcctctctggggaggcaaagagccgttaaaagttgtcagtcacttctaaggctagcactgtgtttgtgtttctctgaagacttattacatatggcaagttctacgaactggaaagggggtcagaaaggcattgactataagggcaagccaagcccttcttgcttcagtagtttcctggggcatgactgttttgagacagctgaacacttcagtcttcactctcactacccaacacagagcagcagtgtggggagctaagtcaagttgagaagaatattcttgcttgctggactgagagcacaagcctcaaaacagagttcagaggatgttagcaagtatctggcatccctgccttctaacctgcaggctcatcttgctgataaggtgcgtgccattccagttcctgggatcagtccagtgctgagtcaaaacagaaggagctcaaatttactcttggttgcaccctgacactgtgatttctgggttccagcctttattctgtggccgtaccttatactttacctttgctgtgtccatagctttttcccttgttctcaaatctctatctcgtgtattccaaccctgtttgctatgggttattttcttaggtacttggtgtcttgccctacaccatagctcacaggtggttcttggcacctgccatctcagccaccagagcccagcctctacagtgtagagtccctccatctaggagggtcaactgctcctcagtggcccttttatttggctattctattactccaactaaaactctcctgctcagctacacctcatgtctaattttgcttccactccaaatacctaattttcagctataagctgaaagcacactccaaatacctaatttcactcttgaggcattttcaatcctccctgattttatcttctctgttatcacctggattcccagattgacatggagaaagctatgatatggctccctcctatttcctagtggaaggcaaagggtgcctgaatcacaaagttatgttaaccttaaaattgaacatagaattgtctacataaattcaaaaggttgaatgtaggaaaaaaaatggtgagtcaatataatcttggtttatctctgtaatataccattaaaactcactgagaaagatcactagttaaacatattgtaaattctggaaacaaaagctgctgagttctgctgaaatagcccaagagtaaatcacaacacctacaagatgttttatgactaagttaatttttttaaaaatcagaagtcatcatatctctgcttggtgctaactaaaaagccagaagttttggtcagaacaaatgtagttcacaaacactaaggttttggttgttcaaaataaatcacaacaccagaaacttagaaataataaatataaacatagagccctcttttgtggcttttctaaacaacttatttctgataacttcataatgctgctgaagctggtcgaatttaattatgcttgtaaagtctactcatttgtacatgggtaagtcaaacattctggttttaaacagagtaagaatagttttctaaaatatgtagtcagtcatgtcaaacctctggctaaagtactgttattttggtgcacatattctgagtttccatgaaacaaaacattcaacacctatgatattttatcatactcagcagttcaaaagtgccattcatttctgaagagcttgcagagtataagctccatgagagagtggagagagtgcttcaagatatattctctctgtacccctaccagtgcccatctagaagacattcagtaatcacatggtgaataaatacatggaaataaagtttcatatcaattaatcattgggcaagagaatgttttctggctgctttgtccattgttaaatctactatgagaaatttaaaggtaacaattaagatgagacccagaaaagcactcagtgtcatgagtcagcagaggaatgtttttgaaaaccacagtgatataccatgatgcatcccagaatgcctaaaattaaacatatcaacagcagcaagtgctggccagggtgagaaatagcgagttatacatcgccgtttgggatgtaaaatgttatgaacactttgagaaaccatttatgattgcgtataaagtaaaaaaaacatgtggttatcattatgatacatctattttattttcaggtgtttacccaaaagaaatgaagacatatagccacataagaacttgcttaatttgaaatatctcctaattataactaattcagcagtttattctaaatcaacatggaaatgaataaacaagggatgatatactcgtacaatggaatactacccagccaaaaaagggaggaaagaacaaactgctgacattggttacaatatggatgaatctctacaacaccatgaatgaaagaagcaaactcaatgtagttgacactacgattttatttatatgaaattctagaacaagtgaacctcatctatagcgatggaaatgagatcggtggtaggctggggccaagggtagacagaattgaccacaaagaggcacaggaagtttttggggttgatggcaatattaaatgtcttgattgaggaggtgacacagatgtatgcatttatcaaaactaattgaactgtacactttaaatgagtatctcttatggtatgtaaattacacttcaataaagctgattatacactaaataaaactaagacaaatttggaaagttggtacctatgtttataattatagacttttaaaatatattctattatgaataatgcttttagcctatggaatcaattcttcataaaaactcattacataattttttgatattgcttgtaaaatcattcctttagacctattgagtaataacggtgtaggtgaagtagaagaaaggttatatgttaacaagatgtgtccaggttgatcagtatcatgatttatagtcctcctctggtatccgtgagggagagggagagaagggggtagatattgagtctgattcatttattgacatcattggaactttctggattgtttagtgtgcctatggtcagtcttaatcctagccttaatcctgaacttttcaagtacttgaagcaataaattctatttttgcttaagctaattcgtattaggtctctgttcattaattcttttgtacaaaatttcgaaggaacggaaaatttaatgcattaaactacacataaagtttggtagatattttcccccaaaatactatatcttgttctttctcctgtatccctcatctgttctaggtaatcaactaatagttttttatgaataagaattaaatgtttctactttttattgaaagatttcagattactgaaaatgtgacaaaaaatttctaaaataagcatagatgttccttctatgaaaaaagtactgacaatttatctgttgttaaatcatcaatatattgtaccagataccattatttactccctattgacttgttgaagtttaactaaattaactatacttaatccatttctaccctaaacatttatttgaaatcattactacattttaaaacagttgcttgatacaaaagtattttctccatataaataagggatacctttaaattgtttacatttgtaaagtacaatatgtaaacagaattttgaataaattaagaatattttcactgtactacctaaaagcaaacaaacaaacaaaacaaaacaaaacaaaaaacctcaaacgcttctcagacttgcagtttgagctaaataaaccttctttattttggtgtatcactgacagctctgagttgactccaggacaattagaaagaaatttccgtaatacatataatttcctaaggtacaaattttgaagtaaataatggatgccacaaatgtaagttggtcacttatttcttttttctcttgtccattatcttcagatgtgtaatcatttgcaaatatatttactttcaagaaaagccctttttattttactgcttattattactgccactaaataatattattgtttatagggctgtgttctatgctttaaatgcattattatacttaattttccaaacatacatgtaagacagatggaggagattgggagtaccgagagaatgaaaggtgaggctgaatccatagtgtttgcagtatccagataggtgaagtaagaggtgaagtgtcttcatgtgagaaagaattggtgtacttttcagagaaacaaaggctttcttacaggaaaaataagccacagttatagttgcatcatttgtcaagagatttctaaagaatctttcaagataggaaatgagagaaagagaaagaaaggagattatgttttttctatgggagcctgtaaattgaactgaaatgaacagtccataaacagaatggaatatctagggtctggatcctagttccaggcagcttatcacctgctcccaggcagcagaagaacctgaactattccagtgaggaaacaatgctttcactcttgacagtcttccctaaacagtagcaaaaacttcctttcagaaattgaccatgatatcctcaaagttttggtatcaaaaggttttttatctaatgtctcatctgaaaaggttgaagatcacagaaaaatttgagtacagaaatatgtttacaatattactcatcagaaaacatatctatagaggctaaaggggttatgttctgctgctttgcaaaactcagagaagctgagtgggaaggcaaagagttcagatcctaaaatgaaaatttgtaaatcgggaggaagtgtatggctgaacaattcatattaaaatgtatcatgaggccaaactttttaatagtaatctattcatgtcctatatgtaaactctttactatattagtgcttagagcataatttgggcttaatgcatatagattgattgagtgactgaaaagataaatgggaaaaatagaagaatacttttttattctctttctgaacttttgtcattaaaatgtgtatttatttcttatgttcccactgtctttaaaatagcatttctttaaagatgattcatttgaggccacttgtaataggacaaaataagcaattgatgactgatgtgcttattaatggcctcgggtgtcacagaaaacaactgaggcttcaggcaattcatctttaatggcattaatgataccttttgaaggtgtgattactactataaaccagagtcagttgtttatttcaatttattcttcagtatgagctacaaaaaattatgaactgaaaacaatactttagaaaggcagatactcttaaaattagcaaatagctttgctaaattataatataggtcattactgaaaaacacagatgtaaaattccacttcaaagaaggtactttattttccttttccttctagtttaataggagaaataagagattcttgcatcattttaacaaatcaaaatgcaattattcatagaagaaaagcaacatgttaatctttcttaaatttcttaaatgagtacttttggaaatgaaaatgaaattatattagcaaaaatttaattagcacatgtggtgaaagattttatatgattcagttagtagatttggtcaatttatgctaattggcaagtaatacaatagaatcaaattatgtatcatcagaataaagaggaataaacattacaataacatttttcaagtatactttccaaaaggtcatttttaaagaattcgccccttctgaacagcacatactatgttcgctgggagctgaaagagtgtgtcagaattatctggcacttaaacaccagcaaggtgtctggaataactttctcacaagaacacggtgtaaatatcatttttcttctgtttgattattttgaaaaacatgcatacttcatgtgaactatagtgaagtgtctgattatccaaagaaaaagccaatatttgaaaaggtgttattcacaatagagccaaaatagaaacagggtaaaattttgatggaataagtggtagggatgaaggaagagcacagagactatgcttgcatttaaaggcaaagcatacagtaattataactatatttctaggtgaagaagctgtggatgactagtatatttttctccacaagatatctataaagaccattgtttggcttgtattaacatttttgtttgcataatctgacttgggcaagatatgtataagaaatgcttagctataaaacaatagactaacactgggagagtatgggtgatggagtcctctgggttacacggcatgctgtggcatagtgtcctcagctgcaaattagagatgatgatcgtaaccaatttctaggagtgttgagattaaataagctagtacacgtaaatcacttagtatagactcaggaaatgttagctcttaatattttgactctactgacttttttcgtttatttttcctcaacaaagaggacatctttaaagatttgttcattgtccttatgtgtgtgtgtgtgagagacacgatatacacctgtccttttgagcaagagtcaaattctcattgaggtcaaggtgtaatttgtagttcaattccttattcgtaaccattgaatgtggctctgccacaccaaggtaaacgtcttgctgtctccattatgtgcttgggttacaggttgattacacgtgatctatgataatctacaatctatagtctacactactatagtgttgttgtttttttaaaattatttccttgcctaaaagttctatttcaaagttgcaatactgcaccataggtttccctctactttctgtgtaacaagatgagaaaaaacaaaagagggaggagtggggaaatggataagataaacaaggatttttagtttccaaagaaactaaaaaagtcattatagaattaaaatatgcgctaatggcgataaagagtagaatggaactgtttgtgtatttgctttgtggctttctatattttccaaatgttttgatttactatctcagaatagacttagataataaaagtaacaaaaagaaaatgagatttttttaaaatatcttcacaatgatataaaaatatcaagtaattctgcataatctaatggatgtgttagttctctaggggaaaaagtataaaacttaatgagagatataaaagatcgaaataaatagatgaagtgtgatcatggattggaaaactgaacattttaatgatgttactcttccaaaattgatctgtagagtaaatgaaatagcagtctaaattctaacaggcttttctttggtgaaaataaataagctggttctaaactgtagatggaaaagcctagggccaagactagccaaaacattctagaagaagaacatggaagaaatctttctaccatacataaaagcttattgtaaagaaagaatcataatgaaagtgtaatttggcgtaagaataaacacataaattaatggaatagaatagaggactcaaaaattgatatatgcatttataaatgctagatttataaccaaggtagtgacaaagagtagctacagtaaaaataactatgttttaataaatgaggctgagatgaatcggtgtacatttgaaaaaatgaaattggcctgttgcatcacaccatatacaaaaagcaattcttggttgatgacagattgatgtgaaaagtgaaaccataaagcttttagaagataatataggaaaaatcttaataacctcaggttagaacatacttttacacacaaaaaagcacacatcataaggaaaagaactgaagaactgtgcatgaaaagatgctacaaataaagtagagaggaaagctatagaattaaagatattagcaacatataactctgacaaagaactctcatccctaagggggctgaatgagcctttgtggttgattcgtgggtgacatttctaaggcagggaggctacagctgcaagaacaaagtgcctttctattttgttaggccagtggatttgctttgcttcttgttggccttccacatagaggccacaggggcattgtacatagttgaaatttcgttcacattctgacattatatagggtttcatttctcctttgcagtgctgtggttttcattttttctttgtgtcttcatatgtgttttaggcaggatttgaagttgtctggctcaaacttcaagtcagatgcggtcttaaccctttttttttctgttcctaaaatctttttgtaatctttactgtagaattcttaatgttgacataaatttatgaatttgatatattttgtgttttcctatattctctgaaaattatatcacaatattcttctgtattgaaagatagtcctatataatatttctaattgaataattacaatttctttgttcaggttgtaagctaactaatttaccattcccttatcctggggcattttagattccctttttcataaagacaaaaaaaatttcagtgagagacttcttgaataaaacttacaagccataaaattatattttagataagttctctggagtaagataactaggtcaatgtgtataagtaattgtatgcttttaaaatatcttgtaattggccaggcatggtggctcacacctgtaatcccagcactttgggaggccaaggcgggtggatcacgaggtcaggaattcaagaccagcctgaccaacatagtgaaattgcgtctctactaaaaatacaaaaaccagcctggcatggcgcctgtaatcccagctactcgggaggctgaggcaggagaatcacttaaacccgggagttggaggttgcagtgagccgagatcgtgccacagcagagtgacactttgtctaaaaaaaaaaatatatatatataatatatatattattctctctctcgctatatatatatatatatatatatatatatatatatatacacacacaaaaaaaaaaccacaaaagaggtgatttttttccttttgccttgtttctcaactcacagagttgcacagctgcacagttccagtacgtgaattgacttctactttaatttatcatacctgattcagtaagtgattctgtaacctttactttcaaacatctctgacaccattgccttctttcttctccattgtcaccttcctccccagtgaacagaggcagcagtaacctaactggactctagccttgcactgaatccttcttctagcctcagactacttcacattgcctttagagacatctcccacatacagtcataaccatgtcattccacaccctaaaaactccaacggttctcacacaaaatagagccagtccttagcatgtcagaacttccacacttgattcagccacctcatcagagtcatatccacaccctctttgacctgtgatcacacaagtgaattagccattcccctaaaatgacttaattacaaaccatatcccaccacttatgagactgtgcacagtctctaccagattttcagactttctttaagaaagttatatcttaatcatatatgaataccctcatcttcaccaccccatgcctagcagaaggcctagcatgcataggatctttttagctataactaaaggactgaattgaactcaactggattgacggatgaacaatccttactcaaaagatattgaatgttcagtatttttttaatggaagtaatttatgctggtgcagaggtctctttatgacaagagcccatctgagattttgtaggaacacttagaaaaggatagaagtcttgttcattacagaaactgataacacaaactagttagttataactagaggtggtgacttacacctatagccctagcactttgggaggccaaggcggtcgatcacctgaggtcaggagtttgagaccagcccagccaacatggtgaaaccctgtctctagtaaaacaaaaacaaaaacaaaacaaaacaaaacaaaccttgaaattaaagataaatgtgctagaactagtcatcaacatatagtccaaaacaacaactaattctgctctctcaattttcaaactataaagaaactggactaccttctagaaacttccaatcccacataaattcaagccctaatctcttacctggactgtggcagtatactacctcttaactgatccccttccttcttctttgtactctccaaaatattttcagtgccccagtcagagtgatcctgttaaaacattagccagatcttgccccactctcttccagtctaaacttcctaatagcttcccattacactcagagtaataaacaaaaaattttttttaataatcaaccagaacctaaatgacttgattctcactacctcttaaacttcatctcctactaccttaactttcatttactgtgttccaatcatattgacctctttgctgttccctgaaaaatcacccacttccctacctcagcctctttgatttttgttgttttctctgcttggtacgttctcttctcagatatacacacaaccacttccttacttccttttgccatctaaaatttcgactcctcctgccacagtagttaataatgcccttttctgctttattttggtctcttggcacttaatgctatctggcagggtatagattttactcttatgcattgtctgcctcaccaatggagagtaagctccatgtggaaatgaatttttgtcatttttgtttattaatgatttcctgaaacctaggacagaacttaaggaatagcagggaattgattatgaagtcaataatgagcaaataagaaattccatggagaagaatttgctttttggttcactacatgacatagaatgagacagatatgacaacatggtttaaaatgtttaaaaactgagagggttaaaacaatagaatttcttgatggaaattgttatggactgaatgtttgtcccaccccacctccaaattcatgcattaaagcctagctctgtatttggagataaggcctttatggaggtaattaaggttaaatgaggtcataagggtagggacctgatctgctaggattagtcctcataagcagaaatgccggagagctcactggctccctgccatgtgaggacacagcaagaaggtggccatctgcacataagggagagagccctcaccaggaaccagattggatggcaccttgatgttggactttccagtctccagaactagaagaaataaatttccgttaagacacccaggttgtggtatcttgttacagcacctgaaggggactaagatagaaatgtaccttaaaactaatctaacctaagtctcttacttaaaggataagaaaactgaagccagagaagttaagtggctttctaaaggtcacaaagtcagtatataccagaactaaacccattaaccacgtggcagttcagtgctttctctacttactatgctgactcttataccactctatgtagtatatgattaacataaggcagacattcttaaaccttattctcatggaactctgttcttccaaaggctgtagcaggcattttgctattaaaagttaagggtgatggtcttttcacaatatcttatgggggtatttaactgatttttttcactacagttttcactacagttttgtgttttttgccaataaatttttcttttcctataaatacaaaagaaatatatatatatatttatatatatatttataaatatatttatatatatatttataaatatatatatttatatatatttataaatatatatatatttatatatatttataaatatatatatttatatatatttataaatatatatatatttatatatatttataaatatatatatttatatatatatttatatatatatatctgaagaaattctgaaccataattctctaaaagtaattctgtcctttggagatgtagtaggatggatacattaaatatgggtaaattttctgctggtacaattgatcctaattcaaatgacagaattaatgctactcagaattttattgtggggatcagaaaagtcaaaaagagtcccttgacttttcagagccctgcttcctggacttgtttgaaaggcactgatgtaacagcatgacacagctgctcaaaagctattatgagcctaggctgaatcaatagaagataagtgtgcaaatcacagagatctcagtccctctggacttggcactattagaacatgtgcatgttattatatctatctgttgtctattcctggatcctatctttaaggtgttactgactggcattcatgggtaatgttaaaggaatagggaatagtttgggaagtgatgacttaggggaataagaagctgttttcagaactttgaagggctgaaataatgagggaatggatttgttttgtattgtttcatgtgcaaaatcaagctctgtgcacaaacactgcagagaagtagtttttcactcaatataagaccaattagagttgttatccctggaactgttccctagtaaaagtaataaaatgtgttgaaaagtactagaaatgtaccagccatcaatccagaatatacagaggaaatcctgtttaggaagtgatttaaaacagttgatctcaaaaggctattacaacacaaagattctgcccttctatgaatacaaagaactggattatttattataacgaatatgttacaagcaagtgcaatggctgggttttttttttttttttcatgccttgtaaaggggaagagggtaaaggtagaaaggccctggatgactaaaatgaatgtaaaaggaaaaagaaaaaaaatgaatgaagaggaaaaaggaaaagaaactgtaaatgcacaatttgcctaagtcttggcctgtttttcaatgagaaactctgcactgagataaattctattcctggtggctgcccatgcacacacgtggattaatgccttggctgtcttaaaaagtcagctacagtctctgagaccctcaatttttacttagctgctgagatattcatgaatgctatataaaaggagaaagaaaaccattagaagaaatattttcaaggatgatatttcaaattattgcttatttaaataaatattgctaccttacattaaagagataataagatactaaaagcttgaaaattttttttgattctaagagcaggtagaacatacttatccttaaataacaccttttccttttaataacatctaagcaatgagatttttacctttttttcttggtggtttcttctttagtcatttgtttctttctttaatgagtccttcctaatgatgttttatttttcacacttttatctgttttctctttttattaatgcttatagtattcatttttatttttgtagtatattttattctttttctcttttgaaaagtcatacttgaataaagtacatgtctcaaaaaaagacaaggacttttgcattttatattgattccttaattttaaaatttttaggttaagaataattctgtactatccataagtattgctttatgatgactatgcttaagttgttggtatatgttataatatagcatttcaaccccaaatacagatttctgttctgtactcttgggaatttatggaggaggagaagacaaaatttaccttcttcaagtctaaaaattatcacatttgggacacataaatccccatgtatctctttaaggacagcatattatttttaaaattaaaatataaatgtctaaagtagagaaaaaataagttcaccttgtccttatatggaaattaaagatggttgcttaaagaataatttagaatggcaaatgtctgaaggtttgctgtaaattccctgagatcttatatgatgttcacaccgactcagacacatacaaatgtcatctctacagaacggccctgaagagagcaatcctgggagcccggttcccctgttgaggcccctacttgggtcagccctatagggcagcagcttgtacactgggccctgctccccttccctctcctactgacttcaattccattgttttttcaagacctttctaagtggcaggaataaaactgatgatttaatctataccaagacattaatgattaatagtggccccatatattttcccttacatttaatgtttgtattataagggctttttatgccttagctgaaagtggtggtaggaattttaggcccacatcatacacacatctgcaaataaccaatctttttctcatagctataattatgcattggcattttatttacttcctgcaatttctctaagtgcatcattttgttctatatatagtattttaaataatacatctttagcctgatgtatttttgaaatatttgtggatgctaatcctatctctgtcacagagcttatttatacacacacatctttctcctcctgccttaaaccccttggtttattcttcccttgttccagtttactctcctatggaactttttaccatttgatgagatatttttaaggaatttgcagataataggagcttccagaataccttcacctgactcatgcttcggcataaagtccccatattatcccaaaactcatctacatgtttagttttcaattttcttatagccttttgattacagtgccactgaaaatatgtcatatttattgctttatccactgctttctgaacatagacagagacactgtaatatttttctaatactttggaataaaaagaagatagattatttgttgaataaatatgtaaatactaaaacacaagttactttcttgtcatcatgctatagtcttcatatgctttacacagagtatgatttggggtaaaccctagtaaagctgaggaacatataaaatgttcaggaatcacattctggaataatcatttaatgtttatgccatgctaaaagagttgggactattatctgtggaattaaaatttggagaaaagaaatggtaagattagcccactgattgataagccagaggtagcacctgtagtttcatggaggccacagctcagtgatacctcggtccctgaactggaaaataaagctaagcttccatttgcagatgttccagaaaaaaataaattttatatttgtgtttttactgtatttttggtagagacggggtttcaccatgttggccaggctggtcttgaactcctgacctcataatctgcctgccttggtctcccaaagtgctgggattacaggcctgagccaccgcgcccggcctggaaagaaagaaattttatgaaatcaaaggagctgctatatctttttcttttgtaacaaacataggaattttcttactggaacaaacccatagttgacctcttatagtactctatgtgtggaagggagaaaacattggtacttctacaaatgggtttcaccaccttttataataaaaacagaagatattcacaaaaatagctaaaaataaggctagcatgagaaatacacaaattactctttttctattatgaaattagcatgcaatctttttttttgtaagcaatccaaccatttcaaagagggtgtaccctccagataatagtgaataaaaaattcagtgaaagaaagtaagcttatagctgctataattttcagaaccattatgcatcctcttgcagctggttttgttggtgctgctaagcgcatcctcctgggcccatccacttagtatttatgggcatcaactaaggattgaagacgggagattagaataaatgtaaatcttagtggatataagatttttgatgaaaatgtttaaacggtacttgtatgccacacaagaccaatggcaattttcatgttggtcgtaatgtttataaatttaggtatataaatgaaggagaaacgtagagtagaagaaaaaaagatctctgtctttacatataaaagggctgaaacaaataattactctttatgctttgtcagatggtttatagtttattatgatcaatgtaatctcattttttcaagctgttttttagcaatcccgaagtgcaggaagatacacgctgttgcaaaactgttaaatgactgaatcaggactccaagccatgttttctgacttcaagacctgtatttaaattcctatagtattcttggaaaatactagactcagggatgttttcacagagtaatatgttttgaaaaatgtgtctgcgaaactgccttaaaacttgctatctcctgcaagtcatctggagttcaccagaagtctaccttttcaactagtttccttatataggaattttaaaaagtgagcagaaaagcatcacactttacttttgagaaatgtgaggcctccttgaaagcataatctattcccttttaacaaatacatagctcacagtaatgcagagtatgagactaggtagagtgattttagatgtagttatttttcctatttccttatgccacaaaatcattttttcacataccttgtgtaattcctgtgaatgattttcaagggatcttttggcatgtacaattatttatcatcaaatatttgtaaatgaaagttctagaggatgagacagaatatagacagctaatcttacgactgctctgaatgacaggcacagaggcaacacagacatttctgaaggagcaaaatgtcagtctgcaaaattgcctttcctagtttgatattggtcctcactgctcagaaatgaaaacggaaaacattcacgaggcattctagtataattgccagtggctgcttcactatatacagttaattagtatatgcatccatacttttaaaaagcaatacttttacattaacaaaccaattgttaatttaaaaattaacaggttttttttaaagttttaatattataagaatatttctgaggtcagtatttatacctctacagatctacatctagccacagaaaatccaaaatataatttactttggaaataaagtttcccatctgctggtccttaagagtaattgctggtttcactttgaattatcaaaatgacattcaggaccaaaaaataagaggcatgaaactactttcattgctactgtcagcaagtgaatgattcactttgaatttgcctgaagttgtcttacagaacacctgtccaagctcattccggttccccttttgacgcttttcttcactcctctcctagcaaataaatagggtttcttagtctaacacaaggaatagaagtataagaagtggggtctgctagtaataaggcttcaggtatgtgccttaggaagtgttttgtttgtttgttgaatgtgaaagacttagccaggaagggagaataccatttgcatgtataattttccaggttctgtttaaaacaggtattcttttttctacttccaagtgaggagacaggttcctctgaatagagaaatcctacactctgcttaatatcactttctgggacaaatttggttcttatagttctccagtggttacagaatatcaaatgcagcaaggaccctggagcttcagtaactattggtaacttattagttgcctcttttgccaagataatggcaaaaaggaaataatgaaaatgacatatttttatatttctgtatggcagtgctgatattttcttagatcatttttctaatattagaggagctctttatgttgccttatgactgctgacatttcatttacttaataaaatcaagttagcagtagactgttgtagaaaggtagctggacactaagtagaagaactgggctcaagtctcagatttgtcccttttgcctgtggtaatggcaaataagtcacctaactccctggggcttacactgctcacccttgagaaaaagagattggacttgcagcttttacagtggcagtggacatggctagagcttggatagtgctgacggggttcaggaaatactaaggaggatgaagctttgcagatggtaaaattattaatctatgcaatcttcagttatggcatcacctgaagactctcagaatctccagttctatacttaatgaatgactttgaagaggaggatctatcaaaagactggatccctctgcatattgtttacaatcaggttagaacttagattaaatctcaaggaaaacaagactcctaaaagcttactagtcaaggaagcctttcatgcacctgatagaatcctccattcaggccgggcgcggtggctcacgccggtaatcccagcactttgggaggctgaggcgggcggatcacgaggtcaggagatcgagaccatcctggctaacacggtgaaaccccgtctctactacaaatacaaaaaattagctgggcgtggcggcgggcgcctgtagtcccagctactcgggaggctgaggcaggagaatggcgtgaacccaggaggcgaagcttgcagtgagcggagacagcgccactgcactccagcctgggcgacagagcaagattccgtttaaaaaaaaaaaaaaaaaatcctccatcaaagttggggtgactatgaagtagaatctctaaagggggccaggatgttgattttgttccagtgcgtgtctaatacccaatcagaagattatagacatctatctcaccatttgagtaaatgcaaaataaaaataaattactacgaaacatttgaaagttagtgaataaaataggttgaattcagtaagtgctaaggtcatttctaggttcaaatatttttgcaaaatcaggaaggtgcaaaggcaaagcacaagcgtgctaacagcaaatgtgaaaagtatgtcttgcagccaaggcattctatttgtattttgcctgtgtcttagtccattagggctgctacaacaaaataccttaaaatgggtaatttataaataatagaaatgtattgctcattgtttgggaggctgggaagtccaaaagcaaggtgccagcagattgggtgtctggtgggaagccactctctactttacagatagttccttcttgcagcatcctcacatagcggaagtggtaaagaagctctctcaggcctcttatataaaataagcactaatcgcattcttgagggtggaatcctaatgaccaaattacctctgaaaggtcccaacacttaataccattgcattaggggttcagtctcaatgtataaattttgaggggacacaaaaatttagaccacagcagcctgtttatgtcatttcctctgaaccataatcattgctccacccgctaattttactctctctctcctctgccttctcagctatctacaatcaggttgtatagtaactatttatgtgctaatcatctgtgattgtcaccttagggtataatcaagaaaatgatgcataatgttgggaaataatactgcagtttaaatcatatccatattatatttttaagcaaattaagaaatttgaaaccatgtaattagaagcagtatcttcttatctctaaatattcaaagtatggacagtgccaggtacattcacagccattctaatatttgccaaatgaagcaagcctttttcaaatgaaataacgtagttttcacttaaacaatccctagtgtgaaatcaagaaaataatgcataatgttggaaattaatactgaaatctaaattatatcaatattgtatgttttaggtaagttgggaattgtgtgcccatgtaattagcgagttcataaaattatattttaactgcttttccttcaaattgtaggcttttctgagagtttagttgctattgttgttttgtcttcattgttgtttgtgaatttgcaagcacattttaagttttccatttaagaataagttgtatagaaatttaatagacttactacaggtgtccatattacccaagcctctgggctgtttggttctctccaaatagaatgttgagatcaaaatcctttttggtgcttatattagttttctaggactgatgccacaaagtgccacaaactgggtgccttaaacaacagaagtttgtcacctcacagttctggaggccagaaatttgagatcaagatgaccacaagtttcgtttattgctatagacaaaatgtgtcatcccaaaatttgcatgttaaaatcttaacattcaatgtgatgatattaagaagttgggctttgggaggtgattaggtcttgagagtgaagccctcataaatgggattagtgcccttataaaagagaccccagagagttccttctcccctttttgccatgaaaagacacagcaagaaggctgctgtctgtgcaacagtaagcatgccttcaccagacactgaatttactagcagctgtaacttcaacttcccagcctccaaaactgtaagaaataaatttctatagtttgcaagccacccagtttatggtatctttctacagcaacatgaatggactaagacattcctcctgagactaagagaggatctgttccatgcctctctcctggctcctggtttgctgggagcccttagagttccttgatttgtagatgcatcacttcaatctctgcctttgtgttcacatggaattctctctttgtgcatgtctctgggtccagatatcccctttttataaggacagcagccatattggattatagctcaccctgaagggctcgtcctaactacatttgcaatgacctgatttccaaacaaggtcatattttgagatatttgggattagaacttcaacgtaaaaatttttggaagacactattcaacccataacaatgctcatttgttaagataaaaccaaacaaaaaagaacattttaaaacacaaagattatcttcatagccctctacaaactaaaaacatatatatatatatatatatatatatgtaacatataataacatataaaagcataaaaatatatacaggtttctcagacatacacattctcttaatattctgggctctggactaatatatatatatatatatatatatatatatatatatatatatatatatatatatatgagtttttttgagtgcaaagagcttgggtgagcagagtgggaaatgagatgaaagaggtaaaagggtcttggttttaggaggatgggaaaccactgaaggttttccagtaattgaaggttttccagtagacatttgacatcatcggatttgtgtttttttatatatataaatatatatgctgattgcaatgttagaactgataaaagccaggcttaagtgattggcagactgtggtagaagacagctgggagctggcagctggactgtgctgcagtggtggtggtggttgttgataaaaaccatcaccttcagtagctatgtgttgggtaaaatgaacacgatattgtgatgcagtggctgtgggaagagggcaggggaaacaccagggacgattcccactttcttatccacaatgccaagagagaaaacactggatacagaccagttttgtggagaaaaccatgattttatatttgcaaatataacactggagttggatgtggctttgtgagactccagtgcacatagcaagtaggcaattgtatgcttccatctggagctcaagaggaggtcttgatgagacataaattttgaggttgtctatgtacagttgatggaaacctgggtgtgggaaagttgtcaccttcagagagaaaatagaatgaaacaggaagagtggctaaaaataatctttaagacacttcaacatctagcttctaggcagaataacacacttcaaactcaggaagctctggactcaggaaagccaagagaagaggatggctcaggagggaagggggagctgagtgttgctgagaggcccaataagatgagagccaaaggagccagtgaactttgtaatatggagcttcttggtgccctaaaacttactatttggtagaataataggtgggaaagccagaacaaagtaggttgaagagggaccaggaaggacaaaaatggtgaaagcaagaatagggtaaataagcgaaccagctagaaaatataggaggctgtgataagagttggggatgcttgaattagagattttggagctggaaaaaagtgtaataacaatgacatatagtaaagatatacagatgaagatggattaagcagctgaagttaaaaaaagattattaaaaacaataagctacagactgggtgcagtggctcatgcctgtaatcccagcactttgggagtccaaggcatatggatcacctgaggtcaggagtttgagaccagcctagccaacatggtgaaaccccatctctactaaaaatacaaaaattagccaggtgtagtggtgcagggctgtagtcctagctacttggaaggctgaggcaggagaatcacctgaacccaggatggggaggttgcaatgagccaagatcgtgccaccgcactccacccttggtgatagagtgagactctgtctcaaaaagaaagaaaagaaaggccaggcacggtggctcatgcctgtaatccccacactttggaaggctgaggcgggtggatcatgaggtcaagaggtcgagaccatcctggccaacatggtgaaaccccgtctctactaaaaatacaaaaattagctggcgcatgcccagctactcgggaggctgaggcagaagaatcacttgaacccagaggtggaggttgcagtgagccaagattgcaccactgcactccagcctgggcgacacagtgagaaaatgcaatgagatacaaaattagaaatcatattctcagatgagtggcatgcatactctaggatgggcaggtcctcaccagacccaaagactctcaacagtgaggagggggtctgggaggttggagatgacagcaagatggagactgagaggatgatgtgccggatggcatgagcctcacaactgtgacctttatacaagggcttgaggagatcaggcatgactagaaacttaagcctcagttccacccacaaacctggactgctggggatggcagagagaggcagccaccctttgaaaagcctgcagaggaagcagcagcgtggggagtgcagttagtacagagtgggagggaagacttgcaagggagatatttgagagaactcttaagatttttggaatggatttcagaaagcactgtggaggcctggcacattggcacatgcctgtaatcacaacactttgggaggctgaggctggaggatcacttgaggccaggagttcaagaccagcctgggccacactgcaagacctccatctatacataaaatttaaaaattagccaggcatggtagcatgtaactgtagtccctgctactcatgaaactgaggtgggaggatatgtggagcccaggatttcaaggctgcagtgagctatgatcatgccactgaactccaggctggacaacaggccactatcctgtctcgaagaaggaaagaagggagggagggaggaagggagggaaaaagagagagagagagagaagacaagacaagacaagacagtagaaagatttcaagagttgttgggcatcagagaagtacagggctgatgatgggaatagtgatgcatatggtagagaatgaatacctgaatacctgcaggtgtgcgctttcacttcagtattacaccatgaaaatgggattgcaaagcatgtaaacatcagcactggtactgcagatggctggagaatgcatcccactcagctggggtggatgtggtcccaggagtcccaggcaatttggtatgatgtgggtgcttcagtatcagccaggtacagctcacaggatatgtctaaaggagcaactgaatttttcagacagatttgtagacccaattttgtaaatatcactttcatggaaaagtggggagaggtgacacaaagtcaaatcaaatattaattctgtttgaagcgattccaaaatagtcattgtataccacatggttagaatcattaattaatggcttaaattattcattatttttagctgtttttgtattctgtagttatagcctagagctgtactttaacaaaaagcaacaatatttacctatgtgaagtagttatgagtatgaggaggtaattttttaaggtgcttagaaaacaggtttgtaaaatagcagacttttaacaagcaaagaaaatcagtgctgagaaagctagttagtaacatctcattagtaagacttttttcattttataataattaattaggcagccacattaggcaataatgagagctagtaatcacttttttattatggaaattagactggactcattttaaaacaacacttaatgcatatgctgtaatgaatatggaaaagtataagttgcttaagcaaaatgtataagattttgtactcctcccacaaaaataagtgactaaagatgggttgaaaagcagagttacttttctcaacttgtggattgtggaagtacattctctttgtattcttgaaggactgagtttataaggtggactgattttgtattctttgggatagtattattctggacaggatgcatttcattttcttaatcctttgccactagaaatgcaacagaggttattaactcttgttatttgtgcagaatcttggatcacttaaattatttgctgcatatttaagagactcacaactaaatgtagagttttaaacatctactggagtatagattgctctcaagttgtcaatttgatgaatcctaaactgtcctagtcaaattttgcactcctctgaagaccttaaagaggtaacttttgtaagaagcagaatgtataactttaccttctgagaaattagacaattgcaatatgaccttttcaggcatagtggggtgtggcttgaatgcttgaatgtttgttcttaccacttattttccagataagctaacaaatacttagagaaatcaagatgctcaaccagagtcccacacagagaccatacttcagtgatgtttatgctctttgttgctcaaagtcatgccagaatatcttcactgttaatggcactgtaggtccttatcttcattccctaggccttacataccttctatatgcaaatgacatcaaaatttatctctcacaccatcctctttcctgagctgaagacttgtattttcaacttgctatttaatagctcccttcagaaacctcatcagcatctcgatactggcatggcctgacctgcctccaacccccctcatcatcttggtggatgcagcggtgacgcagccagttgctgatgcaaaaaatcccaaaaatcccaggaacctctttccgttctcttactcccacacctcatggagaccctcatgaatcatccagtaggatatactttttttttctttttcttttttttttttttttttttttgagacagtgtcttgctctgtcagccaggctggagtaaagtggtgtgatcttggctcactgcaacctctgcctcctgggctcaagaaattctcctgcctcagcctcccaagtagctgggattacaggcatgcatcaccatgcctggctaatttttttatatttttagtagggaaggggtttcaccatgttggccaggctggtctcaaactcctgacctcaagtgatctgcccgcctcggcctcccaaagtgctgggattacaggcgtgagccaccacgcccggcccaatagagtacactttaacattagaaacgaagtcctatcgttgccaactttaagacctaccctatatctaacttctcaccactatccaaaccacaaacaacctttcacttcctccactgcagtcacttcttggctggtcgttctatttactacatggcagaatattttattttctaaaatacaaatccagtctccccactgctcacaattctctggcatcttcttatcactcttaggatgaaactgtgactcctccccagtcttacccatgactcctctgctttgcccagacatccagccacacaggtgaatgtactgacagcttccaagctcttacctttgccccttgtgatggttaatattgagtgtcaacttgattggattgaagtatgcaaagtattgcttctgggtgtttctagaagagattaacatttgagtcagtggactgggagcgaaagtctcccagtgtgtgggcaccatctattggctgctagcagggcaagaaaaagcaggcggaaggaggtggaaggtgttgacttgctgagtcttctggtcttcatctttctcccatgctggatgcttcctgcccttgaacatcagattccaagttcttcagcttttgcactcttggacttacatcagcagtttgccaggctctcgggcctttagccacaaaccgaaggctgttctgtcggctttcctacttttgaagtctgggactgggactgagccactattggcttccttgctcctcagcttgcagaaagcctattgtgggacttcaccttgtgattgtgtgagtcaatactccttaataaactctttttcatatatacatatatcctattagttctgtccctctagagaaccctgacctactatacccttatttctgcctagaaggttctttccccaaatctttagttgtcatgtctgtttatcattcagcttcccgcttaaatgtcacctactaggaagagccttcctcaactgtcctgtgtcagaaagtccaccacccaccccagcacccctccagccctgctcactttcttcaacatatatatcactatccgaaagtattgattcatttccctatttattttctgtctttctttccaaaatgtgggcaggaggagcttggctttgcttactactgtctccttaatgcctgcatagaggaacagagttcagtaagtatttgtcgaatgaagaatagtgatacacttcttcctataatttgatttttaacctctggagattatcaattggctcacctccctgctaaaaggaaacctgatttattgtaataaccctacgttctctacgctactctatccccaaaactctgctaatcatattatttccatgttgttataattaatgttacttttatcccattttataacttgaatttcacagttgtttagatgctattctatgtttgcatggattcaatattcgccatcatttctctactgtgtcttccttatccatctcatggttgactgtagtttactatttaataactttttaaagaaatgctcgtgagagttaaagtccgagaacacttgtttgttgggtaatataaaccctccacctatgtggcagtttttatgggcatggtcattattggatcataacttccacctctgagcattttgcagacgttccacatctcctaggactgatctctggatacccacagaaatatttgctcttctttttcgataaatttcctgtaatattctcatttttaccaaagcctacaagtattccttggaagtttctactttcagcaaattcagttctctcttgtaaagttacttttctattacattattatttttaaaatgtcatctgttatttctagttgcacgttttgtctttcattatttttgtctctttactaatattaatcaactttttgtccttttccattttattttgttcatttttttctcatttgtcctagatgcctctgatgacattttcagtaaagccagtttctcctcttgctgattttcatttctgtgttgattttttcccttccatttctttccaaaatctatcagttcacttttcaactacctccattgtcctataatatcttacctgggagcttctagaccttctttgggctcctgttacttacatgacatatagtcatacattttatctgatttgtcatacctcttgtttgatatatatagtctttctctggccttctgtttgctgtctctctctctctttttttttttttttttcatttaggtagtatctttgcataggtctcatgctttctttttggtatttactcatcactgaataagggaactaattcggttatgaagataaaaaccagctatttgcactaggagagtataaggaagggacaaggatagtaacccaggacaatgcaacacagtttgcactgtactctgatgtcttcagcatactcatgcatcctctgccccagacataaatgtgccctcagctagcaggaaaactccctgtgaagctgtgagatgcccattgtgggtttcctctgtactcattgagctcttacttctcttcagttggcaaaaagaggtaacttcaggaacatgcgccatacacatgttcttctctacgtggccacatggacaagtcaggcttcagcgaaaggacacggatgtcatttcctcatcaagtctcctcttccccactgctccgtgttgcctgccattccgggcatagagcggcttggcccagaaaccacacaaatgggccttgttgttccaaggtgggtctcctagtgtttcccctaagggcaccacctaattagaagcattctttgcttggtcagctctgcctaagttctacaggggatgtggtcctctctctgtgccccttcacctgcagccttgctctcagaatctttctccacgtattatagtatattattcaggcatttccaaataaagacagagtttcttttttaataacaactttatgaagatacaattcaccactgttaattataccatttaatgctgttagtatagtcacggtgttgtgcaactatcaccacaatcaattttagaatcgtttcagtaaccgaaaagaaaccccatacccatgaataaccattttctatctccgccaacttctcagccctaagcaaccactttctgtatctatggatttacctatcttagactttgcatataaatggaatcattgcaatatgtggcattttgtgtcttgcttctttcacttagcataatgtttttgaagtcaatccacgttgtagtgtgtgtgtgtgtgtgtatatatatatatcttagtacttcattccttttattgctgaataatatatctcattgtatgactatgccacgttttatttataatttatcaactgaaggacaattgagtttacatttttgcctgttattaataatgcttctatgaccattcatctacaagtatttctgtagatatatgcttttaattttcttcatatatattgatgagttgaattgctgggctatattgtaacagtatgtgtagcctttgaggaactgccagactgtttttcaaagcagctgcaccattttacatccccatcaacagtgtataaaggtttccatttcctcatattcttggcaacatatgttattgtccatcttttttattatggccatcctactccaggtgaagtaataattcagggttttgatgttaatttccctgatgactaatgatgggcatcttttcatgtgtttatcggccatttgtttatcttacttggagcaagtcttattttgattttttgcccacattttaattgaattattaatcttctttattaatgagttgtaagagttatttacatattctggttttatcaggtatatggttttcaaaaaatttatcatctgtgtgttgtctttttacattattaacagtatcttttgacgcccaaatattttaattttgataatattcaatttatttattttcttactttgttgcttgtgcttaagtatcatatctaagaaaccatttctaattcaaagacatgaagacttactacacctatgttttcatctaagaatttaatagttttagcagttatgttcatgtctttaatccacttgaattaattttgtatatggtgtgagataggggtcaaactttatacttttgcatgtgtataccaggtgtagcagcttcatttattgaaaaatactgctttttccccattgaattgtttggcactctggctgaaaatcagttgaccataactctgagagtatatttctatttaattgatctatatatctatttttatgccaataccacactgccttgattactatagctttgcagtttttgaaattggaaagtgtgagtcctccaactgtgtttttctattttaagatgcttttggctgttctgagtcccttgaattttcacatgaaatttaagatcagcttgtcaatttctacaaagaaatcaggtggggatttaatacaggttgcattaaatcagacctcaagttagggagaagtcccatataaacaatattaagtcttttgatctatgaatatgtgatgtgttttcattcattcagatttttgctttctttcaacaatgtttgacagtttttaaagtataggtttgtgccctttttgctatatttagtcctcagtattttattatctttgatgctgttgtaaatggaattttctcttagttttatatttagattatttattgcaagtgtatacaaataaaattggttattctatatggatcttttattctgcaactttgctaatttttagttataatagtttttagtggattccttatgatgttttatatacaagatcctgttatctttagataaataattttaattcttcttttataatctggatgtatttaatttatttttcttgcctaattgccatgactagaacctcctataaaattttaaattgaagtgataagcacatacatccttgtcttgttcctgattttagggggaaggtattcagtctttcaccattaagtatgatattagctgtggttattttctaggtgtccttcaccaggatgaagacatttccttctatttctaacttgttgagtgtttctatcattaaagggtgttgaatttagtcaaatgctttttctgtatttattgagatgttcatatggttttagttctattccatgaatatggtatattagagtcaccggttttcagatgttaaaccaatcttatacattcattttattcatgagatatgatccttttcatatattcctgggtttgatttgctagcatttcattgaagttttttataccacaattcataagagatttcagtatgatttttttctggtgatgtctttttctcgtttcagcatgagggtaataatagcctcatagaatgaatagggatacctccttttctatgttacgagtttgttttgcagaaatcaccagtgaagcttgtacttttctttatgggtagttttttttttaaaaacaattaattcaatcttatttgttaaaggccgttaatatattctatttctttctgggtcagttttggtagtttgtatttttttaggaatttgtcctttgcatcttgtttaatttgttggcatatattagttcatagtttcccttatcatcttttttatttctgtaaagttcgtagtaataccccatatttcatttttgattttagtagtttgagtcttttccattttgttttcttggtgagtctagttcacagtttgtccattttattgatcttttcaaagaattagttttgattatgttaactatctctgttattttctataatttattttgtatatctccactctagcttttattattttcttccctattcttgcctagcatttagtttgctcctctttttttaatgacttcagatgctgtttgcatgacatgtgtttttccatcctgtcactttcaatctatctggtttctttgaatctaaagtgtatctcctgtaaacagcaaatagttgaatcttgttttttattttatccagtctcacaatttctgccttttaattagattgtttaatctattcacttttaatgtttttattgacatatttgtacttatatttgccattttactttttgtttcctatgtctcatgtcttttgtttctcaattgttttattactgctttcactgcattaactaaatattttctcctgtttgtcttttcatttctaattttatttgtcagctttcgttggtttcaggtgttcaggtggtaaggagaagcagagaagacattgctcttccattttaaattagaagttatctgtctaaggtcttcaagggcaaatatttcataatacttttctacccccatagtagatatgtgtgaggttcatcacaaatcctcctctcccaaacatcttttcagtttggttcagtgactgagtcattaggtgctagtaaagaaatctgggttttaattctagctctgttattaactagttgaatgatcatggaatattcatataacctctcttggacttattttctgacatataaaatgagagggttgaatttgattttatttaatttcccttttagcactgatatgctaaatttccagtaatactgtgatcatatggatctaaatacataagcacataagccaggcagagttaggcattttgcttcttgcaataggcaatcttatctacaactgattttgaagcataggatttaactagatccacaatatagtaaaataattatttggcccaaactactcactggccagtagcccacagattatccccttatgtgtaagagaccatgatttgagaatagaaggaaatacagactttgaagtgattacaaatataagctagtccaagatgcctcatgagaataaaagctttatgtggagtcctatatctatgtccaataatttgtttaaaggtattttgttagcaaatccattatccattgactgtctacagtgtgcatacctctcaagagtggcttatgtactataacaaaaacacaggagacccgctctaattggcctcattttaaaatgaaagggagaataaacacagtggcacctttaattattaatgacaattgaaggaagccttagcacaaataatcccaaagacatttctatttggcttggaattttaatattgtttttgacagatctatttacctaattatattttatctaggatagtgtttaaatgaggttctgtttgctaagcacttaccaacagagcagtagaagacatggctacaaagtgtattgcttatagcaggaagctggtccaggatttattaaaaaaaaaaaacataaaacatgttttgtgaattatccataacaaggaataccctcatgcagataatcaacaattgaatacgcataaaacacagatgacaaaaaaacaaggaagcttctctataaccaagcacagctgggcaaggatgcacagagatgctgcaggggattcatggggtgactggagtcgagacaattagtctgtaaaagcttcgtgctgatgccctcctgcagcacatttccttaacatctttaaaaatgcaccagtccagctgtttcatggagcatctcaggcttttaagacctccgtttttttgtctcattcattctctttattaccattaacaaagagtgggtcttagacagctgaatgttctacttacttaatgatcaagatcgtggagatagtttcaataatctaatggataaagaatccagaaatatcttaaagtttgtgttttcaggcttattctctgagtgtcagtccctctcaactagttcttacttagtcccaccctgataccatgctgtcaaattacttgctattaacttacaaatcacattctcctgttataattctcgttgagggaacatcagtgtcccccctaatttcacctacatggttacctttgtaaaaaaaactatctgagacacctgtgcttattcatgatactgtattatattgaatggttttagactttagtcttcctttagaaaaaattctcaacttaactttgtttcatgaatacctgtttacttctatatgttgcattttagattcccttcagaccaactaaatatgttcttattgaccatcaatgaaaaaaaaaggtatctaaaaatgggaagtatttaagacttgtactcagtcaaaccctacgtttgagggtttttaagctgtttgataacaaccatcctctgccagcatccccccaatatgtttcataaaatattacttacatggaattttaacagatattttgtcaaaataagttttagaaacacaaagtaaaataatttttttttacactttaggactcttggagctctggatagtataatgtgccttatgaatcttgaatagaggaatgtaatgtaatgcaatctcccaacatttttaatgcatatccattctgagaaatatcttttgtgtgatgttccagcataaattactaaaggtgaagagatacatatttgagctataaagactagatctttttttcctactttcattcccaaataatacaaaaactattcatcaaaatgttaacactaaaacaaatagattaaaaatttcaacataaactgaagaatatggtaatgacaccaagaagttatttaaatcttcagtatcaataattacccttcaaataacactatgttgctactctgagtacttttatattcgtgtctctatcgtggtaatacagccgtaacttgtcttcccacttagaccgaagaaaattaaactaaaaatgcgttagtagggcatatagataatgaataatgtgctcctttagaaaatattaaccatacttctgccaaatacattgttgtcacagtgcacggagaacttcatttcacaaggctttttgcaagattgatggtgtaacttgagtaggtttggcaaaaggagcatgcaaatttcagcaatataattacatcattttcccttatggataccacccaaccgagaaatagatccaatagtcagatgagaaattaaatacagtaccagctttattagtaggtcaattagcatagttttggctacaaggaacaaaaatcaccaaataaaactgacttaaaagtagggtaatttctcatctcaaataaaaagctgttcagaggtaagtttactccaggatgtcagggctctagagatacaactcagtgattctctgggtttttgtcctgtacgtaatggcttcatccttgcactggaagtgagatggctgtgttagctacagatgtaacatctagacatataaacattcagaggaaaaacagaaactccactcttacttaggagtaagaaaaccaaacctttccagtaaggctttcatgaatttccctctcattttattggctagaattgggtcacacactcattcctaaatcctgacaagggaaatggatttaccatgattgatttagacaaatcagactatcctggatgtagggataaaggtatcctctcttcagctactttagaggagtcgattttgggggaaggaaaaaggagagcagagaatgaacactgaacatagtaactgagagtgttcacactattacccagcacacagggtctctgatgaagtctaaccgtgttttcctccttgtttccctccatattgaatttatccaactagatcgcaggcaaagaagatggatgatggtaagcttgctgaagctcaccttctctcacctgcctacacatgcaaaagcagccagtgtaaaaccccaggccttcccataacccatgtgctacacagcaagagaaagaaggagagtttcaggcatgaaaataataagagaattctgcccttatctcagcagttctgtgagtcacttctcctcagggaagagcaattagaaggatagaaagaatggtagacatttacttcccagaatatattagcagagtttcctttttcttggtggaaactccaggaggaaagatgaagtttttctttttgggtaaaagatgaggtgaggggtagaggggaaagcacactagttttaggtgccatcaataatcctgtaggcattcatcctgcaatcatgtagtaaatcataacatttgtcatgcagggaggtaggtactggatgagcattgggaagaagacgtggtcccagctatggaactccaaattctgtgtctccaatgtgatatgggaagtaattataatatgtaagctatttgttatgtctacaaagcattgtaaaaatgtatattaaatttaaaaaaaaggcaagaaatctttttcctgttcagtagttccaaaaagactttaccaaataaatgaaattagtgcagaatttaggaagatgtatagattgtcattagtcaggctacaggaaggaaatcatttcaggcaaagacaagatcctgagtgaaggcccagatgcatgagagcagaaattgtcttccagaagctatgggtaaacctctatggttcaaatatggtgtctagagtgagacacattgctaaggcagaaaatcagcctgaaaggaagattgggtcaagttatcaagtttttttcacaccactcaatattatagttgaggcagaatactattttcctctctccttcctgatctttgccgttaaatctttcagtggaaattatacacagtatgatatatgcagtaagggaaatacttaacaggcctctgtcatgggcatttgtggatgagtacaaaagaaatagaagatacaaattcttcacacaataaatatatagtatgtgtcaaaattaaataagataataatataagacaatgaggcaatagtgccattgcttgtggcaatttttaaactccattttttgagccagtagtgccaaattttgtctatactcccaagtgtcagattcaatcattctgtcatcacatatttattatatgctgtgtgctggataaaaatcttcatcgttgagggaagatttgatttggggatccctcccaaagttatttgtatcaaagtcagctgaataaggtggctgatcatgataaggaatgccattatagactaagacccaactgcaaggaggaaatgagattttttttttgacctgtacactgtgaagcataaaataagaaccataaacttaaggccatttaaaaagagaattatagaaaagcattttaagcaaaggcagctcactttaaaaaaaaaaaagtgactaacttcccacaaagactcctttgaaggacacgcctcatttgggtgtatagatctccctacgtttgttgccatgagccttagtctatcatcatcatacctcaacttagcaagttctatagcatatggaggagacaaaattgcttcagccatttagacaagactgaaatcattgtgggcttccgtgattggaaaaggtctttaaaaagctttgaacccagcatggaccttcactgcaaatacagtcatgtgctgcataatgatgtttcataatgatggaccaataaatggtagtatcaaaatattataatgccatattactactgtactttttctatgtttagatatacacatagttactattttaccattgtgtcacatttgcctgcagtattcagtacagtaacatactgtacaggtttgcagcctagaagcaatgggctgtaccagatagcctaggtgagtagtaggctatcccatctaggtttgtgtaagtatgctctatgatggtcatacaatgacaacatcaactaacaacacatatctcagaacatatccccattgggaagtgacaaagtgactctactggaaaacaaaatatttcgtacaaagcctgggatgtgtgctctgtttattatcacctcaaagaagacttacaaattgggagaactaagatttgtaagagttctcaaacatagagagaatattatgtatcattattatatatcatgcatacattcgtgtatatttacttcttagaaacgtgtatcatgtatatgcatgttaaataggtatgtagtctttggcaacttctatgaagttttttttttttttttaatttttttttttttttattgatcattcttgggtgtttttcgcagagggggatttggcagggtcataggacaatagtggagggaaggtcggcagataaacaagtgaacaaaggtctctggttttcctaggcagagcaccctgcggccttccgcagtgtttgtgtccctgggtacttgagattagggagtggtgatgattcttaacgagcatgctgccttcaagcatctgtttaacaaagcacatcttgcaccgcccttaatccatttaaccctgagtggacacagcatatgtttcagagagcacagggttgggggtaaggtcaccaatcaacaggatcccaagacagaagaatttatcttagtacagaacaaaatgaaaagtctcccatgtctacttctttctacacagacacggcaaccatccgatttctcaatcttttccccacccttcccccctttccattccacaaaaccgccattgtcatcatggcctgttctcaatgacctgctgggcacacctcccagacggggggggcggccgggcagaggggctcctcacttcccagtaggggcagccgggcagaggcgcccctcacctcctggacggggcggctggccgggcggggggctgacacccccacctccctcccggacggggtggctgccgggcggagacgctcctcacttcccggacagggtggctgccgggcggaggggctcctcacttctcagacggggcagttgccgggcggagggtctcctcacttctcagacggggcggccgggcagagacgctcctcacctcccagacggggtcgcggccgggcagaggcgctcctcacatcccagacggggcggcggggcagaggtgctccccacatctcagacgatgggcggccgggaagagacgctcctcacttcccagatgggatggcggccgggcagagacgctcctcactttccagactgggcagccaggcagaggggctcctcacatcccagacgatgggcggccaggcagagacactcctcacctcccagacggggtggcggccgggcagaggctgcaatctcggcactttgggaggccaaggcaggcggctgggaggtggaagttgtagcgagccgagatcaggccactgcactccagcctgggcaccattgagcactgagtgaaccagactccgtctgcaatcctggcacctcgggaggccgaggctggcggatcactcgcggttacgagctggagaccagcccggccaacacagcgaaaccccgtctccaccaaaaaagtacgaaaaccagtcaggcgtggcggcgcgcacctgcaatcgcaggcactcggcaggctgaggcaggagaatcaggcagggaggttgcagtgagccgagatggcagcagtacagtccagcttccgctcggcatcagagggagactgtggaaaggggagagggagagggagggggagggggagagggagagggagagggagagggagagggagagctctatgaagttttatcaacctgcacttttaaggtaacgtgtaggttaattttcacttctcaaaaccctcacttcagatagaaaaaataacttcggaaacagcaataataatagtaataattataataaatagtctaaataattgaaatgaaacctaataaacagacaaaggaaatgatacaaatggaataataatgaacaagagaaaaatttacgattgtgaaaattagattgtaaaatggctttagaggaaaagtactgtaattcacattcctacagttatttgagagaaagggaccaaaccagtttaaaaatgtttttactgagaatttaaaaacaccctttagaaatagaaattcagtttctgactttatttagcaaaaattaaccagcaaaaaccttatgccccccaaaatgtgacctctttctctgtggatagtccagtgtttttcagcctagagcctaattctgctcttgggggacagggtccatgaagcgcaaccctgtgttttgtattcatagaaatgcagccagcaaacttgggtattggatgaactgggcattgtgggtcactctgcccgtggacctgctggtggcaccgcagggaaaaggttagaaactgcatgttctctgccaggcagaggctctactcatgttcttctagggagtcttgccttgtcatttctaccagtcatagactgggagatttgctgaccttagagatagtaatatatttcaaacctcaagaggcaagaatgatatgaaacaaaggatatccctggatttcctctggggctgcgaaagggagtctccacctggctctggaaggctatgtcttgtttccatccactccatttaactcccacttcttggcctgctttgagactgtcagctgggggccaattactgccatttagagaagtggatgctttaatgtgaatacttgtctgcaggaaccacacagagacagctgccttatctcacaagaaccctgtgttgtttatactcagtaatctgccacagagctctctccacaatggggaaacgaatccaatttattctccctattgcctgcacttaatttctttgactcgtttacatgtctgtctttttaagttgaagaaagaatacgaatgtaagttcctctgtggctaagagcatctttgactgtgttcttaacagtctaagacaatggagcaatagtactattgcctgaggcaacccttctgagtttttcaatttattaccaaatttttagatgaattatgatctagtctagttccagatggtgcatctagatctttataaataccagaagcacttacttgaaaagctgccagatctataaagggatctactactatgacttggagttttttcatacattattgtctgttttcataaattgataattaataggttctctaaaagccaagctgttcatggtttaaaaacagctgttagccatgaaaactgtggtgacatctacttaccaaggtatttccagagagacatgtagaatcacactggaaattctgtaccactccctggtgctcttctgggcagggagagtttactccacaatgccacaaaatcttatcagattactctccttttgaaaccttccaaagacttcacactccatctaagataaaactcagaggccctgagcatgaccttcaaggtgctcacccactctcttgcttcagtttttgtttttttgtttgtttgttttatttttagacagggtctcactttgtcacccagactggagtacagtggtgcgatctcggctcactgcaacctctgcctcccaggctcaagtgattctcctgcctcagcctcccgaatagctggggttataggcatgcaccatgacacctggctaatttttgtatttttagtagagatggcgtttcaccatgttggccaggctggtctcaaactcctgacctcaaatgatccacccagcttatcttcccacagtgctgggattacaggcatgagccacccagcccagccctgcttcagtttttaacctcaccacctcccacaccaagctatgtccacagttgcctttttctctgttcttagaaccctacattgatgagcatcagggcacttgtctcacctcataatccagttatcctctgaggcagaatagaaatccagacctggaatctcctcttgtttctgctttccaacagcttcctctcaatcaaaatgacaaatgattcaatatcatttttttttttttgagacggagcctgagttttgttgcccaggctagagtgcaatggtgtgatcttggctcactgcaacctccaccacccaggttcaagcgattctcctgcctcagccttctgagtagctgggattaccagcctggcctcgaactcctcacctcaggtcatctgccctcccaaagtgctgggattataggtgtgagccacaatgccaagcccagtatcattcttgattaattagttgcaacttaaaggagtgaattttctaaatataagattatatcatctaaaaacaaggataatttgatttctccccttccaatttggatgagctttatttctttatcttgtctgactgctctgactaggactttaagtaccatgttgaataaaagtggagaaagtgggcatccttgtcttgttccagatcttagaggaaaggcattcagtttttccctgctcagtatgacattacctatgggtttgtcagatacagcctttattgtgttgagctatgttcttttgtaccctattggttgagagttttttatcatgaaggaatgctgggttttatcaaatgctttttctagcctctattaaaatgatgatatggtttttgtccttcattctattgatgtgatgtatcacttttactgatttgcatttgttgagccatccttgcatccctgggatgaatccacttgatcgggatgactgatctttttaatgtgttgttgcatttgatttgctagtattttcttgagaatcaaatcaaaatggattgagggcttcaatgtaagacctgaaactatgaaactagtaaaagaaaacattgggggaaatgcttcaggacattggtctggacaaaggtttcttgagtaagaccttaaaagcacaagaaaccaaagcaaaaatggagaagtaggattacatcaagctaaaaatctccacacagcaagggagacaatcaacaaagtgaagtgacaacttacagaatgggagaaaatatttgcaaactattcagctgagaaggattagtaaccagaacatataaagaacacaactcaatagcaaaaagcaactaataattgtatttaaaagtagggaaaatagctgagtagacatttttcacatacatatgcccaacaggtatgtgaaaaaatgctcaacatcactaataatcagagcaagacaaataaaaaaccataataagtatcatctcacccaagttaaaatggcttttatcaaaaagataaaataataacagatggtagtgaggatgcagagaaaggggaacacttgcccactggtggtgggaatgtgaattagtatagtcattatggaaaacagcataaaggtttctcagaaaactaaaaatagagctattaatactatatgatccagtaatcccactgctgaatatatataaaaaagaatgaaaatcagtatttcaaaaaggtatctgcactcccaggtttattgcagcactatttgcagtagccaagatgtggaagcagccttagtgtctacctacatatgaatggataaagaaaatgtggtacatatacaaaatggaatattattcaaccataaaaagaatgaaattctgtcatttacaacaatatggttggaactggaggtcattatattaagtgaaataagccaggcaccaaaaggcaaatattgcatattctcactcatgagtgggagctaaaacaattgatctcatggaggtagagagtagaatgatggttaccagactttaggaagggtagtggggaaggaggaataaagaggtgatggttaatgagtacaaaactacagttaggtagaaggaatgagatgtagtgtttggtagcacaatagggtgactatagttaacaataatttattgtatatttcaaaataacttgaagagtgggattgaaatgttcctaacacaaattatatatggctgggcattgtggctcaagcctgtaatcctagcactttgggaggctcaggtgggagaatcgcttgaacccaggagtttgagaccatagtgggcaccataatgagacccctatctctacaaaagaataaaaagttttaaaaaattagcttggcatgagggtgtatgcctgtggtcccagctacttgagaggctgagctgggaggatcacctgaacccaggagattgaggcttcagtgagccatggttacttcactgtactcgagcctggatgacagagcaggtccttgactcaaaaaaaaaaaaaaaaaaaaaaacgaaaacaaaaaaaagaagaggaggaaatgatatatgtttaagaacatggagatccccattaacctgatttttatcattacaccttgcatgctgtatcaaaatattgcatgtgtcccatatatatgttcaaatattatgtacccatagaaattaaaaataaaaaaaattaaagctaaattttaagttttcactgtgttctcagagcacgtagtcattctatccatctatccacccatccatcaatcgagtgcctagtacgtaaccttaaagtgattatatttcttagtaagcacctgctgtatactaaaggtaaaagttattggtctctgtgcatatgtggttgagtttagcagataaggcagaccaacaaacaaatcactatatgatgggggaatagatcaggttttctagaaacatgagtgagagcttctaatatgccctagttggtgatgtgagcgtcaggacagtttttctaagagttgttttgagttaagcattaaatcatgaataaaagatagtttgggttgccagatatttatcaggctttcattgatgcccccttaacatttgccagtcatatgggaagtactcaaaaaatgtttgagattcattctttagtgatatgttcactttcttttttaaaaaaaaaaaataaaaagtagtttgagacttctgtgattctctgtaaataaattttgacttgacatgtctgggaccttggcactgactctcctgggatacctcaattcccctcctttcccctttcctctctctatatatactatatatatgaagtcccattgtcctggcctctccatatggcctctttctgtaggatactggatgatattctgtacctctttgcaatttgttagctgagagccaggaaagtgaaagcaggaactgctgggacccataacatcgaggcccggaaagggcagcgtcacttctatagcattataatgatcaaagaaagtcacaggccagccaagattctggggaggagaaatcaattccatctctcatgtatgtagtggaaaagggattgctggtggctatctttggcaactatctactgcattccctcctcctcaaattaccttattctttctatcctcccaaagactaccatatgtatatttgcactcattctctagatttgacataaattggttgacactaatgacacttccctgtgtctaacccttgtccccatcatccaattctttctgcccttacctggcatctgtaattaatttctttgcctccaatgttacttctctgtttggtagtgcaattgaagaccacataaaaatgctgctagaatgcatctcctttgttagcagatttagtattctaatgtgaaattccttctcatcctttaaaacccagttaaatctgacttctataaagtccttattgactatcccaaagaagaggggatttctctttctaaaatttgtagtaatgtgtttctggaatgtattctagttttgactatggttaggaatacacatgctttacctttctaataattttgaaaactcaaaggcaggcagtaggatatactcattttttaaattttctaaagcaccaagatgagcccattacatagaataagttgagtttttgttgagttgtcagggatctgggaagaatggtttggcttttaggagaggttctcagccaaccaggaaggaaaaaaaaaatgattcagtgattagtgacaacagctttacttctagaatcctcccacctactactggcagcacgagcaggcagcttgccttcctgggacgaacctagatgaggtacaatgtggctggaaagctctctaatactgatctgacatggcatatttcagattaatctgttttctctccttgtttccagtttcagcacatactaatgccatcttgaatcttacttttcctccctggccctcagcttccccatctgtaaataacaaaggctactatttactaagaacctgcatcagtgccagacacagtgctgggcactagtgctaatcctcacaataatagtgaaaggtgcattttttttatttcctccttttaaatgaatatcagatatggaaaggaaaacaacttgcccaagccctctcagcacaactggattgaaactcatcccccatgagtagcatcagggtcaggccagataagctgtaaattcccttagcctttactatgcatctccaccaggatgtaaaatacaatctgctgtttgtcttccaccttctcctagaccagcttttctgcgtcattatttttcttttttgtcttcagctgcagtttctcttatcagttattggctccacaactagcaagtttattttttgctccatattgtattctggtgtgttatgctacaatttgtatagggaatgagacacaatatggtttgctaatgagaaaatctacactgcagagacagaacctatttgttctcagttacttgaaacgtatgttagaatgtagaatctcttcttcattcccgtgtgaggtgctgaggaaggctggaggggttctgattcagtcacatttgattttggagtcaaggtcttggcttcaactcatattgagttttactggaaactgccagctttgttttgggtagacatttgtaaatgtgacagaacagatgactcatctcaagccagctctatgcttttattcaatgtgtgcttaaaaagagtaaacgtggatgttggaaagtattttcttgtaagtactttgtatggcagatgccaagtactgctaaacctaattatttaattcttcttcttaaatagatattatttagttttaatttttaaaaaccttcaactatataattgatatatatcatatatatagatatagatatatatcaataatataattttactttttagcacaccagaagcatattattttggaagatcataggactcagagctctggataggcaaagtagacttggatttacattctctgtgatcttaagaaatctactttctcccttattttcacttttctgtactaaaaaaaacagctgtactaacatgaataatatgtacctcacagggttcatgttgaggacaaaattattaatagataatatgtcaaagagcttgccatataatcagtaggttctttcctgccatggaaaaatttttttagtcagaataggtctcagccaacctctttcatgttccagaatttaatgcatacttgctgattcaatacaggtagaaagtttaatattaatttttattttgttggctttctaaaaaagcagtcttttcacattagaataagtgaatgaaagagatcactaaaatcaaaagttgttacaaatgttattttgattgctatgatttcaaatgcagttttatcttcttataaagttaaaatacccaatttcgtttttaatttatttggaaacaacaacacgactggttgaatactctgtctaaagtaatctctaacaaagaatgactgaagttctactctaccaatgaaaagcaagaaccggggttcctcctttctctttctgtggtatgggagctacatgaaggcagaataaaagagtcagactaggctgggaatcctgttcaagagaggcactcagttacagtgtacatgtcagaattgattgataaagttactaggaagtaggcatgtaaccttagttagtcttgttctccagttttcaataaaatgtggactatacctttgggggttgtgttcatttgtttgtttttaagacagagtcttgctctgtcacccaggctggagtgaagtggcacaatctcagctcactgcaacctccacctcctgggttcaagcaattctcctgcctcagcctcccaagtagctgggactataggcacgtgcaaccacgctcagctgattttttgtatttttagtggagacgcagagtttcaccaagttgcccaggctggtctcgaactcctgagctcaggcaatccacccatctaggcctcacaaagtgctaggattacaggcatgagccaccatgcccagcctactacagtatttttaaagaagagcagtttcacagtgtcaccaaatcatggctttcagatccagagttacaaattgcctcccaactcagcagttcttgaaaatataatattaccgatgtttggctcatgaagactccctagaagcccagtgtcccctagggaggaagtgccaaattgaaaatttttaaataatcgttactgtattttatagcaaataagtatatgattatcaaatatgcttaaaccctttgggaaagaggagcttgaaaacactgtatccatcctttgacagatccatttagcctaattattcaatgatccccatacattttactcgcattcttgacccaaataattcagattatatttgtatgctttttgatatccttaatgtaaaaaaaattcttgattctttttctcattcattcaacaaatacttgttgagtgaagaccatattctccatgagcaaataagtagaagaatctccatgtgggtcctgcattctaatggggaaagagaggctgataaatactaaacgcaagaacattaagtaggtactatgtcagtaaacaaagtatagagtagattagaaggaaaaaaatcaaataatagcaatgttaggggcgaaggagcctggagttgtgaggatggcttataattttaaatagagttgtgggaattggcctcaggaaggaggtgacatttatgagagagttggaagaggtgcagggattcaccatgtgactatgtgggggaagaacattcagatagggagagcggccagtccagaggctcaaggcaagtctgtgtctgagatgttccaggaagaggaaggaggccggtgttcaggagtaaactttgtaacttagtctttcttttctcacattagactttttcgttgttgatgttttactttaaggaaatttatttttgcaaaaatatgtactatttggtttgttaaaataacatctaactcttgaaagatcatttaccttgatagaggcattcatctattctgttaggaagaagcacaggtcagccggagatgtttacagtacagagttcttatataagtaggaaaaaaaaaactgtaataatttaaaaagtaaaaaaaaaaaaagtcaatacaggacctgccccttcctagacaatcacaacgtgtccactcattctactttcagctgccccctccccaccctatccgttcaatatcctgccactctggcaccatcccagccacaaggcctcaggtcctctctctgctctcgctggttttcagagaggcgctcctcagagagagtttctagcactaaaggataagtgattgttatgacaatatacttctttttaaaaaatgcttgtttcatcggagaattttggctggctatgggtaatggaagagatttcacataaaagttgagtccccttctcacaaagcaaatgagcacatgatggatcaaggtgctctgctggtgtagactaacatatattaataatacacacatacctattaagagatctgtgtcaaggaatatacatgtagtatatattaaagacatcagaatataagacaataaattaaattaccttatagtcacctggcttctatggagcaaggagaatttaattaaaccacagaatctgagagaacatttgatccttggttgatgctaaaaaattgtttcactatttgaaaatagtttcaaatcatttcactatttgaaaaaaaaaaaaagcaagttcagatgggagatggactcatagcttatactatgtcgaaatgcattaggaaagattagtttaagatttcatgccaataaaataactttaccaaaaactacctttatggagtactagtctcaccaggggaagttcaaaacatcacattttttaccaggaagttgatgcattcccttggcaagtcaatgggatggtttatgcctagaatctcagagaagaagaaagcctttttagatgaaaaagatagtcatatgtctccaaaccctcatgtgtatttatgtagtggagaggaaactaattgaagcagaaggtagctagatttttaaatgtaatcattaatagtctcacagttgtgttgatagcatccaacagggttaccttctgggcagaaacacagatcactcctactgttcttggagaaagaaaaaggaggaaatgaacacatgctcactgaacctcctagcaaaaaaagtctctctagaaatatatggtccactcccaagctcaccctttaattctccaatgttacttctgtaaaatagcagtcctgtgatattactcactgaacagatgaaattaaaatatttatattctgcacatgcacgcacggaggaaaatctcacttcaattatagcagttaagaagtctgaagtaattttcccagctagcatttggccattccattgagattgaaggaatctggtatgatgatggttcttattaattcaccctctcttcgttttaaaagaatattatagttcctttgtgatgtaaattgtttgggcaatatgatggtgcactgccttgtgactaaaaagtcgacaagctcaaaggacaaagtattcaggaacaatagctaacatttactgttcggcactttttaaatgttctcggtaagataatttttatttctgattcacttttctttttgcctttccaaaagggatttaagttaattactttttctaatgtgactttgatatttcagtcccctcagatcttccaaggaatttacaggtgaaataccattctagttcttttattttcctagaaactctgatattaaatatgggtgtcacactggaaaattccaccagaataaaaagctaaacaaggcataaaatttacattagtaacatcccattaaaccatcatctagaaagcttttgttacatgattttcatcatttattaaattattttggtgtcttttctggtcttttttgcctgtaggactgaaccttgttatgcatttgtctccatcaaaatggtgtagctgcatttggcattattccttcaacattcttctttattttttccacagaagatgaaattagcttggtttaataatagtcattcctgattactctctctgtggaaaacagcttaagaggcacattattcaattaaagaaagtatttgcctcgccctttaaaaccttcattttatataacctattgattgtgaatccaattagtcttacatattaaacttttattacttttagtatagcacttttacatgccatcgggaaactcatcaccatgtaaaatgcatgtagttcctgactttcaaacaagaggtatttcagaagatcactgctaagtcagtgtttcaaatttgaatatacatgttcatcctataaatgatctatattcagcctataaatgatgacatgattatatatatagtcgtcctacaaataatcatcctataaacaattattgggttcctggggtaacagcaaagcaaaataattagaacatttttgttaataatatacctagtaataataatgtagctgggaaaataatgaacaaaataatatagctgaaatagtagtcctacgttttagggacaaggttagaaagaagagagcaccaggggttggagggagagagtggttcctcatatacactgtgataactcagatagtctgcagtcaggaaacaattggtaatccattaattagagagtatgatgcccttttatgaagtgatagtgtagacacaatagcaatattaattagctttcctattgcttccataataaattagcacaagcttagtgacttaacccaaacttattatctcacacaattctataggtcataagtctgagttgattctgctggtttctctgttctgggtgttaggaagatgatgtcaagatgattaacagctgggctgtggaaagaatctgcttccagtctcattcagtttgttggcagaatccagttccatgtgaccataggactgaaattcctatttccttgctggctgtcaacagggaaccagcctctagttcttgcatgtgggccccgacatctcagagccagcaaacatggaatccttctcaagcttggaatctctttgactttctcttcttccacatccttcttctgcttcaagccagagaacactctctacttttaagggttcatatgattcaatatgtcccacccagacaatcatctctctattttaaggtctgtaaccacaatttcgtgtgcaatgtccattttgccaccatggaatacaacatattcacatattccagggatccaggtgtggacatttttaaagggccattatgctgcttatcacaaatgtaacatgttttgagttgttcttcaagggttcaatccacgaatagcttgtatgcacaaaagcacttgtacaaaagatgaccaccagggctccgcgggctgcctgtgtcacagaatcgagtgatgtccactggcctcacagttcagagctcaccagtactctctttcagcagttcttaatcttatttccaaagatacaccccagatatcctttccttgtgtttacatattctcagactctggctgctgtgttaataagtggtgttgagactattgcttaatgtacagtgaaagagttaaagtgattttgtataaaaatgcaacgatctgtttcactaacattgtcccaagcaacagcatgagcagtcgttttttatattactttaacagaatttcccatccacacaggagaagttcatcctctccattttcttaagagtagagagtgtctttagcatctcaaggtttctgtggatcaccaggagccctgccttggagaggctccagtacacaggtgttactgagctggagggcttgagagaggggaccattctgaggatgggggatggagaaagaatgttaccaaggtgaacggaaaggtagcaaagacgggtatgtacgggaaggtctgagattgctgtttggaattgatttttcaattattaattttttcatgtattctgatatgatgaaaaaaatgacagaacacattaatcttatggaaatgtagggtaaaaaagaggatttgagattggaattattctggaaacctggatcttgagctagaattttaaaaataatggagatggttagcctacagttcggtttctgcttgggaactctttttcaaaaattctctggaaattattaaggcaccaactacttgctctgaaaattgataattaaaggggaaaaaactaaatatttattctgactttaaagggagttatatttttcagtaatcaaaataatcacttgatgatgaatagccttttttatggaaatattgcagttcattaatgtgtaagaataaaactcaccattttgcaatgttaataaaataactgatcaaagcaacgttcatcagtgattaaatcctttggataaaatattaaaaagaactagacaatagagggactaggttttcattataactagaatttggaaccctagaacttattttttctcttaagataatgtaacataaagcagactgcaccatctatgaagcatttctgtcaaaagttgaacctaaatctaattgagcctttatcacttacttccagccaccaggaaatagagagggaaggaagcagttaaatgacaccacaatgaaacaaacagagaaatccagaatgaaggacattttataggactactgacacagtttctgccaaaagttaatgacatgggaaaaaaggagaggggaagaaggaggagcacagctgtaaatttaaaaaagaaagaaagaaaaatgacttgggagatttaccaaatacagtatttgaatcttaattcgagcatatcaactaagaaaaagacatttttgaaaccgttagaaaaattttagtatgcactagacatgattccaagacattattgttaatatgtaggtgagataatatcactgttatcttgtgagacaatgtttgtgcttttagagatggatactgaagtattttaggtatgatgttacatgttgctgggatttgttttaaaaatttttagcaaagacaacatatatggcgcagtgtatattgctcagttgatgggtgcaccaggatctcacaaatcaccgctgaagaacttattcacgtaattaaatgccacctgtactccaataacttatgggaaaaaatttaaaaaatagcaaagaaggccgggcgtggtggctcatgcctgtaacccagcactttgggaggccgaggtgggcggatcacaaggtcaggagatcgagaccatcctggctaacatggtgaaaccctgtctccactaaaaatacaaaaaaaattagccgggcatgatggtgggcgcctgtagtcccagctacctgagaggttgaggcaggagaatggcgtgaacccaggaggtggatcttgcagtgagctgagatggtgccactgcactccagcctgggcaacagagcgagactctgtctcaaaaaaaaaaaaaaaaaatagcaaagaaaaaaattaagcagatgtggcttatttttgctggaaaattaatgaatctaaatgatgagtttatggggattcattatatcatcttttctgtatacaattggtagttacagaatttttcattaatttttttttaaaaaaatcagttattcccacataactgtatatcttaaaaccattgttttctacaaagaggtataatattattgtgtggttgctctgtgatggtacgagtaggcatccttattttatcaagtattgtcctcttaaattgcttggtttcttatcatggtggtctaatttctttgaggctctgtatctcaggcctatgttcattgataaagttcctttctctttgaaattcctattaatagacagtcttcaatcaagaacatattagttctgctaatacaatttatatgaaattttaccctactccataatttgcagaagctaatagtgtactaacaagggagcaggagcaataattgatcatatttgctttcccttagagagaagtgcagccatcagtcttagaagactgatgtaatgagtgccaagtgatggatgccccgtgcactcacgattgctagatctcccatgggtgtcctaaaaggaagcacgtggtctgttgggagatgcagacagcagaattatttggaaataggtggagccactgtcaatgagagacgtttcccctatctctattttaaaaaatgcaattctatcttaatcccttccttttttcctcaaaaatttaacaatgctaattctaagcttgtgtgcacttttcccagtggttaattataatccttttctttattaggttttattttgcagccttaaaaaataaaaagaaattaacaaaatggcttaaaggcaaaattagagcaaatctcattttcttaggagactctgcatttcatttattgttatagttcttacttcagagacagggaaggaagagaaggtagcttgatagtaaaataatatccttcaaggtaaattccatgaatgttaagtcaagcagaacttctatttttgtagcattctagagacattgaatccagtttcttgatgtttcttgccgcatttctcactctgttctacagagcaatttggtttacaggtaatttaagcttgggataaagctctggttaattcagtttctggataaaagaaagagtaattcaacttaaagatcaccatagaattttaatcatagagatgagaaagcaaggaaaggcataaacctcgttagtggtataatgggaaaagaattgtctcagatagatggttctagctcttgaagttttgctgtaagctgtaccagcactagaaaaaaggtacaatgggaaatgcagacctttagttttgtccaccttcctgatgttgcctttttcacttcagcttttcaacaacgttgctgaaaaggtctaccagtcagtgcccattatatatacgtttctcttcctttctccaatcccatctaaataatgaattctgtattccagatcttgatcctcattttaaacattcatttcctttatttaaattttacttatattgttattactttataccttaagatattatattttaattatagtgtttttattgaaatgtaatttttacatcatgaaatgcagactctaagcacacagtttggtaaattttgacaaatgtatacacctgtgtatcccacacccatcaagataatagaacattttcatcaacctagaaaattctgtcatgccaattcctaggtcatcagtgcctttcagttcaaaggagaatgtagatctgatttccatcaacagattcatttcacctgttgtggaattttatagaaatagagtaatacagaatatactcttcgaggtctgactttctgcatcagaaaaatattttagagtttactccatgttgttaaatggtatttcattaaataacacacctcagtttattcacctgtttttcagtttgtggccatttgggatgtttctagctttgaaatattgtgaataaagctgctataacatttttgtataaatctttttatagatctatttttttaaaattctacctaggagtggaattgctaggtcataaggtagatatatgtttaaatttataagaatctgataattttccaaaggagttatacctatttacatatccaccagcaaaataatatagttctagttgcttttcccttaccaacatttggtgcagccgtcagagttttaattttaatttggtccattccagtgggtgtacagtgatctgtcattatggttttaatttgtatttccctgatgattaatgattctgggcactgttttatttgcttattggttattgcatgtcttttgttgtttaatgtctgttcaatttgttgtttaatgtctgtttaatgtgtctattttttcgttgctgctttattgagttatataaatactttattctgaatctaagtcctttgagatatatatttgaatgatacatttcctgccggtctatgattttatgatctgcctatttattttcttagtggtaatatgtcaaagaggagaagtctttaattttgattaagttcaatttaaatatttttctttgtggctagcactttctctgtgttatctaaaaaagctttgcctccccaagttcataaaaaatattctcctatgttttcttccaaaagtttcataattttagcttttagatttgttactgatcaatttcaaattaatttgtgtatctggtgtgaggcaaggatcaatttattcatattagattattcagtcatttcagaaacatttgtgaaaaaaacttaaaatgactttccttaatgaattccctaggaacctttgttaaagatgaattgaccatatagctgtgggttatttctagattatcttttctgtcccattgatttatttgcctatgtttatggcagtgttacagtaccttcatttctgagttttatggtaagctctttaggtactaatgtggaagtatctttaaaacagagtgctgaatggaaaaaatgtacagattaatatgtctagcttttgtctaaaaaaagagaaaataacatatgttcatgtatgcttgactttgcattaaaaaccttggaagaacacaaatgatactaaagacatagttacctgtggcaggtagcagtatatagttactagacatatttgtgacaggaatataaagaggaataggaatttttattatatttttaaacaacatgactatattaattatgaaaagattaatttttaaaaagagtaagtgatataggaaatgtattctttctcagagtagataaaacattgagtgggcaattcattgaaataatgttttctaggtcccattagatattttttgggccttgaaatttttaatatctgttttacttgacaaatatttattaagtgccttttatgtatcaagcaatggtaatacagaaggcaacaagactgacatgttcctcatccccatggtatgtatattccagtggagggaaaacacaataaatcataaacaaataaaaaagatattttcagaatgtgataagtgctataaataacataaacatgacagaaagaggcaagatgaatgtgaaatggaagtcctggagaaggtcttccagtgtggtaacttaggaactgagattggaatgccaggaaggattcagagatgtgaagaatttgggtgttggggaggaacctgcaaaggaaaaggccctgaaaagggaaatggctgaagagaaacaggaaagaaggcaaggtggaagagcacggtgaatgtggtgcagaataaaattgcggcgacaggtagggactaaatcaagctgaactttagggaaatgatgaggaatttgggttttattttacatgaaatgaaaaactactaaaagttattggaagttactgaaagagtataatgatctgatcaagattaaaaaacaaaaagcattcattttattgggggaaaaataacagattaagaaggggttggcagtgagaaaggaagaaaatcagaagttacatcacataagccaagaaacaatagtgtttaaaaaagaagaaatgtcccccaaatgttccaactgaggacagagaaactgtccgctagatttagtctcatggaagtcttctatggtctgacaagagcaatttctatggagtcgtgggtagagaagatggactagaatatgatggaaagtggatggactctctattttatactcacctccccacctcactcccaacacatgaaagtgaatgagaaataaagaagtgaagaaagaagatttagatgactctttcaagtgctctatgtaaccgtagatacatggagatgttgtgtatatccaggctggcatatctgtgtgttggtttagcaaatacatatcaaaaattcttacatgaaaagctcctttataacaagatgttctcacttttttagtgacaaaatcccatgaataaatccaaaaagagtctattttatataaaatcccaccctgttggaagtattgcaagtttccactgaaatttttaatctgacttctagatatatttttggagtgttgtctattttgtcagcctgccagattatgtcaaaatgttgatatgtaataacagtttatctcgtgttcctttatccaccctatttacccacctcagctgtgttaactgtccttgactgattccactgcatcattaatactgccatagggaaccgtgccctgatcattcatactgccactaataggatgccaagtggatgtttcaaagttggatgctgatgattatcattgcgatgtatatgacatcgctaagacagcattttcagtcaaaaatatggctgccgtttaaggtgtgagctttttgcctttttacctagaaaaacaatgatatgtaaatttcttattataatttgtattactctactcttatttgctatttgtcaactctgcaagagacaagggttggtacagaaaatatcattttatcagaaggaaaccttgtcttctacagtaggtactaccttcttgagctgattctggataataaagcttgcttcgcaataatccagagttttccaaaccatatatttgactccctttactgactgatatgcaaagttgtgtttaactatatggaaaattgtgaatccttttcatccaagtctacacactccacttgcttttcccttctaccttgaattcatgtgcattcccccagttttctgcctttgtaatggaggcttcagttcttctgcagccacagttgcaggaaacccaattgtaatcagcagctgccctgctgctaaaagctattagtgccaatgttgttaatgaccgacccagttgaatgtgctgatttaaggggtagacttatttcttgtcactccctagggccttgttcttaaatgagatttctacgttgtttagttgtttactcctctagcataaggagtattaaccactaacaaccacacttcgtatatcagcacgttgaattgaaataatggggaggttaagacatatcactacctttgaggtatgaagacacgcgccctgaaaaaacttggctcctacccctaatttttgcctaaagaagttggataccactgcaatttgctctgaagttatacatgttattgtcttcaagggactataggatgagaagggtacagttaggtttcttttcagaactaaacacattagcagtaacctgcaaaaatcaataccaattacttgcaagcaagggcttaaaaaaaaaaaaaattactgaagctacagaatatgcccataggtgaatggcttaaaacaaagaaaatactggcatagctggtactctcacaaaatagaagcaaaagtagtaaagttctcttttatttattttggcattttggtattaatttgtaaaagccaacaactgttatatttaaaaagaaaaataaataaagcagcaaataactcaatataagaaggctattttactgtctccctggcatgactaaggtttgtgttgtctttctagcagacatcaaggcattcagaaggtgtatggggatggcttatctatataaaccagtaaaccttttattcaatacccagacattctgcatgccaatattatgtgtttagtgtctcgagattctatttagcagaaattcactttgaggggcttggtgaagccttcagaggtttaactgtgtagtctctcctttattcaaaaggctgaaataatatttttccggtttctggaattcttaagcttgcatttcagattaaactatcgcagagagtagaatttcttccttccttgtcttctagtagtaaagatggggcacatatctgtaagatgtggacccagaaactctactctcaagtctggctatgatgacgaagtcttgagaagctagtaagccttgctacctcattcaagtccacggtagagttgtgtatgaatgtatggagaggtgggggaagttccaaatactacagaatttccccatagttaacagccctgcttaccaaacaattgaggccatgtggaaatggtacctatcattaaatctcacatcagaaggaacgagttttggcatgtctgtatcgccaatatgagtatcaaaaaaggtaactgtggatcttcttggacagtcattttcctggacttcagtttggtcctccctggtcataaaatgatatgattcttaatacttgaaaaaattgtcccaaaacacaatatcacccaaaaaaaccctcttttaccagcttcctttttttttctttaattgcagagcctcaaatcgatatttaagaagtaagagaagtgaatggtggtcacacaatgcctgaaaaagaaagctctgagtagttgtctgggggacactagaaacaaaagaagtgtgtcacgtgataccataatggcatccagcactttccatatagggaaggcagacagggaaaagaaaattttgcttaacgtggattgaggaagtagtggactcaagtaatggaaaggaaatgaattttacagtattctgaggtactggtaaatttacttgctacggattatactgaaggtaaaatgctgcttaaatagagtctaagattttatgtatcaaatatttacctaatttttaaagcattaaaaatgttaggattcaatagttatagttactttcatcctttgaaacaaaaataattcttgtttcaattttatatgttgagctgttaaaagaaaattgaaagaggcaaacaatatatacttatttgtctctatgggtttgtgcagtttatagatatcctgagcagtgcttctagtgagcgttcttagtagcaccaggttggttgttaatggagtattgacccagcaatttactggggcaagcccttctgctctactcagagttgatgtgttttatattacaattgcatctaataccttattttacaacttcaattaatatagttgggtagaactcgaagaaagtttataacaaagctatgaatagagtaattcattattataaaagtgtactttgagaggagaaactaggattgtttttcctcagaaagaaaacactgatgtatgataatagtattctccaataaaattaaaaataaacatctaaagagacataacatttctgttgagaatagaaaacctgcactcgctgtctgcaaacactgggataatatctttcacaaaatgtttataatccagataaaaagagaagatatatatgtgcaaatcaagagaagaaatgaaatagagaagaaatgagagaagagatgacaaccactaaacaaagagtggagagagagaagtgctctgacagttggagggcaacagagatctctctgcactgaggaggccaaggaaggctttttaaaaagatgatatggggtgtgggtgttgaagatagaaggtgggatgtaaaatataagaaaaagggcaaagtttttgcacgaaaccttaaggtgaccattctcacttcggttccttggtttttgtggagggatagtaggtagtaaaattagggtgagaactttgaggatagattgagggtagtaatttacatcaggctaaggagttgtaggcattctcctataagccaggcaatagaaggccatcagaagtttacaagctgggatataatatgacttttataaacagcaatatgccagttgtgtgaaggatgagtttagagaaagactgaagctgagaacactaagaaaatgttttaacagtgatagggaaaaagtaattggatattttggctgaactccttaatagaaataatgaaaggaacacaaaaggaaaacacaaaatctagttcaatgaatacttaaaatttataagtgatagtataatcctataatttattctgaattaagaatccataattctgattctataattggaactatcccagaattctatgtcctatttgacattagtttgacttaaagattggcttatgtctcaatcaatcaatttgatggtgaccaagaatttcctttcaatttacagtttaatactggccagagaatggaaagtaaaaagccatagcacatgctatatatatgatccatagacttatcaaattcaaatttaatggggagtctaaaacagctatttggcatttataccccaggttttttctaatattttatcagagatatcaaagagacttcaaactcaattcactgactgatataaacagcaagctatttcaacagatagagaacgctgggataaagaaaaagggcttggaatttttttgaagtgaaaaaatatgtgtaaaaaatgcatttctaatagtcacaggacaaaagtggacagaatttcccattacagtaaaatttaatgaattcagttggttcttttaaccatcatatggtctcatcaagaaataagaaagaatatcattaagtggatatccccctttacataaaagctgaatacattttttttttttttttttttgagacggagtcttgctctgtcacccaggctggagtgcagtggtgcaatctcggctcactgcaagctccacctcctgggttcacaccattctccaacctcagcctcctgagtagcgggactacaggcacccactaccaagctcagctaatttttttctattttcattagagatggggtttcgccattcacaggataaaatctgaatacataatacattttaaggactgaaatcccttctataataactttagtaattactcactgttgatgaaaaatatcctaggccaaaagttttctctgtttgccccaagcagatggagtaagggctctgagtcaacctgacttccctctgcatggtgtcaagcactctgtggcttcatggccttgcaatccagttaatccctaggaaccaaacttacccaagtggttgtgtaagttgtacataataaatgtaaagtgcttagcatagcacataaaatgtaaagtgcttaacatagcacataacaaaaaaaattgttgagtaaacgaatattttgctctaaatagtgtgggccacaagatctactaaacaaattagattgtaaaacttctcaagggatatcctcggtgtatttggtagaggaaagaggaaagagatttgtaaaatgattgaaatatgttacttacctttaggattttttttcttgccaagctttgggttttgaacttgcggaatcttagagtcacaggaagaagaaatagatagctcctgtagtgctggctatagtctcatagagcccaaaaaggtaggaaggagatgatttagaaagtatgagagggtagaatgccagggaggtttctgaccagttgttttccaggccaaagcaagtaatgcaatgacttcttgtattaaacccatcatttatttaatcaaagataaagcatatttctattatttctataataatagaaattctacaagaaaggagagaaacctttaagttttccctaaagaaagccattcttcctattcttatgatttctgatgctagctacactgctttcaaaacacacgatcctttagggtacagaggagagaaaaggaattcgtttaaaacatgattttctatgtagatcatcaacgaatgaagaaagaaactagaaaaaagggggaagaaatgggtgaatgtagtatacttatttcagatatgaagatgtgcttccaggtacagcactagaggtacaaattcattctagagctttgttcactgctacttactatctctggaactacagtcactgcagaaccagggcattgaagcccaaggttaatacagattgtagggagcagacaaaattggatcgaagtccagatttccttgttttctaactggaaggggcttgggcatttcatttaataccactaagtttcaatttatccatatgtaaaatgagcctcatagaggtgttataaggaatcatagattactgcattcttccattctatgacataggcacatttcacattttaattgggatgattcttaaaatcaatggcacatcttttttggaagtgccacataaagtcatgaggcatcaaacaataaattctatcttaatttgataaaatacatgaaggtaataaaggcaaagtgcctctgacaacatctggcatctaataagcaccagcaaattgttttggggtgatgctcagtgctgttgctattaccccatgctacaccactcagggaagcatctctttcttcataaatgttcactgatactccagctcaagtgaatgcagtctagtgcgtattttgtgaaagagtaattaaagtcttaaatgtcctagtttctctaatcatctaaaatatcatacttttaatataaaaataataataccttaaaaatgaaatgatacatctttggaacatttatcaccttcaaaggacttgcaatcctcctacataataatggtactatattacttagttcttgggtatgaagagtctgtactgcacatagcactctgctaggcacgagttttccttgttttttctaatacaactttgatatgacctaatttcaccaccaaaaaaaccagcaccatatggcaagttccccatttcccctaaaataatttattgagcctttagtgtgtcccagtgactgaactctttatgctgaatttttctcaagatttcttcaggacatcagaacataatgcagattttttttcaggtggccctctaccaactggatatgaaattggatcagctggaggcaagaacagatggggttgagcagcagatggaaagatcctgtttaggatatgcagaatcactctggcaaaatcaatcatgccacaggagttagtttcagtttggtgaaagaaaatgaactcaagtagacaactgagttaccgggaaattaatacgagctcacactttagaaagtcttgattaagtgtcaataagacagatgagctaatgatgttgaattaaaagtcttaaatgtcacgtttgtcagtgatcataatagctctccatatttagtgcttaccctttaccaggcatttcaggtacagatctcattcaatccttacaaaaaccctgtgagacaggcatttttccgatatcacaaatgcttaaatggaagttctaagtaaattgatcaaggtcataggactctaggtaacagaaacaggattggaacttgtctggctagctggaaagcccacacaaatcatgaacactctactactttccagtgttaaatgatgtgtatacaagaacaattggaggagcatacggtcaactttcagatatcctaaggtcctttccacagtaacaattggaacaggcctgtgatggtcagagtgaccaccgggcatctgcttgaatctttgtggggaatacagagcagcgaggggggccacatggtccccagtaaagcagaggtcacaggtgtcacatacaggctctggtgaatcccacggagtccctgtagaaatctcacatctgcttaccccgagaaggtctcccagaatcctggagctgccttgctccagaagtggatctccatagcaaccttaggccaaaagagtctcatgcacccgttctagtccaaacatgctatgatggactttgtttccatggggcattcaatacatatgtgaatctgagattgtgagtggcttggagtacgtactgtctcagtccattcgggttgctattaaaaaaaaaaaaaaaacataaactaggtggcttataaacaacaggaattcatttctcacggctctggaggctgggaagtccaagacctgccaaggtattggtggatctggtgtctggtgagggggagttttctgttcatagatggctctttctagctgtgacttttcatggcagaggggaaaatgcactctctggggcctcttgtataaggtcactaataccatatgtaaaggctctgcatctcatgacctacttcccccccaaaaggccccacttcctaacatcactttgggtgttaagatttcagcatattaatttggtgggggtcacataaacatccaatccactacatctactttcttcaaaactgtaggcaagctgtaaagaagggaaaatcatttcagcccaagtattcgccctgctttaactttggagcaaaagcaggaaatagaaggaacttatcattcattgactgcctactatttgccaagcatggaaagaccatataatgggttggagggaaaataagataaaagtctgagcaacagatggaaacacatctgccaggtgccatgctctgtacgcattacttcattccatacagcattctcttgtattagtgagttcctgctgactgctacgttactttttcttctcagccaaatgttcaagaagcaggtactggttatgagtaagcatggtgaaaacccattttctaagaaacagaagagatggcaagtgtatcctctcaaagaattaaattttgttttctgccttatttttctcaaacaaaacaagcttttaccaattgcattaccatagccttgctatctatacataggtatcacagaaatcttaatctttgagttttcaagttagaggaattcttattaagcatgagagttaataatctcctgagacacaaatatgcctggtaatatgagaacaataaatgtttgttgggtccaaacatgaattaaagctgtatatgttatgccttaaagacattaaattaatcataaattatagtgattaattacattaaaacagtagcattatgaatacacaagatacaagtttcagtttaaggaaaaaccatattttaataatccccaagtacgcctgtattctgagacactaaaaataattatatgctactaactataccttgaaaacgcatacactcttactgaagacacagaaatgaacagaacagaactaaaaattgaatacattttgtgacacatgatttttttcattgtaatatttctgaaatttggatgcatcttggaatctatgacatcttatagttgccttcagccaggtggcagtcgtgatgtcacaagcaatgcttgcatgtaggagaacaacgtgtaagacacatgtcagcatcttgcaagaaaacctcagagtcaattacagaccactcttattattcctaggacctacttgttttgaaagaagatgggtgagacaatgtattatatatgtttaacatacaggaagcaaaagtaaaaaaagaagtctagttctatgtcattgccaaatgacttaagagtctagcaccacagcattttagttgcttaacagatttaaatgttacattgcgcttgctttggcagcacatatgctaacactggaccaatacagggaagatcagcaaggcccctgcacaagaatgacacataaatgcataaagattccatatttttttggaacacaaaggataaatgcttcaggggattgacacccaattttccatgatgtgactgttacacatggcatacctgcaccaaaatatctcatgtaccccatgaatatatacacctacaatgtacccacgacattaaaaataagttaacattttttaaggaaatattacctcatcttatctcttgatggcatagaaatttatattttaaaactgttatatataattatataattttataatcatacaattatatttttatatttttaaataaatatataatttaattatataaacatttaattaaattatacatttaattatataaacatttaattaaattatacatttaattatataaacatttaattaaattatacatttaattatatattaactatgtaatttaattgtatgtttttatatatttattatataatatagatccattatctatatttatacatatatctatatacataatatatttaatatatattatttatacagaattatatataattaggcttaataactctgagtcaaaaacgtgattcaaagagtcaaactctacatgaaaggaagtttcagaaatatctcacccaattaactttgcttatattttattttaagtatatttaattatatttcaatatatttttatatttcaatatattatattgaaatatattatattgaaatatattgaaatatatatttttacgtttcaatatattatatttttatatttttatataaagcaatatataaaattatatttcaatatatttcaatatattatatttcatattatatttcaatatatttcaagatattgtttttatatttttaaataaatattttataatttaatgacatataaacatttaattaaattgtacatttaattatatattaactatgtaatttaattatatatagttatatatatttattctataatatagatcattatatttatacatattttatatgttatttatacagaattatatgtaattaggcttaataactctgagtcaaaaacatgattcaaagagtcagactctacatgaaaggaagtttcagaaatatctcacccaatttattttgtttatattttatttttgtgtatatgcaataaataatttaaaaatttataatcaagctgaaaagagttctttcagcaagcacaaaattttccagtgattaaaatttactgagtccgtttatttggtggtatttttcttaggttttttttttttttcatgaaacaatgataactgctagcatcgtagatacaacaaaataggggtataaaaatatgcgggaacatgaggagatggtatacaaatctacagaggcatgaaacaatagaaattagcgccaatctggaagttaggagatagagatcccaggcttggttccataattaaggagctgcgtgatcttgagcaagtcacttaatctctccgagcttcaaccataaaataaggagctgtgatagataatttccgagctccagagagcagtgatgtaagcaatcaggaaaatagaaccttccctcgatgctccaaggaagaagggatctgatgtgggtcactatgtgcttatgaaagtgacggaaaggagtcctgaggttgaggaaggccagtcactgctggcctcagcttctctaatggctaccgagggattagacattgcctccaggcaggtcagaaactcaaggaaacttccccacaggtcacagcagcctccggtatctattggtgaactgctaaaggctactaaaaaccctttaggttccaaactctgcatgtcagcaggccactgccccaatacacacttctctgccatccaaatctcccacaggagtttcttactggtcgcatccaagacaaagctctgttaggcaaggggttctgggaaatgtagttcctacactgccagtccctgtgctgtaggagagatcatagaatgaggtaggaatggggctgagtgtcacagacagatatctggtaccccagctggggagcgagggactatgatggcaacgcaggtgaacaagagggaggggacggcatgaagacagattcagaagtcatggagaggaaggtacacatctgaaagacacctcaaaggaagaattgaaagattagatatgggttactttttctttccacactagtgagtcaatataatctataaatcaagtctctttagctcctctgctgactatcatgttctttttccctagctctcctgtaacagggaacaatacaccctttttcttgtagtgcaagaataatgatttgctggcagaagctccgtgaatcagactttgcactgaacatgttatattgtttgggaacccagctaaatttttccatgactgctttaaaagtgatttccatttaaagctaggtggaacaaattcctgctgctggctaaatcttctttttcttttccaatgaacagaatctcataaaaaggactattgctcttttgtacttttctgtgatgcattttgtgttggggtctatggaggaagccatctaaaactacagagtgttgtaaaaataccctcgtaattctactagaattcaactttttaatagctgtctttcttctccttttatatctccttttcaattatttctttccctttggtactctgacagactaatgtttctgggtctttcatagacacctacatcgaccaaatggatccatctcccacctttgagatcctcattaaactctggcagagtttggtggctacatgaactcaaaccccagacgtatggagaaagaatcactttcaatagaaaacctaacatcaccagtacttacaattctgactaatttttgtcataaataaatacagtggacgtcatttatgtccattttgagtctgtatctatgttatatcacactttgcctaataataatgctgctgtcaatttaatgagggttttagcttacataaataacaaacattcagttcagtggggtttatcttaaactgtacagaggtgcttgttttattataattcaactgaatcagaaactttctttctctccacttgctcacactggcttctaaccaactcacgtttctttaatgacaagtgctaaataaacttcacctggggactgatctgccaataaggataaaaaaaagaattgccccggctaccaaagtatcattgtttcatctccaatgaaacattcccctgtaaaaccatttctctctatgcaaggacttggagtaggaatccagccacagaggtcagggaaggccccaccaccaccatccccactgactcagaaaaggattaaaatattttaaagaaggaggaccagaggacaaaacgtcagcatggtcaagaaaaagtgagcagagccatgaatcgagtgatgaagttgtagattcatagaaaacatgtaaaggctatcatatatgtagaggtaaagtgtcactcctcgttttaagggtgaagaaatgaggcttgcaggagttaagtgtcacacagcagatagtggccaagatagtggccaagccaggctgagtcccatgtccaaatcagtgtactgcttgcttctctgtgcacctgtcatctttagtggtggtgaatggatgagcagtattgaggttaataccctaagaaataacacagcaataatgctcaagtgtaatctagtaataataatgattggaaatcaacattactgtagtgacttcaattgtgtgccccaaaaagatatgtccaagttctcatccctggtacctgtgaacatgaccttacttggaaacagggtttgtgcagatgtaatgcagttaaggatctgcagattaagatcatcctggacttagaaatctactctaaatccactgactggagtcctcatgagagaaaggagagagagctttgacacacagagaagcaactcatgtgaagacccatgtgaagagagaggaagagattgaagttctgtggtcacaagaccaagaatgccaggagccatgagaagctgaaagaggcaacaaacctcctcccctggagctgtggagggagtgcagtcctgctgaggcctccattgtggacttctggcctccattgtggatttctggcctccagagctgtgagccaatacattctgtggttttaggccatcaagtttgtggtcagttgttacagcagctttaggaaactaatacaactatgaaaatacccaatctaaaaagcaatccaggaagaaatttttgttgtcctagtggtttgttgttgtcattgttgattttaacaaaatatagctcaaataacagtactttgaacttttcagttaggaataattacacacgtaacggctcccctaaatgttttttagcctaaagactctgtcaacatttaatattatataaaaggctctgtctacctccccagcctcgtgtcctcccagccttccccttcccccagtattccagccacactggtcttctctttggttccagaacatgctaggacccttctcacctcaggcttctatgtgctcctcctttggctggcacactcctcccccaccatgcaccacctccccagtcaacatcagctccaaagtgcaactctacgggaagccctcctgcccctttataatagatcagccccacacatacactctctttgtaaactctcctaacaccctttccctcttcttcacagtcatgatcattgtttgtaatttttcatttatatttctggattgtctgtctttcctgctggactgtcactctctgacggcaggcacaggacattttgctcatcatgacatttcatgggtagcatgatgcctggcatatagcagccactcataaatatttggaaaataagtgagtgatagtatttagccttggatggagctcttgtctgttattcaaacttatagctgttctgtttccaacatataaaattgaaattgtagaaaaatctgtacatagtcataatttgaaaattaacttattttagtaatgtcttaatttttctcctctgagtttctaaatgaattcatgaaagttctgctttgtcccaaaggcatttcataaataagtaagcatagctaaaagggactcaaacctgttacatttcaccatgccatccgagttcatggataggtgaatttgccctaattagtattatccatttatataatcaataagcatgttgggtaccgtattagtccattttcatgctgctaataaagacatatccgagactgggcaatttacaaaagaaagaggtttaatggactcacagttccatgttgctggggaggccccacaatcatggcagaaggtgaaagtcacgtctcacatggtggcagacaagagaagagagcttgtgcagggaaacttctctttataaaaccatcaagattcatgagacttattcactatcatgagactagcacaggaaagacccacctccatgattcagttacctcccactgggtccctcccacaacacatgggaattgtgggagctacaattcaagttgagatttgggtggggacacagccaaaccatatcattctgccccagcccctcccaaatctcttgtcctctcatttcaaaaccaattatgccttcccaacagtcccccaaagtcttaactcatttcagcattaactcaaaagtccacagtccaaagtcttatctgagacaatataagtcccttctgcctatgagccagtaaaaccaaaagcaagttagttacaccctagatacaatgagggtgcaggcattagataaatacatcattccaaatcggagaaattggccagactgaagaagctaaaggccctatgcaagtccaaaatccagcagggctgtcaaatcttaaagctccaaaagatctcctttgactccaggtctcacatccgggtcacactgatggtgggctctcacagccttgggcagctctgtccctgtggctttgcaggctatagcctccctcctgactgctttcatgggctggcattgggtgtctacagctcttccaggtgcatggtagttctccatgagcaccccgcccctgcagcaaatttctgcctggacatccaggcatttccatacatcttctgaaatctaggtggagggtctcaaacctcagttattgacttctgtataccttcaggctcaataccatgtggaagctgccaggacttggggcttgcaccctctgaaaccattgtccaacctgtaccttgaccccttttagtcacacctggagcggctgggatgcaggacaccaattccctagactgcatacagcacagggaccctggggccaccccacgaaaccatttttctctcctaggcctctgggcctgtgatgggagggactgccacaaagatctcttacatgtcctggagacattttccccatagtcttggtgaataactcggctcctcattacttatccaaatctctgcagccagcttgaatatctcctcagaaaataggatttttttttctatcacattgtcaggctgcaaattttccaaacttttatattctgattctctttttaaactgaatgcctttaagagcacccaagtcacctcttcaatgtttttctgcttagatattttttctaccagatactctgaatcatctctctcaagttcaaagttccacaaatctctatggcaggggcaaaatgctgtcagtctctttgctaaagcataaaaagaatcacctttgctccagttcccaacaagttcctcattccatctgagactacctctgcctggattttactgtccatatcattatcagcattttggtcaaagccattcagcaagtctctagggagttccaaactttcccacattttcctgtcttcttttgagccctccaaactattccaacctctgcctgttacccagttccaaaattgcttccacattttttggtatcttttcagtagggctccactctacttgtgccaaaatctgtattagggttctctagagggacagaactgataggatagacatatatataaagggaatttattaagagtattgactcacatgatcataaggtgagatcccacaataggccacctgcaagctgaggggcaaggaagcaagtccaagtcccaaagctaaagaactttgggtccaatgttcaagggcaggaagtagccagcacaagagaaaaatatagaccagaagactaagccagtctagtctttccacgttcttctgcctgcttttattttggctatgctggcaggtgattagattgtatccacccagattgagggtggatctgccttccccagtccattgactcaaatgttagtctcctttggcagcaccctcacagacatacccaggaacaacactttgcatccttcaatccaatcaagttgacactcagtattaaccatcacaggtacctaatagattccaaagattgtattttaaaatatgttttaatctatagaagagaaaaagaagataacaagaacagtaatgagaggtaaatcacagtgaggctgggtggcggtaaaggaacatttccagaggcagtcactcttgagctgagtcttaaagagtaggagaaagtgagtaaagaaagccatgaaggttgttttaggtcagggtttcttatttttgacatttttcacagaataattctttgttgtcaggggctgtcctgtgtgttttaggatcttaacagcatccctggcctctgtccatgaggtgctagtgtgacaaccaaaatgtctcctgaagatttctcaatgaactgaaaacagaactgcagtttgatacagcaatcctactactgggcgtctactcagaataaaagaaatcattatataaaaaggatgcctgcacttgtatgcttattgcagcactattcacaatagcaaagatatggaatcaccgtaagtgtctaatggatgattggataaagacaatgtggtgtatatatgtgtgtgtgtgtgtatatatatgtgtgtgtgtgtgctgtgtatatatatatgtatacacacacacacacacatatatataccatggaatactactcagccataaacaagaatgaaatcatgtcttttggagcaacatgaatggaattggaggtcattatgttaaatgaaataactcagaagcagaaagccaaatacctcatgttctcacttataagtaggagctaaatgatgtgcacatatggtcatagagcatggaataatagacactggaggctcagaaagggaggagggtgggaaggggaatgagaaattatctaatgggtacaatgtacactatttgggtgatagttatcctaaaagccagacttccccactgtacaatatatctgtataacaatactgcacttttaccccctaaatctataaaaatttaaaaattttaaaaaacgaaaacaaaatgtcacctgacattgcaaaatatctcccctggaatgcaccttcttcccagttaagaaccactggtgggggcagaggaaggagcctatctgcagttgggggtgtctgagttactgcagcatgtccaggtagctctaggagagtgcccgggagggagataggagagaaagtacaacactgctcttacacagggggtttcatgtcttatgctggggagtgtggaatttcatcctgaaagcacttatgcagaatcaaaggatcttaagtaggaagtggacatgggctaatttgtgcttaagaaaaatcactctggtcacagtggaaaggaaggatcgaatggagatcagaatgaatttgaaagaattgaatgtaatccagaagagaaatgattcatggggacagaaaggaaaggaaagggaagatagaaaggtactcacatcacatctctaagaccttgtctagaatgggatctagattcttggtttggatgatcagaaagtagaatcataaatcttctccaaaatccacttggaaattagccctcatgactttatgaaaaaaaaaatcaaacccttgaactcagaaaaattacttgtaaagttggttaagcataatctaggtgacctcatgatgtaataaataaaaatagccactacctccggcttcaaattcaattaggccttcagcaaagattatttcagcaaattgtcaaaaatattagtttttaatcaatgtattagaaaactgtagtaaattttcaccccctgcccccaagcaatgtctagacaagtgagacagagagacaaaatgagtaattgaggccatttttcttgcctgattgttcagaaaattgcctcatttctttgctttattttctgagtccacataatgataacagaaaaagttgtatgtgtggatattttttacaatctgaatctttgacagtgttgagagaggtaatcgccaacaaacacactatcacagcatttgccagatcgtctgttttctttcaggcttttgtcagtatctaaggcaagtcctttgtgtgagaactgactagataaaatgtcatgagcacctcctgtgagggaaagaccgagactgagatctcagtcataaagagactccccagctacaggtgctacaaggtgtgcaaaggcaattaacaatttggggcaaagcgcaattttcatagactctgttttgcaaaaaaaaagaccctacgctacctatttcacaaagttattcacatttctagctcatgaggaacacaggatattcaggccctgctaaaggatatgaataggtcatccaggttttgattaagagattgtttgaacaagtcccaagtgggaataattcaaattaaagcaagaatgtgtcaatacatctgaaatgttgaagaatgcaaaaatagtatttatacataaatataaaatataaatggaatttttatgtgttgatcaattatgtatttttaaatatttggcttcaataacaatataagaaaaatgaaattcctactaatccatagaataatgtgtactttcttttaagaaatcaccaaccttaaaatcactaaaatatgatacatttaacaaaatggtagattttaaattataaaccaaactgaattcagaaagtaaaaattatgatacacagtttatattggtcaaagttgccattaattgtttattatcattaaaaataaatacatatgtttcacttcacatgtgttacacaggtgcttaatattttattaatataaatgcataattcatttgctcttcacaaccacaaaaactagatacatgattattcccattttgcagataaggaaattaacacccaagtgaaatactttaccaaaggtcacataggtagtaagtaacaactgtgtgatcagaggagagcattatctccaaacttcgtgagagacacatataagcaattagtcccttacagactaagaaattttgatacagacaatttgttgcagattcataagatagtacagccagttctgtgaatcacagtgttatatttatttccacatattctatgttaataatataatttttaattccatgtattttaagttttcattcaataactgctataagtatatgcagctctgagaacaagggggaagagaataatttcagccatttaaaaatagcttttatatttagatttaaatatttcagttgcatttcttttttttttttttttactttttacttttctttttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggcgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctcaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccaggctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttacccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagctgacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtgctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaagtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttatgtctctatttccttcagttctgctctgattttagttatttcttgccttctgccagcttttgaatgtgtttgctcttgcttttctagttcttttaattgtgatgttagggtgtcaattttggatctttcctgctttctcttctaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggcttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacattggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccatcactgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcattttagagtttccagtttttctgttctgttttttccccatctttgtggttttatctacttttggtctttgatgatggtgatgtacagatgggttttcggtgtagatgtcctttctggttgttagttttccttctaacagacaggaccctcaggtgcaggtctgttggaataccctgccgtgtgaggtgtcagtgtgcccctgctggggggtgcctcccagttaggctgctcgggggtcaggggtcagggacccacttgaggaggcagtctgcccgttctcagatcgccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttggagcttcccggctgctttgtttacctaagcaagcctgggcaatggcgggcgcccctcccccagcctcgttgccgccttgcagtttgatctcagactgctgtgctagcaatcagcgagattccgtaggcgtaggaccctctgagccaggtgtgggatatagtctcgtggtgcgccgtttcttaagccggtctgaaaagtgcaatattcgggtgggagtgacccgattttccaggtgcgtccgtcacccctttctttgactcggaaagggaactccctgaccccttgcgcttcccaggtgaggcaatgcctcgccctgcttcggctcgcacacggtgcgcacacacactggcctgcgcccactgtctggcactccctagtgagatgaacccggtacctcagatggaaatgcagaaatcacccgtcttctgcgtcactcacgctgggagctgtagaccggagctgttcctattcggccatcttggctcctcctcccttcagttgcatttcaagtatctttttctgctaagaatttggcctgtctgaatttcaaaaggcatttgggcttcaaactttagttaatggtaaaaaaaaaaaataactaaatatttaatttcctgaaatagttccaaattacagaaacagagagaaagcttaaataccatagaacaaaaattcatagaatagaatttatgaatcatgattcatacacaaaagaccaaacctctcaatgaataactgtattgttgacagtttgggaggaattttaattttgtttttttttctcaaatagtgagatcagagtcggaaaagccttaacatctccatattagagattctgtaactcacatcacttatgccaggctccagctacgtactctgaaaagtatattaaatcagaatgaaaattgttcagtaaaatttctcctagaggtatagtaaatatgattgatttaatacatcattgagattctactggaaaaatggcataaaacagcaacattctgttgccattttataactttcatttttgtaaagtgaccattagcataatatagtaatatcattatgacaatctgcacagatgaaaatatctcaaggccaatattacattttcatcaagtaaatgaccatgtgtttcaataaacacgattatgaatgttaatataccaacagattgagtattttcatttctcagcatcattgtttgtaggggaaaacaaattaatcatctttgagataacaggagtgtagacttttagaacatgatctgtttcactacaactattcttggtttgctgaataagagtcaggattttactccagactgtcctcatctgaggtcatcttatctgtccccttctgaagtaatcttgtcattatgtaaatacctatgcagcattatcaatttagagccagataatttaagatgaatcacgtctttattttgataagtatccacaggacacccatttgtacagtagaaacatgcaaagaaacctcttcctcctgcctgttctattgtcttggacaattcctgaataagctgttctccagccctgcacacctgcgagcaggccagggactctgtggacccagccatgccctttctgtcaccaaggccacatttgtggtcaggaggcaagtgagatggtcatcactttcacttaagtcctttttagcaataggcatgttaggcattggaatggatgtgcaagcgaaatggacacaaaccaaaaatggaagaggcaacctgtctatggccttaccatcccgaatatgcctgatctcagaagctaagcagggttggtttggctagtacatggatgggagaagagataactagctgagacttcagtatctagcttataggctgcttcagccttcaagcacagcttaattatatgtattactggggaagatccttttctggaaagaggcaacattttaagaccattcaagattaacctttacttgagcaaaaagaaatgtttctactttcaaatgctttttggtaaaaatctttaaaaaataataaatgcttcaaagagaataaaacagctaggaatccaacttataagggatgtgaaggacctcttcaaggagaactacaaaccactgctcagcgaaataaaagaggacacaaacaaatggaagaacattccatgctcatggataggaagaatcaatatcgtgaaaatggccatactgcccaaggtaacttatagattcagtgccatcccaatcaagctaccaatgactttcttcacagaattggaaaaaactgctttaaagttcatatgcaaccaaaaaagagcccgcattgccaagacaatcctaagccaaaagaacaaagctggaggcatcacactacctgacttcaaaccatactacactacaaggctacagtaaccaaaacagcatggtactggtgccaaaacagatatatagaccaatggaacagaacagaggcatcagaaataacaccacacatctacaaccatctgatctttgacaaacttgacaaaaacaagaaatggggaaaagattccctgtttaataaatagtgctgggaaaactggctagccatatgtagaaagctgaaactggatcccttccttacaccttatacaaaaattaattcaagatggattaaagacttaaatgttagacctaaaaccataaaaactctagaagaaaacctaggcaataccattcaggacataggcatgggcaaggacttcatgtctaaaacaccaaaagcaatggcaacaaaagccaaaattgacaaatgggatctaattaaactaaagagcttctgcagagcaaaagaaactaccagcagagtgaacaggcaacctacagaatgggaaaaaatttttgcaatctacccatctgacaaagggctaatatccagaatctataaagaactcaaacaaatttacaagaaaaaacaaacaaccccatcaacaagtgggcgaaggacatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactaattcaaccattgtggaagacagtgtggtgattcctcagggatctagaactagaaataccatttgacccagccatcccattactgggtatatacccaaaggattataaatcatgctgctataaagacacatgcacacgtatgtttattgcagcactattcacaatagcaaagacttggaaccaacccaaatatccatcaatgatagactggattaagaaaatgtggcacatatacaccatggaatactatgcagccataaaaaatgtcctttgcagggccatggagaagctggaaaccatcattctcagcaaactatcacaaggacagaaaaccaaacaccacgtgttctcactcataggcgggaattgaacaatgagaacacttggacacaggaaggggaacatcacacaccaaggcctgtcgtggggtggggggaggggggaaggatagcattaggagatatacctaatgtaaatgacgagttaatgggtgcagcacaccaacatggcacatgtatacatatgtaataaacctgcacgttgtgcatatgtaccctagaacttaaaatataataaataataagaataataataaattatttttctgatttgtttaaaaaaaatcactgtattccttggctgcagcacagcagcaaatgtagctagtataagaactacttatcctgggtcccaaaatatagttgcttgaaaaagtctatattgcgaccttaatttttagtgctttgcctctttgggaactccagtgtgaagagaggtatgcacaacctcacggtcctcaggttgttatcacatggccgaacactttacaacatgaattcatgaattatgtagttaattattacatcaaagaagatctcgccgcacttatcacaaacactcttagttatagccccacaaccttaattgttattgccaagaatttctttccatccactcttcctattttgcaaactacaattacagaggaggtatgaatgaaaagttttctgtatcattccaaaaatatgttaagatgttctgaaaagttctgattccttgatctacgagtgacttagcaacatgattagatgagacaaaacccatagctacacatctttctctagaagtcttaatgtcgactcttgacaaaatttcagatccattcaaaatttcaaatacgttaaaataaaaaaattaacactctaatgttgagattgagtagactatacaaagccttccttaaagattacattttttgcattttctagttttcattcattgcaagaatgtttgtaattgctcagtgaatggctaatttcaaatctgtaccaggtaattctcacatctctgtcatctcacggctgacacctattgattttctttctttttctttcattcactttgagatcttcctggtccttgacattgtgagtgactcttggttgaaacctagacattttagatattattttatgagactacggatcctctgctggttgaaacctagacatttaagatattattttgtaagactatggatctgctgctgtcatcctctctctgcttttctttttcttctccacttactcctacccctttaatccagtgctcaagtaggaccagggaaacattaaaagttggcccacagatggaaggaacattgtacttcatgtgtcacatttaaattctccaggaagaaagggcttgtcaataaagtgtctttttaagtcacagatggcagtaaggctgtgctactcccaccttttctttctattcattgtctcctaatgtcatttattttctgaagtatctaagtagcaccaccactatccaagactgacagtctccatttatattcaatcataactcactagtgaagattaattggggaggagacaagtctgaattagaaatcaccaaagtagtattttaaaagaagtgcagatttattgcattcaattctagacctaattcagagacatggctagaactgttacgaaggaaatgtcttaaacggcctgatttaaagcatagagacaacccatttgtacattagtagaaagtaatgtgttttaaatctttaacaatggttttcttgagtagattaactaccgctttaaaaatcctatttatttatctcctacactaagtaaatttcaacacaacccttttctgaattttcacaaatactacaggagaggaatctaaattagaagctcgattatatatgttatttctgtttaaaaggcactaattaagctgctttgccctgtgagcactagaatttgggttggcacagtcatttcataatctgaactctaacacaattatttctggatgaaccattgccataaaatttaacaggctatattagctgttggttggcattgatgatctataaatactaacctttatctcttgatattttttctcattcttttttatggttaatttagaatttcactgattaggcatttgcttatataaagtgctttgttaagactcaaaacatttttaagcatgtttatgctgcaaagtgaatgagtgttgcaaagtttgacttagtgtagaaagattgtaagactagaagttacttttagaaaacctaaactatcttgtagaaaaattatctcacggtttttaaaaatggcgttcaaaattcagagagaacaattcaagcttgttgctagtggaaagttaacagtggtttagatcagttgtacacactgtgcaagatgtttatgtgctgacagcttgtgtgcctacctccacatcaattcggccattataccagctaattcttctatctaggattcataacataaaaatgtgcttcctctttctgagggaaagttgactatgggtagagaagagttgccgttatttcaccttgaagaataacaatataagctcatgtgcaatgaaatagcagacttattggaaatgattactagcttcttgaaagcaaagaagtatatattttttaacttcataaggatttagaagttgatcattcatcatccccttctgcactctgagtgctgaaccaactgaaaaagagatggaagcaagtgtcagacagaaatcaaaacagtagctcagactgtgtttctcttgtgacataggcccttcaaaccctactttttgaaagagtggctaggatacatgaagtcattacagtatcaactgcatacccacaacatttagaaaatataaaactccccagcccctacttcaaggttatgttctcagaaccagatatatagtgcagtctagccctgcatcatccagcacagtggttcctagccacatgtgactgttgagcactcgtaatatggctactgtgacagaggaattgaattttcattgtgttttaattaatttaaaattatatttaaaaactgattctcaattcactattggaagactttgaagtctacttgaaacaatttcaggtatgtgcatctactttttcaaccataagctacatggaacctaagtataaattagttatttctaattagaataattaattccattaaaatgaaaaggccaaattgagatatgctctcagtacaaaatacataagaattttgaagacaccgcccaagaaagagaatataaaatagcccatttataattgtttacatgttgaaagaattgtattttggatatacaggattaaataaaacacgaaaattgacttttaaaaattcatctgtttctttttacttctttaacacgattactagaaaatgtttaattacatatgcggctcacattgtatttctattagactcactctactagagtgtgatgtagattcaccctctagttggtgtgtaaaagtcatggtggagatttcattgtatctaggggaagaagaacaaactaatgaagggggagaaggagaaaaccttctgactcccaggaagccaactggtctgggccagtttgtgtctctgcatgacttctgagcctgaacttaagtggaagaaatctcccaccaagaagttacttacattgccaggtgtttgtttcttctcagacctaggattactgagctctgagtgtcatcttacctggatgcttcttctcctactcttgtttattaaaagctgttacttctctaggctttgattaacattaactattaaaattacagtgtaggctcggcatggtggctcacacctataatcccagcactttgggaggccaaagtggacagatcacgtgagatcaggagtttgagaccagtctggccaacatggtaaaacccggtctctactaaaaaaaaaataagtacaattgcaaaacaaataaataaataaatctgcagtgtaaaactctcttttactctctattttcctattgcaacataattcagctttccctgggtagccattccttaatcctaggtgagaaaaaatatatattaaagatgaaacatctactaatgcccagccctgcaaaaaacttatactcccatttctggtggaggcaacattgaaggttggctctctggtgtctaaaaagatgttctgcccatgtcgatttgaacacctattttttgtaaaaggccttgccctttccacatggactatgaaggacccacagaagtgaaactgtgtccccagtctaaactccctgggagaacctctcctgactcaataaagaattggtttttctgcccaagaacagagctctgcttgattagtttgaggtcgaggagaccacctggatcaccaagataaatgctttttcttgctaacccaacgcagaaacaggtacatttctcagttcttcaaccggccgaccctgctgcctcctggagcccatatagggtttcttgttcagccatagttctagaccttggctgcattttggaatcacctttctagtctcgagcataaaataaggcccagagcccaggccagactcactacatgagcattttcagctactaaggagaacttgaagaaaagaaattggccaagcagcggactcatgtgtgccctggcacttttcctatctcactaatcgcccttctcatatcataactcacccttctcatgaaaaaatagaatgaataaatgtggacggggaaatgccgaaacaccctcctcataacttgcacacgaatcctcctctatgttcgaaggcagggaaagagagaaaatggtaccaaagatagcctgtgtgcagtacttgaggcaaggctttgcatgtttcaagcgcccaatacttatctgttgacacaaagagtgccgtaattatgttagaattagtttggctttttttttttttctgctctagaaacattttgttcgtataagtcaaaaattagaaagaaagtttggaatttaatttcttatcaggcaatagccaagggaaaatatttctgttaaaggagtaatcatacagaacagctaaaattccaggaataataaaactcaggaaattttggggggagtggggtggttaggttttggaaaatatttgtcagtaatatttgaaaatccagatcttccttaaaagtctacagatttgagtgtacccctcacccaaggaaatctgtctcaagagacagaatcagtccatttttcagggttccccaggaaagtttgtcacagccagacataaatgtgatgaaaggcaggaaagggagagacagaggctgggacaaagaagatgacagactttattggtaacattaggccagaatgataaccataacccaggctgtgttttcaaagttgttgttgtaaactaaatgttttggtatatttgtcagaactttttatcttggttagtttaattaaaataaagtcggtagccaaaataaaattatgtaaaggttaatcaggatgtttcctgtattttttgacataaaccaaattaagtagttatttttctaacacatggaattcttacatttgtctccgtgcaagatgtatgttaatgttagttgttttactacatttgaaattcagtcttttaaaatgggttttctctgttctcctccaaggctatttgagcatctaaatatctacatattacatggctgttggcaaaagttttcaaatgctattcactcaatttgaaaaaaatttgcacttcttataaagctagtatgaatgtgactctaaaatctcaccaattggcactaatcaggttcatcatcaaaataaacctgataaatattaaaactaaattgttgagttggttttgtaatgtcaggattttcaagacaacaaatggccaagaacttggcgtcagaggaagtcctgctttcggttgattcttgatgctgattgagaacaggcctcctaagcactgatgggaatatttgcctctaagaagtacagcccatttaccacttagaagctaaagttcagaaataaaactctgacacaacaaaatatcaataaagccagatagagcactagaaaaattcgtaaatctctaatatgaatatacatctctaatacaaattacattcaagcaacagtgatttgcctcggctgcaagtaattatgtacctattgttaaaatagtgtgagtcacagcaagaacatggacaatatcaattcccttcagagactggactctgtgaagcctttccagttctaactacacagtacgatctttttaaaactatcagctttgcactcatttcagacccaagtatgttgaactggatgaggtattactttcaaggacaaggactggacgttaatcaaaatgaaaatactctttttttcttttttgagatggagtctcactctgttgcccaggctagagtgcagtggcgtgatcttggcttactgcaacctccacctcctgggtgcaagcaattctctgcctcagcctcctgagtatctgggatgacaggcgcctgccaccatgcccagctaacttttgtattcttagtagagacagggtttcatcatactggccaggctggtctccaattcctgacctcaggtgatccgcctgcctcggcctcccaaagtgctgggatgacaggcgtaagccactgcgcccggcctaatcaaaatgaaaatactttcaacatggaaataaagctttccagtgctaaagcttctgttttcttagagcaaaagagctccactaagaagaaaactgaatgttattgagatgttgtttaataagttcctggtatgtagattgaattgtgtcactgccaaagaagataggttgaattcttaactcctggaatctgtgaatgtgaccttatttgggagttgcagatgtaatcaagttcggatgaggtcatactgaagtaaagtgggccctaattcaatgactggtatcctcataagaaagacatgtagacatagccacacagggagggcgccaggtgaggacaaagttagagtctaaaagctacgtgtacaagccaagaggaattaaggattgctggcaactaccaggaactagtaagatgcatggaaatattctcccctagagacttcagagagagagcacagccctgctggcacctgcattttggacttttagtctccagaactgtgagaaaattaagttattttgtttgaagctacccagtttatggtaatttgtttcggcaaccctgggaaacttctatataaggctatgtcagaactcctcttatctcttaggaaaccaaagttctatccttaagcgaatataagatgtaagttcacagataactcagaatgtcctcccgcttctcaagaactagtcctgggtttgcattatccttataaatgccctaagatgattttttcaagcatatgttaccaagaagtagggaagtttcagcattaacaatacatagcttcgtaacaattagccatctgtttataatgctgttagggatcgacagcatctcaatggaagcagggaaaacaacagaaatatcatatctgccaagttctagtcatctgttatgttacatagtaatttgtcatctcatgagatcaccaaggagagaaaaaagccatgccgtgctacaaaataaactctgtaaagcaggtagtttaatagcaaattaatgatgtgctgacaagatcaagaccaaaaaaaaaaaaaaaaaacatgtcatattttctgcagtgcagctaataatgcaagtttgtaagctgtctcacaagaaggtagtatttattttttccaaggagctatttgaaaaccagagagttaacatattttaagacagttttcctcaatgtcagtttattttaaatattactagagttcagatattatcttgctatcactcttaatatccatcttaattatgggagtccctgtggtaaagtctaacctctttcaatctcatctcttgacttgatgattcatttcaaagaatgtgttagtacaatggggcttcttctcaagagcaaagtaactttgaataaaatttacaaaagtaaaagaaataaagcagatggcaaatattgcccacagaattggttatagtatcattatccattaagaaatgaattttgtacaatagatgatttaggtcttacttatctgtctctcataaatatgtatatatgcaatattaagatagatatactgatattgcaaactggcaataaaaaaggtggctttaatatttcgtatggtttggctctgtgtccacacccaaacctcatcctgaattgtaatttccatgtgtcaagggagggacctggtgggaggtgattgggtcatgggggcggtttcccccatgctgttctcaggatggtgagtgagttctcacaaaatctaatactttgaagggatttggagactgggtgcagtggctcatgcctgtaatctcaacactttggaaggccaaggtgggcagatcacctgaggtcaggagtttgagaccagcctgaacaacatgctgaaaccccatctctactaaaaatacaaaaattagctgggcacggtggtctgcgcctgtaatcccagtgttcaggaggctgaggcagaagaatcgtttggaccaaggaggtggagattgcagtgagcagagaacacaccactgcactccaacctgggcaacagagtgagactccgtctcaacaacaacaaaaaaaattagccatgtgtggtggtgggtgtctataatcccagctactcgggaagctgaggcatgagaatcacttgaacccaggaggcagaggttgtggtgagccgagatcacaccactgcactccagcctaggcaacagagtgagactctgtctcaaaaaaaaaaaaaagtgtttggcagtttcctccttgctctctctctctctttcctgccaccatgtaagacatgccttgattccccttctacttctgccatgactgtaaatttcctgatgcctcctcagccatgaggaactgggagtcaactaaacctctttctttataaattaccgagtctcaggtcattcatggcagtgtgaaaatgcactaatacaatatttggaaactctatgcaacaatacagggttcatatattgtccagcctgaattaaagtgctatgtgttatctctcctatcaaactatctttaagatgatgacaaagggatttcaggtgacaacttggaatgaaagatactgacccactgtttgctttcctgtagcttttcctcaagtggataaaaacaattacagctttttttcactagtctactaaattgaactcttaatatcaccccagctgcttttcttgtaggtgttcctttctatgtcaaccacacttctgtttgtgataaggattttcacctcatctgatgaaaagagcagtctactgtgagaaagaactaagcttctactcccaaagcacaagcagtttctgtcaaagcaggaatacaaatatggtcccttggaacctagcccattgcctttccaacataatggtggttattgagccatcagaccatgctttcagcagatacttgaacttccactgtgtatgaatcattatattagtgtaatagagctgtagagataaataagacctagcccatgcttataaatgcctcataacacaaaggacagagaaattatgcataaataaatgcaaaataaatgcagataaatctccatggctgttcagttacacaggcatccaacacatccattgagtatttaccacataccaactttgtcctaaagactgatgatgacacaaattgaaccagatttaggcaaccaccaatctcacaaagtttgcaatccaattagaagagaaaagaatttaaaacagccattgcattatagaatcattaatgcaatgaaaggaagattcccaagtactaagagaaggcaacgctgggacacctagcctaatctaaagggcccaaaataaatatccttaaagtggcatataaattaagacattaccaagtgtggtggctcatggctgtaatcccagcactttgggaggctgaggcatgaggatcgcttgaggtcaggagttcgagagcagcctgggcaacatggtaaaaccccatgtctaataaaaatataaaaattacctgggcatggtggtgtactcgggaggctaaggtggaagaattgttcgaacccaggaggcagaagttgcagtgagccaggatcgtgccattgcactccaacttgggcaatagagtgaaactccatctcacaaaaaaaaaaaaaaaaaaaaaaaattaagacacgaaggataggagttagttagccaatatggtattttgtggtaatgcagctataatctaatcaccgatgaaacagtattccagcaaaccacttcaaggaagctttgaaaaccgaccacatccttttggcctgtccatcatcaaaaaagataatagcccgacaaaccatgggttataaaatgcctgacacataactgtgattacagcattagaggtttaaaatgcaactaggaaaacttgaaaatataagcaccaatttcaaatcactagtcatttgcatcaatttcaaccattcccccgtactcctccaagcattctatttggcttgtgtcgtatccaagaccatccgaaatcacagaataaatttcctataacatgcatctttcgtgtgcataataatgcatactaacaatttacaatttgttataatgtcctataatgtacttctttattgcatctgtgtgactaaagagggcagtcgggagaaaatctaataggagaacttcctagggttgaggttcttcagcttaaaatctttataactgggaccccttacattagcactcagctttggccagtatgtctgagaccactcatatatatatacatatatacacacacacacatatacacatacacacacatatgattgttttgtcattgtaccttgtaaaaaggtatttgttaccaaaatgataaaaggaagtgaactttaaaaaatacatgtcttattactgtcatttggagtattcctcaaaccactgattgtatatgatatagctacctctaggaattcaagctcaagttattcacaacactaaagatacaaactgatttccaaaggtattatccaagaaattaaccgtttataagggaagcaaagtatctttccatttcttttatatttttatatatatatattttaagttctagggtacatgttcacaacgtgcaggtttgatacagaggtatacatatgccatgttggtttgctccacccatcaactcgtcatttattttaggtatttctcctaatgctattcctcccccaggcccccactccctgacaggccccagtgtgtgatgttccctgccctgtgtccaagtgttctcattgttcatttcccacctataagtgagaacatgtggtgtttggttttctgtccttgtgatagtttgctgagaatgatggtttccagcttctccacggccctgcaaagaacatgaactcatccttttttatgactgcgtagtattccatggggtatatatgccatattttcttaatccaatctatcattgatggacatttgggttggttccaagtctctgctattgtgaagagtgccacaataaacatacgtgtgcatgtgtctttacaggagcatgatttataatccttttggtatatacccagtaatgggatcactgggttaaatggtatttctagttctagatccttaaggaattaccgcactgtcttccacaatggttgaactaatttagactcccaccaacagtgtaaaagcatttctatttctccacatcctttccagcatctgttgtttcctgactttttaatgatcaccattctaactggtgtgagatggtatctcattgtagttttgatttgcatttctctgatggtcagtgatgatgagcattttttcatgtgtctgttggctgcagaaatatcttgttttgagaagtgtctgttaatatcctttgcccgctttttgatggggttgttttttttcttgtaaatttgtttcagttcttcgtagattctggatattagccctttgtcagatgggtagattgcaaaaattttctcccattctgtaggttgcctgttcactccaatgatagtttcttttgccatgcagaagctctttggtttaatcacatctgatttgtctattttggcttttgttgccattgcttttggtgttttagacatgaagtccttgcccatgcctatgtcctgaatggtattgcctaggttttcttctggggtttttatggtttcaggtctaacatttaagtctttaatccatcttgaattaatttttgtatatgatgtaaagaaaggatccagtttcagctttctacatatggctagccagttttcccagcaccatttattaaatagggaatcctttccccatttcttgtttttgtcaggtttgtcaaagatccaatggttatagatgtgtggtgttatttctgatgcctctgttctgttccattggtctatatatctgttttggcaccaataccatgctgttttggttactgtagccttgtagtatagtttgaagtcaggtagcatgatgcctccagttttggtcttttggcttaggattttcttggcaatgaggggtcttttttgcttccatatgaactttaaagtagttttttccaattctgtgaagaaagtcattggtagcttgatggggatggcattgaatctgtaaattaccttgggcagtatggccattttcatgatattgattcttcctatccatgagcatggaatgttcttccatttgtttgtgtcctcttttatttcattgagcagtgttttgtagttctccttgaagaggtccttcacatcccttgtaagttggattcctgggtattttattttctttgaagcaattgtgaatgggagttcactcatgatttggctctctgtttgtctgttattggtgtataggaatgcttgatttttgcacattgattttgtatcctgagactttgctgaagttgcttatcagcttaaggagatttggggctgagacgatagggttttctaaatatacaatcatgtcatctgcaaacagggacaatttgacttcctcttttcctaattgaatgccctttatttctttctcctgcctgattgccctggccataattcccaacactatgttgaataggagtgatgagagaagacatccttgtcttgtgccagttttcaaagggaatgcttccagtttttgcccattcagtatgatattggctgtgggtttgtcataaatagctcttattattttgagatacgttccatcaatacctagcttattgggagtttttagcaggaagggctgttgaattttgtcaaaggccttttctgcatctattgagattatcatgtgttttttgtcattgattctgtttatgtgatggattacatttattgatttgcatatgttgaaccagccttgcatcccagggatgaagctgacttgatcatggtggataagctttttgatatgctgctggattcggtttgccagtattttattgaagatttccccatcgatgcttaccagggatattggtctaaaattctctttttttgttgtctctctgccagccttcggtatcaggatcatgttggcctcataaagtgagttagggaggattccttctttttctattgattggaatagtttcagaaggaatgataccagctcctctttgtacctctggtagaattcggctgtgaatctgtctggttctggactttttttgattggtaggctattaattattgcctcaatttcagagcctgttattggtctattgagagattcaatttcttcctggtttagtgttgggagggtgtatgtgtccaggaatctatccatttcttctagattttctagtttatttgcgtagaagtgtttatagtattcgctaatgatagtttttatttctgtgggatcggtggtgatatcccctttataattttttattgcatctatttgattcttctctgttttcattagtcttgctagtggtctatcaattttgttgatcttttcaaaaaaccagctcctggtttcattgattttttgaagggtttttttgtgtctctatctctttcagttctgctctgatcttagttatttcttgccttctgctagcttttgaatgtgtttgctcttgcttctctagttcttttaattgtgatgttaggatgtcgattttagatctttcctgctttctcttgtgggcatttagtgctataaatttccctctatacactgctttaaatgtgtcccagagattctggtacgttgtgtctttgttctcattggtttcaaagaacatctttatttctgccttcatttcgtcatgtacccagtagtcattcaggagcaggttgttcagtttccatgtagttgtgtgattttgaatgagtttcttaatgctgagttctaaattgattgcactgtggtctgagagactgttgtcatttctgttcttttctatttgctgaggagtgttttacttccaattttgtggtcatttttagaataagtgtgatgtggtgctgagaaaaatgtgtattctgttgatttggggaggagagttctgtagatgtctattaagtctgcttaatgcagagctgagttcaagtcctggatatccttgttaaccttctgtctcattgatctgtctaatattgacagtagggtgttaaagtctcccattattattgtgtgggagtataagtctccttgtaggtctctaaggacttgctttgtgaatctgggtgctcctgttttggttgggtgcgtatatatttcggatagttagctcttctttttgaattgctccctttaccattatgaaatggccttctttgcctcttttgatctttgttggtttaaagtctgttttatcagagactaggattgcaacccctgttttttttttgttttttgttgttgttgttgttttgctttccatttgcttggtagatcttcctccatccctttattttgagcctatgtacgtctttgcatgtgagatgggtctcctgaatacagcacgctgataggtcttgactctttatccaatttgccaatatgtgtcttttaactggggcttttagcccatttacatttaaggttaatattgttatgtgtgaatttgaccctctcattattatgttagctgtttattttgctcattaattgatgcagtttcttcacagcatcgatggtctttaccacttggcatgtttttgtagtggatgataccggttgtttctttccatgtttagtgcttccttcaggagctcttgtagggcaggcctggtggtgacaaaatctctcagcatttgcttgtgtgtaaaggattttatttctgcttcacttatgaagcttattttggctggatatgaaattctgggttgaaaattcttttctttaagaacgttgaatattgaccccaactctcttctggcttttgggtttctgctgagagatccgctgtttgtctgatgggcttccctttgtgggtaacccgacctttctttctggctgcccttaatattttttatttcatttcaaccttggtgaatctgacggttatgtaccttggagtggctcttcttgaggagtatctttgtgatgttctctgtatttcctgaatttgaatgttgacctgccttgctaggttggggaagttctcctggataatatcctgaagagtgttttccaacttggttgtattctccccattacttttaggtacaccaatcaaacgtagatttggtcttttcacatagtcccatgtttcttggaggctttcttcatttctttttactctcttttctctaaccttgtcatctcactttatttcattaatttgatcttcagtcactaataacctttcttctacttgatcgaatcagctgttgaagattgtgcatgcatcacaaagttcgcgtgccatggttttcagctccatcaggtcattcaaggttttctccacactgtttattatagttagccattcgtctagccttttttcaaggtttttaacttccttgcaatgtgttagaacatgctcctttagctcagaagtttgttattatcaaccttctgaagcctacttctgtcagcttgtcaatgtcattctctgtccagctttgttctgttgctggcaaggagctgcaatcttttggaggagaagaggtgctctgatttttagaattttcggtttttctgctctggtttctccccatctttgtggttttatctacctttggtctatgtgatggtgacctacagatggggttttggtgtggatatcctttttgttgatgttgatgctattcctttctgtttgttagttttccgtctaatagtcaggtccctcagctgcagttctgttggagtttgctggtggtccactccagaccctgttttcttgggtatcaccagcagaggctgcaaaacagcaaatattgcagaacaacaaatattgctgcatgatccttcctctgggagcttcatcccagaggggtgcctgcctatatgaggtgtctgtcggcccatactgggaggtgtctcccagttaggctacacaggggtcagggacccacttgaggaggcagtctgtccattctcagagctcaaacactgtgctgggagaaccactgctctcttcagagctgtcagacagggatgtttaagtctgcagaagttgtctgctgccttttcttgagctatgccctgcccacagaggtggagtctatagaggcagtaggccttgctgagctgtggtgggctctacccagttcgagcttcctggccacttcgtttacctactcaagcctcagcaatggtggacaccccacccacagccaggctgctgccttgcagtttgatctcagactgctgcgctagcagtgagcaaggctccatgggcatgggaccctccaagccaggcatgggaaaggttctccttgtctgccggttgctaagaccttgggaaaagtgcagtatttggtcagaagtgtcctatttttccaggtacagtctgtcacggcttcccttggctaggaaagggaaatcccctgaccccttgcacttcccaggtgaggcaacgcctgccctacttcagctcaccctccatgggctgcacccactgtccaatcagtcccagtgcgatgaaccaggtacttcagttggaaatgcagaaatcatccatcttctgcatcgatcacactgggtgctgcggaccagaactgttcctcttcggccgtcttggaatggagctctatctttccatttcaatgcagccactttagcagttctcttaaagctgaaaatatatagaaaaagataaaacctttcaacagctacagtgatcctgaagtaaattactgtgtatatgacacagtgcattatcaaattgttgctgcatcagcatgtcattttcaaaatgaaaacaagtctattaaagtgcatatcgaaggtataaagtaggatgatagtgtatagtttgatcatgagatattgcttgcagtgtaagtttcatagaagaaaaatggtttgagaaaatggatcaaagggaaatctccaagttgacaacaatgtgttaagagaatgagaatttcaaagtacaactactgaaaaagccaaatttatgcagacaaagtgaaaaagaaatgaatcaaccctggaagagggagaatcagcacatcaccgtcaaggaaaacaagtacaagaataaatggatgttaatttcagctcacaagacagtagtaatttcaaaataactaaggaagggaagtgaaaaaataaactgcagtgtcataactgactcttgatccggagggatgtataagtgtccctgaataatgactgtagttgtggttttgcttttctagcctccttgcttgataaaaaagcctatggaatgatgtaaaacatagattgcagataataagtttgtgccaaggattggctggtttagctcaatttcatatcaacttacaatttaacctagagtattttacatcatctcatcagtttatccatttaaattgattatcttgatcttcttttattttttaagatcatccagtaagtatgtattcagcatctaacctgtactaaatattttgctaaggttgagggagacattaaactcacaacactcctataagatggacattattattacttccatttaacaggtgaatgactaaggcaaagtcatattagatgcccaaggtaacacagctagtaaatggcagaattgttgtgttagttcaggtcctccaagaagcagatgccaagacaagaatatatgtgcaagagatttatggtattgatctatgttgaaaatttggtgaggaagttgcaggagcctaactgagagagactcaggccataacgctggtctgaccctatggaggaaagagggaaggaaggaagattgggtaggaaatttcttagtctctggtgcagttctagaaaattttggcaaggctcatgggaagtccttgagctaaagtagcccatatgaggagccccacatcttgcagaaatgggcctgcctgagtatctctccctgctcagcattgcctggggcagcccatggaaagggtggcccagaaattgatgtggtggtggatcccaagcagctgaccatctgtcattcacactcctgcaccaggaagttgagaggccatgttactggtcccacagctgagatctcaacccataaaccttgtggcagagaaaacatgctcaaccccaatgccaaggcaatcctggcattcaacataaaatcagagaatgcaaatctttatatgccgcaattcataaattctttgcatttttttagtctgcttctgcttatatcagagatagaacatccaaggccaacaatacacttcttgtccttgagaacaggtggaagtcacctaggaaaatggaacataaggaggatgggatcctcttgtggcatctgttgtgaccctaggagagacattgtggatggcgaggggatacaaattctggcttacctccgtggtctgaggatagggggatcctttcagagtccctcctatccctcaggctaaccaagcatctccccctaccctcaactattacctggtcccaggtaagaaaggaaggaggctttccagcatagccttacttttggctgggcttggcaaagaaggtgtttggagtaattatggcccctcggtcacccatgaactcagaccaaccatcactggcctcccttccagatgatctctatttgagcagtttggtaatattttggaaagtacatttcactcatttaatgggaaaataatttaaatatgatttagatatgtattgaaagaatttactagatattttaaccatgtgacttgttgttgttgctatttgtattaggggaaagatgccagggaaattaggtaactagtctaaagtcttgcaaaagtaggcaggatttgaacttaagtctgtctgacctgaaggccacattccttctcctccatggccccctgccccagatattttactgggctcgggctttacaaaatgcttgtacatgtgctatttcatttgaactgtaatattagctactattttccagtccagtattatgggacttaaagacgtcagtgccagaaggtctattggttcttttcccctcctgggactcctcctctgcctcagttgccctcattggggtatcagcccccactacagccattacaaccggcttggcacgtccacaggggctgctgcccactgaagtgggtacaatttctttatccacccattcttctccattcctttctcttttttttttttttgcccctttttttaaccctatcttcattcttgagttcattcctgccctattactcctccaaagcacacatgctatccactcttcttcactttgagactatgtgagtcgtggccgaatagttcgggaatttattttgcacaatttgcacaggccagctcctctcacatctgcttcaatgatctctgtctttatcttcccagttctggtgtctttccttcagctctggatttcttgctttggttggagccactacctcgacatgctcctgggtaatgcttttttcgtacgtgttttaacttttattcacatgagtgaaattgatttttaaattaccactgtccctagcaggaaaaagccagtggcagagccagaaagagaatctactcctccttggcccaccctacattctttgactatcacaaatgccctgtggagaaagagaaacctgcccaccctgtgtgttccaatttactgaaataacatataaggcatgatttggttattttggaattcctcaatttctgatgttatcataccacagaattttgggactatttatcagttgagtgttaacatatcagatccaactttgtaattcttctttttagcagttgattatatttttgaagcccacaagcaccaatttcagggaaaatataagcctaaaatcattcactagaaaactacagaaccgaataggagagtaaatattatttaacttatgcttatgatttgatgtctttatttcttttttattgtgaagcagaattacctttgcctagcattctactgactcaccagtctaaccaatctaccttctgagggtggcagcaagatgggcaaatctggagatgagctctttcaacaaataaacatcatgatagattcctggaaggatttttggtgttttggccgtaactttctagttcaaattgctcattcatgaatcgtcacaaaatgacattcaaaaagaaagtaaatcttgattcaattcattatactatgaagcttttgacttaagaattagaaaaaaaacctttatccaacaaacacccttttttgggggcgtagattacttcctcaattccatcttaccacagaatcaaatattcccaagtatcaagtatccttctcatgtgaaattcttgctataaatgccaaacaagaggaaaaaagaaaaatgtacaaataattaaaacacaaatatatagcatgttagtaggcattgtgtgaatgaaaaaatagttcatgtctctttagatttatgcacagataagagataccattcaatacatgtgctgatcaaagcctaaatatgaacattcaataaagtaaaagtgctaacaaaaatttgagtttggcattaggtcaccaataatgttaattgattgtacttatacataataaaagctaacattttaaatctatcctgatagacaggaataggaatccacgctccagcttgggatcaagaaaactaaaattagtaacactaactggactccttaccactaaggagctctaaccagaaacgtttgttaaaataaaaagatagggagtgtatactagtatgcctttggacttagctaagaaaaatgtaaaatataaaattgtattagtccattctcattctgctaataaggacatacctaagactgggtaatttataaaggaaagaggtttaatggactcacagatctacatggctggggaggcctcacaatcatggcagaacacaaaggaagggcaaaggcatgtcttacatggcagcaggcaagagagcatgtgcagaggaactgccctttataaaaccagccaatcttgtgagacttattcactatcacaggaacagcacaggaaaaacccacccccatgatttaattagctcccacagggtccctcccacaacacatggggattatgggagctacaattcaagatgagatttgggtggggacacagccaaactatatcattctgcccctggctcctcccaaatctcatgtcctcacatttcaaagccaaccatgcctttccaacggacctccaaagtcttagctcattccagcattaactcaaaagtccaaaatctcatccgagacaaggcaagtcccttctgcctatgagcctgtaaaatcaaaagcaagttagttccttcctagattcaaggagggtataggcattgggtaaatacacccattccaaatgggagaaattggccaaaacaaaggggctacaggctccatgcaagtccaaaattcaacagggcagtcattaaaccttaaagttccaaaatgatctcctttgactccatgactcacatccaggtcacaatgatgccaaaggttggctcacacagccttgggcagctctgcctctgtggctttgcagggtatagacccccatctcagctgctttcatgggctggcgttgaacgtctacagcatttccaggctcacggtgcaagctctcagtggatctaccattctggggtctggaggacggtgacgctcttctcacagctccactatgcagtgccccagtgggaactctgtgtggggggttccaaccccacatttcccttctgcactgacctaggagaggttctccatgaggggcctgtgcctgcagcaaacttcttcctggacatccaggcatttccatacattctctgaaatctaggtggaggttcccaaacctcaattcttgacttctgtgttcctgcagactcaaaaccatgtggaagctgccaaagcttggggtttgtgccctctgaagccacggctcaagctgtactttggctccttttagccatggctggagcagcttggacacagagcaccaagtccctaggctgcacacagcaggggggccctgggcccagcccatgaaaccatttttccctcctaggcctctgggccagtgatgggaagggctgccatgaaggtttctgatatgtcctggagacattttccctgttgtcttggtgtttaacattcagctttgtttgtttgtttatgcaaattcctgcagtaggcttgaatttctccccataaaatgggtttttcttttttattgcatcatcaggctgcaaattttccaaacttctatgctctgcttcatcttgaatgctttgctgcttagaaattcgttctgccagataccctaaattatctcactcaagttcaaagttccgcagatctctagggcaggggcaaaatgctgccagtctctttgcatatcaagagtgacctttcctccagttcccaacaagttccttatctccatctgagaccacctcagcctagactttgttgtccatatcactatcagcattttggtcaaagccatttcacaagtctctaggaagttccaaactttcctacatcgtcctgtcttcttctgagccttccaaactgttccaacctctgcctgttacccagttccaaagttgctttcacatttttaggtatctttatatcagtacaccatttcccggtaccaatttactgtatttgtttgttctcatgctgctaataagtacatacccaagactgggtaatttataaaggaaagaggtttaatggacttacacttccacatggctgggaaggcctcacaatcacagtggaagggaaaggaggagcaaagtcatgtctttccgggcaggcaagagattgtgtacaggggaactgccctttataaaatcaacagatcgtgtgagacttattcactatcatgagaacagcccaggaaaaacccagccccatgattcaattacctcccaccaggtccctcccacaacacatggggattatgggagctacaattcaagatgagatttgggtggagatagagccaaaccatatcaaaaatgcttccagtgaatagacctggggaaaataaaacaaagtaatttttaaaaatgcttaacatgaccaggcacaatggctcataccgtaatcacagcactttgggaggccaaggtagtaggataccttgagcccatgagttcaaggccagcctgggcaacatagtgagactctgtctctacaaaaataataaaaataaaataaataattatggttttaaaaatgcttaacataaccctttctacttcagcaggagggatagatttacattttgggatgttttcagcatcagattactctgggtgaccctaccttcagaagcagataaaagtggtaacaacacaattaaggagtattcttcagtgaataaaatatttgagagtacagaggtaaagaataaaagttctgtggtcccatctagggctaaatgtcaacaccataaaaatcatactgaatcactctgatcctatcactgcagaactgaaaattattccatttattttatacacattgggacccaaataagttccaacttatataaaagaatgaaaagtaaatcctgacaacctaccggaagagaacactctgccccgtgctttccattctccttcgaatgcgtgagtgtctctccctgtctctctgtcctgctctctcacgtcactttcttttctccatctttatttcactcttctttggtgtctcctttgcttactgacatgtattgggcttttttcttatgcattgtcctcctcttattgcttattattattagtgctgctgtgcgaaaagttttgtttctttttttatcatttcaaaagcagaggagaaaaacgtttaaatgtatattgctcagccaaaataatgtttatttgcatgggaacttcgatttgtgtgtgtttgtgtggtataccagagagaatggggacagcaatttttcctattgtagaacgagaaaaggaccaacccctcttcaataacaccagataatgggtaaagtggctgaagttagttattatgtgctttaccaaaccttggaatcaaattgtaatacaaatattattgttattccttcctttccctccacatttttttttaaatagcagttagggggagtgatattcccctactttgctctgtttggtcaatctctggctcatcataaggtagagacgatgttttctaggaagcctgaacgtagggtgcttattattggtgtgatgtttagtttgttaattcccaccagcctgagaccaccaggagcacaccacagaaaggtgggtctgtgggcttgcaagaacaggaacattagaggggggtgtgcactgtggggaactacggggcatccttgtaagggaatgtggagaggaggatattataggattggggctggtgtcgggtgatttcagggagtgaagatttgttgtggattgggtggtgctcaggaatggatgcaaattgatagcaggagggcccacgtggggctgtttgtcattgggaaaaaagtggtagccagtcaggttagccagatgagggagtttttcggttatttttgtggccacacatggttttggtgttcagacacaacgaaggcttttttgtgttgtttggccatgatcatggagtgaacctgtttgattattgctgatagtctatggaattgtattatgttcaggagtctagctgttacctcagtctggctggtacctgcaaactgccagctgccagagcctttttgtttttccttctttctcaggtctcagagtaaatgttaaccaatcggtcagtccatccatgtgtaatagctgctatgcccagcactgagctaaacattatgaacaccatatggggactttctcattaataaaacacccacatttaaaaagtaatggaaaagaacataaaagaactagagaatacttaactaatatttgaaaccgaagtaaatattctatcactcatccattttgtgccctagaaggttctaaatgaaaagttttggtaaaacccttcatttatttcatagctaagagaaagggtactgtttgaaaattaatttttataaataattgaattgttcctcctcctagataagctcaagacactttgttaaatgaacacctgacaaaggctttcattttttctaattacaaattagagatactagctgggttgtgtctggttttttttcattgtttttgtttgtttgtttatctttgttgttgttgttttttacctcttgcagcagttgaaatgcatgtggtctttggttctgtatatttaagctctagtttattacttctaatctttaaaagatattaaatcatttaaattggcagacaccagtgtttgctggctgctcgaatattaccatttaataccctacattggagaattaaagcatggtgccctgctataggcaaagtttagaagagtcctgcctgtcatcttgatggtttccaacactgagttttctaattactatattttggtagggcgaaactgagtatgctgatggtttttgcagctatggtagtaacatttttccagccatctttaggtatgtttttcagtggaaagtttagcattggaagtttagggtttttttttttttctttttcttttagtggagtgatgtataggtattctattttattactcattggaaaattatctatttgtacagtgcctaaaacagctgaacacctagtaattgttcagtaaatgatgatgatgatgatagtgatgatgatgatgattttctcttcaaattaaggacaatgtcaaattaattcttgttctctagcttctaatacagtatttgactcagcctccctaccagccacttgactttgctaattacttatgttgtaatcatttgatagtaatttgaattattctttttttttgagatgtctttgtattccttgaaagaaagttattgtttgttatatatcaaaaatttttagcaatctttagggtcttttttctctgaaaactcaagtttatttttgtctttttatcaaatacttttatagatttaggaaataacttattctagtttaataaattatacttggcccgttattgttactccctaatctttctttgtttctgatggggagaaaggatccttttagattctttttaagtcactctgatttcattctggaaagaataaggcaacatacatcaaatccttttgagaatattcaacatgagatagttttcttttaagtctgacagtggcaggccataatactactgaataaattcttaccaaactgaagcttctgggctcagtttcaatgttttatttagtattgttctcaccagctttcttctgacagggctcaatgaagatgttagttaatattcttgcacattgcatttggatgggtttgctctttttggtactgactctgttacggttttcacaatgacacacacttctgttggtttattactaaccatagttgttattgaagagaacctctctttcggcctcagtgatgtagtaaacggtaattttgcaatccttacaaattcacccttatacaatgtatggtacatttctgaacatggtaatttttaagtgctttcaacttgcaaagtagcaaattgatacacaggggatttccgacagcttcttctccagactgaatgtcactcatgggattgtgattccatgtgaaataaggcaacattggccggaggagctgccatctggactttgacgacgaaggcatcatttacacagggctggcattcagagccagggtcacaaagcagctctttccaggagcaaaatgaagttgtcaagcaagtatttgctctgactctgccaggcaccattcagatatgacaaacttgccttcctctttttattacagcttactaattctggagaaagatggaaatttttttttttaatgcgtgctcttccaaaggtcaaaacaattttaaacaagggcaggcacagtcctgcaataaaaattcagcaatctagttgtgcaataagtccgtgtaggggctgagggaagtgtcatgtttacctctctggaaagggcactgtaatcaaaagactgatggcaagaggagctttgaatttgttgttctatttctcccacatctgcatgaaattgtgtctttgaaactatatattatggagatgagtgatactggagagaaacacatgctctgaagtaaacagaaaaatacagcagcataataaaatgctttgcccacttttacagcctctgtggtggccatgaaataggagatgccaactgatggggatgtgagtggagctgtttgaggggtggatttttccccattactacacatagatgcttgcatctttccctaactgtgtatttccttaggtgggtaatgacagtcagtggaaaagccagtgcctgctgttcaaacacagtgtggaaaaaatgaaattgaaaacagtggtgatgagatccagttctccaatattcctctcctagacagactaaaacctttcttctcccgcagcgttagcgctcactctggtcctctcagctgcaaagcagatggatttctttgagaagtggtcagaatttccttgattcaggagctggacctcacgccctcctctagggctccatcatcaccacacaggcacacggccacacctgagtcccatacacagagaagggtggtcatggacaaaagaaacagtggacaaagttttgtgtatgacaattcctggtggctccaatagcaggatggatggatttgggctattaacagaggtccaaaatcccaaaaagtgaccacatgtagatgagacagtcatgacttttatgtgcatttgaattgggcttgagatacctaagtggggatgcctaatcgacagttggatatgtgagtctgagtctcagaggaaagagctgatttaaacgtacaaatgagtgagtcctgtgtctactgaaggcctgaatatggatgagacagcacagaaagcagaagaagagggagcatagaaagacgggacttggaaagtgccaactttttcattgtttgagttaaaaaaaaaaaaagttaagactaacagaaatagcaaccagagaagtaggagaaatcaggaccagctctcgggacataggttaagtgtaaagactgttccaagacaaaggaatgacagggacaatattgagcatcaaatgctgctgagaggtctggtaaaataaaaaatgcaaagatctattggatataatgaaatggaaggaggagtagaccttaacaaagaccattttcatgtgatgattggagttgggtgtgtgtgtgtgtgtgtgtgtgtgtgtgtgtgtgtgtgtttccaagtaagataatcagtcttagatgccagtgggaggaatcctaagagaaataaagaataaataataatgtacatctcctgagaagatggagaaagggtagaaccctaccataagaccaggaagtggccagaggtaggaggaaaaactgctgtaagagacaggagaagatggtattcctacagacagaatggtgaggcatttctctctgatatcctgtatttttccatgaatttaaaaatgagatcagttgttgaagaatgaaaaggaagttcctgagagcatagacacaaatagatacatgtgttttgttgaaaggccaaagagtgaaaccattggaattgagtatatgtagcaccaccaaatgcagaaatctattaaattgttaagaatatggaactggagttcacaggagggagagagagagtgggactagacttatgtggcattagcattaccaaaggtgtgtattgtagtcatgggactgaattcatgaagtcatttaatatatactgaattattatgaatcctagtagctgcagagaatatatactgagttattgttatgaacctttgtagctgcaaagataaagtgagatggcttccacccgctgagtagtcgtcggtctagaaagaagctgacatttacacaggaaataggcagtgtgaccgaggctccaataagcaggacaaggttttataaatgtttgtaagaaaatgcacctctctttgctagaagaatagaatagttagaataggaaaacaatgtttgtatctatacataaagaaaaagcaggccagcaccgtggctcacgcctgtaatcccagcactttgggaggccgaggctggcagatcacctgaggtcatgagtttgagaccagcctggccaacaacggtgaaaccccgtctctattaaaaatacaaaaattagccaggcctggtgatgggtgcctgtagtctcagctactcagaaggctgaggtaggagcatcgcttgaacctgggaagcggaggttgcagtgagccaagattaagccactgcactccagcctgggcgacagaatgagacttcatccacccctcatccctaccaagaaaagaaaaaacagtggcaaacttgatgaagaaatgagaagaatatttctgttaccgagaagaggtgtgaataatgttgttacaatatatgcaatgtaaagaaaatagacatgtggcaatataatccaattaggtcacttctgaaaacataatcagaaaaaaaaatcatagaatcatgaaataataaagccagaaacagagatcatcaaagtccatgccccatgttagacagcaggaaagagcctgaggaagaaatggaacgttatgatcataatggaggtggaatagagtccagatctcctggctccaatttcagtgatcacctcactcactgatctctatttcacagccactcttgcactggctggaatatgcaggatctgtaatatccttgggaaggaacagaattctctggggtccactgtcaaatagtggacatctgaatcagctgcttcaggtgaggtggtgctcagccccctgcctctgtccacagatagagaacagagttactttgtgagcctctaggctgtcaacattacccttgcagatctgtaggatttatgctatgctggagacataactgccgacctagtgggaccagagtggaggtaggaaggcttccgagtctctctttgtaaagcctgtgactacgagccaggctttaacagaatccctgctttactccctttttgtgggttatgccatgtacctctatagtctcccaagaatctgtcaagatatcagcttttattactcattaccctaaacctaaagaagacagacaggacagaacccaggaaatccaataagtggatttcccagaaatgaaagtgcatagaacctagaaatccttatatgtgaattttcttgtgaataaaaagtataatagaaaaacaatttggtttgacaaatatatacagaaatcttttgtttgtgtgtatgtgtgtttatttaagattcgcctgcttttgtaaatgtaatcagctacatacaatttttaaatttctcacttccgtaaaattgtctttccttgggtcatgattctgaacactgatataactgtacagcatgatagatagggtaggtgtagaaaattgtactgaattgtcattgagtgttggctataccagggtctcccagaatatagaaagccttgtgctagttagaaaatgggctcctcttctctgcaggccaattagtttcagccagcctcatgagctgactgcatactgaagtcagccccaaatcctgccctcccaaatcaacctgcactaccatatcttaagagtagactgtcaaaacaagtccctggtttactcttttttttgagacagtgtaagacacaagtagattattgagcttcctgaaaagatagattcagagtaattaaaatttgattttaatgctgctaagaaaagaatagagatgtgatataaagttatgacacaaggaatacaaataagattatcacttatggatgatggctgtttgaaagataagcccaattatgaacaccaatacagattctgcaaatgtatgttcagagatggttatataagtggcataattgctgtaccttttacatagaaaaattgcagctattctttaatcaactgacactgggagaaactgattaggtgtgataaagttgcctcaggtgaaatccaatttcaactgatagactgaggcataaagaaaggaaaaaatacaccgaaacaccagaattcaaaatgtgcgcatgatttttaaaatttattttctcttttttctttttttaaaaatgtgtttagatatgaaaaaagaaatagaataatgacttgaattcgtgcatctgaaaaatgtttattaaccacctaactatggacaggtgctatttatcagaaaccaaaacaacagctcaactctactggatcataaactctagtgggaggggacaaaataaacaataaacaaaacagtatctaatattagaggtggataaatgcaaatagataaataaagtaggataagggttatggagtgaagcaaagatgctctttggaggttattaagtgaaagccagcctaacaaaatggcatttgaagaacatctaaggaaggaggatgaaaggtccttgaggatattaaggaaagagaatttcaggtggcaaaaatagtccctgccaagccctaaagtgggaatgtgcttgggtgtttaaggagcagcaagatggcagaccggctggaacagcgtgagcaaaagccttgaacaatgaaagaggtcagtgataaataaggaattcattcttcacagaaaatggggcgatgcatccaggcaggttataaagattaagagttgaaatcagagaggcaggtggttttgatgttttgagatttgcttcctaataggcatcttaatcaaattattcatccagagttgcaaagcagcaataaccaaaaacatatctgaatattgagtaatttgtcacattcattacaatcaaactgatatcatttgcctcgccagaaaaaaaaaaaaatgactaattgacataatgtgaagagctttgaagaattgcatttaataccagcaggttaatcaaaaggctaacgaaacaagttttagttaaatacatacaaggaaaaatgtattctgtgtctttcctgctgttgtcaggaaaaaaagaataagggcaaattttagtgatttcactgtttatatgtgtcccttttacccacttgaaaaatctgccacttattattgttattgaattttccgtcatcttactgctcttctgtgagattggaggactttgaatttgtgccacttttattaactgcttgtgccatcgagaaaggctttagcatcttagtttcctgggaggaagaccgggtaatggatgaataatgtgtgactctgccagtttgatgtgttataaacaaaaaaaggatttgtgcccccactaaatagcaggcttgatatgagacctcaggttttgagctgcataagcagcgtcttgctctgctgttgaagaatggatgcatttttcagatagtaagtaacacatgactgtctggagagtaacaagtattgggttggtgcaaaagtaattgcagtttttgatgttactttcaatggtaaaaaccgcagttacttttgcactgacctaatagggttaaaggtcaaggctaagtattttaatgtcatcaattttattttctttcttaatgtgttaaatagtagaaaagaagaggccaggtcagaaagtctcaatattaaggcttatttgtctcccttgtccttttctggactctcctggtcgtgtcttcatcaaattgggttaagaaaccaaactcagcttgagatattctccaaggcaatgtttatgtggagttggttcaggccccagcacgttgggaagaagtagtaaatatcataatagtgattgtagttattgatcagtattggtccaatcatcagagctttgatctttccttctttgtcaatttcttttacttttgactacagattcattcagaactccaccccccgccaccccgccccatcttgcagaagccacactttctccttcatcaccctttggctggtctgtctctctctccttatgttcagaaggcttttctgttttgatcattcatgtttgctttcttatatcaccttaacctcttaaagcttgatcacctgaaacatgagtctgccgctcagatgattctaatcctcaaatctgatgatgtcggccaacctttacccttggaacactggaacatttacctttctgaaacactcaccgctcgtttacctgctagaagctggagtacagaatcagtgtccaggtggaactcccagtctgtagggaagatgagcacataaagtaactgcaacacaatacatgaatcagaggaagaaatgcaataactaagttctgcatgaactgtggcttaacacaaatagggaacaaatactagtggctgtgggaaatgagaatgaaagcagatttcagagaagtaacattcttcaaatcacgttgcctagacccttcccattttgtagctgctttcctaaattctttcttcctctcctgttgctgcagcaccctaagaggtggggccttagctagccatgtgccccattccacagactgtcccatgctcaggcatcagttgtcactgtggatgactcacagaattaaagatgcggttctggctgggcgcagtggctcacgcctgtaatcctagcactttgggaggccaagacgggtggattgcttgaggctaggcattcaaaagcagcctggccaacatggtgaaaccctgtctctaataaaaatacaaaaaaattatccaggtgtggtggcaggcacctgtaatcccagctacttgggaggctgaggcaggagaatcgcttgaacccaggaggcagaggttgcagtgagccaagatcatgccactgcactgaagcctgggcaacaagagggaaactccatctcaaaaaaaaaaaaaaaaaaaaaaaaaaaagatttggttgtaatctctctctctcttgaagtcgtaagtcccatctcttgtacatcctcatttccaagttgctatgtcagagggcttctcaaccagggtgctactggcatttgaggtgtgacatttattgtgcagaactatctaacacattgtaagacattcagctttcatgggacctgaggcactacatatcagtggcaccttacacatgtttccgaatcatacctgaggaggtagtgccagccccagttgagacccactggcacatcaaattcaccctctataaaattaaactgaaaaagtgttcatttcccccaaaattaacactctcctactgacatttctttcaaaatgttcagatttgcgtaatcgtgaaaccaagcatttaccactagctgatccatcaggtcaacacatcctactaatgtccttttatagtatgttttccctctgtctgttaggcagaatgtcacatccatgatactccaagtctttatcacctaatttgtagaatagttcctctatttactgttgcctttcctttatgtcacattgtataataaaatatcaccttgaccatgcctctcccttgctttaaaacctacagtaacagacttcgactatacaattaaggccaaatagatacaacaaaagtgctcccccataaacatttttaaaatgcataaggccaggcgtggtggctcacgcctgtaatcccagcactttgggaggctgaggtgggtggatcacctgtggtcaggagttcgagaccagcttggccaacatggtgaaaccccatctctactaaaatacaaaaattagccagatgtggtggcaggcacctgttatcccagctactcaggaggctgatgcaggagaattgcttggacccaggaggtggagattgcagtgagctgagatcatgctattgcactccagcctgagggacaagagcaagacttcgtctcaaaaaaattaaaaataaaaataatttttaaaatccttttaaatgtatgattgagcatgcaagaaattgaggaagatccttgaggcctaaaatgaagaaaaatcatgaaccaaggttataaatgaatgccaaagccagaagctgacctaaaggcttctgtcagttccatgcaaccagcagcttttctttcagtggctatatgaggaagaagggtccatgccaagtaataaattatatcaaatatccctgtatggaaaacaaaatccagggggttagactctcaatgaaaaacaaaactgaaaatggaaaaatccactctacaaaagaagataatgtaaaaattttgattatctgaactttagctcagagtacaaagaagaaattatcccttgaagctatgtaatagaaagccagttctgatgcatgtttacagcctaacttcacagcatttgaatggttggagaaaactcaagctgaaaatatattttaaagaggtcccagattggtaatgtctccatgtatctgagaaaagcaaatgcagatgatctgagagagacataccttctactgaacctcacaggattctcacagacatatttccaagaaacatgatctcaaaagaaaaaataatcaccaaatgtatggggaaacaagatactgtaattgtgaatcaatagagataactaatagcattttcagtcctacagaatcttcaggtattgaaattattggattgaaaaaaattttaaagagaaaagtggatatactattaaaaataatgggtaacatttgaaaaagaaccaaataaacattacaggaataaaaacataatagataaaattaaaagcttaatgttagagataaatagcagtttctacccagctaaagtaggaacaatgaaattaaaaatagattctgaagaaatttcccagaaatctgcccagtgagagttgtcaaatatgaaaaataaaatattaaaagcaaggagattagatcacaaccaatcaatacatctctaattggagttgtgaaagaagagataagagtggtgaggccttattttggtgaatgatggctaaaaattgaccagaaccaaaaaaacatgcaaattaagattcagattaaggcatcatagtggatgtaagccagaatgaaagcaatccccagctagacagaaattacagattatttacaaaagaattgaaattaaactgaccattgacttcttgacaatggaaccctgaagaaacaaactattgtgagaaaataaccattgaccttgaatatgccacccagaaaaaaacacatatataaagtctaaataaagactttttaggacaaaataatgataacatactaccctctgaccctagagaaaaaaagatctcataagaatagtctgagatagaaaaaagagggaacaaagaaaatagtaaaatgtcagtaaatctatgcaaacattgacaatattgagcaataaactttaatttgtgatatttaaggaaaacaagatgaagctaaaaaatagatgaaataccttatatgtaaggaacagaaacaagctataaaattgctgtattgtttaggaagagaataaatatactatgttgagacactgttaagttaaatatgaaatttaaactttctagggtatctactaaaagaatgatatttaagagaatgcaaaattctaaaccagtagaaaatatatggaatgaagaaaaactatcaattcagaaggaagaaaaaatacttaaacattagtaacaataaaaagcaaacaagagagaaaaaaaggtacaaatatttggaaataagtccaagtcagttatcacaataaatagactagactctccagttaaaagataattttagacaattaaaaagaaaaactatgtgctgtacacaagagatattaaaaacattaaggacaccacaaagtctgaaagaaagatgatagaaaacaaggccaggagattacaaattccaaaaagctattgtgagcctattgatacgaatgcaaatgaaagagaaaaaaaaattacaattcagagcattacaatagcataaaaatttccaaattactgaaaatacctaatgctaaacttgggaagattgaaagatatagtattatagaagaagcttttaatattgatgtctcagtaattataggtcagaagcctttaaaaatcattaagtgtacagagcagcagtatccaaaagaactttctgaggtgatcaaaatattttctgtacaatatggtagccattagcacatatagctagtgagactgaaaaactaaattttaaatagctgcgtgtggctattggttacctactgggcaacccagataggattaaatagcataattaataactgtgagtcaatgcacacatagtactattagaaaataaatattttttcaagcacatgtaaaatgtttttgaatattgaccacagactcgattctttaaaataaatctcaacaaatttcaggttattggtatcataaatcctgttttctatgaccaattaaattttaaaaatcagctaaaaagacacttttacaaaaaaagcttaaagcaaaacatataattagacattttaaaaatacttctaaataatccctgcactgtgggagactgaggcgggcaaatcacgaggtcaggaattcaagaccagcctgaccaatgtggtgaaaccccgtctctactaaaaataataataatcaaaattagtgcatattatcaaataatgatgacagcataattcaaaacttgagggatattcctaaagtggtattttgatagaatttatagtcttatgtgtatagtaaaagcttagaaaggctgaaaattattgatccaagcatccatcttaagatattagacaaagaagggaattcttgtacacttttggtggggatgtaaattaggacgaccattatgagaaacagcatagaagttcctcaaaaaataaaaatagaactcccatatgatccagccatctctctacctgctatgtattttttaaaactgaaatcagtatgtcaaagaggtatctgcattcccatgttcattgcagcattattgatagtagcccagatgtggaatcaacccaagcgtccatgaatggatgaatggataaagagaaagcaggatttaaacacagtgatttctggaacacagaagaacatagaatacattatgttgagtgaaatgagctaggcacagaaagacaaataccacatcatctcacttatatatggaatttttaaaagttgcactcatagaattagagagttgaatggtggttaccagaggctagggaatgggaggttgcagagttgttgatcaaaggatataaaattttagttagataggaggaataagttcaagagatctattgtacaacatgatcattatagttaatacagtgcattgcattttgaatattgctgagagtacacaaaaaatgataagtacgtgaggtaatgcgtatgttcattagctccactgagccatttcacagtgcatacatatttcaaaacatcatgttgtatgtgttaaatgtatttaatttttatagatcaattaaaaactattttttttaaaaagaatagactaaaggattataggatatatccaaaggaagtagaacaaatgaaatgcatgtaaaagcaggaataaatgaacaagaaaatcaaccatacagtaggtaaaaatcaacaaatagatttttttttttttttgagacggagtctcactctgtcgcccaggctggagcgcagtggtgagatcttggctcactgcaacctctgcctcccgggttcaagcgattctccttccgcggcctcccgagtagctgggattgcaggcgtgcaccatcatgcccggctaatttttgtatttttagtagagacggggtttcaccatattggacaggctggtcttgaactcctgacctcctgatttgcccgcctcagcctcccaaagtgctgggattacaggcatgagccaccacgcccagccaacaaattgattttttgaagagactaacaaaatcaataaacttctggctagactggtcagaaaatagcaggaaaatatattagtagaaatgaagaaaagggatataaacacaactatttcccaatatatttaaatatttaaatgcaaagagcaaattcatttaaaaaaaacaacatctacctggaatataacataaattagaatataaacttatagaaatggatataagaataatcttataatgaaagatactaaattatatgagcctcagatagtttaccaaataattccaacatagccccccctaccattctttgagtccagtattaacttgataccaaaaacataatgatagtacaacaaagggaagttataggccaaagtcattcatgaatacagtggcaaaaatcctaaacaaaatagcaaagcaaacccaaccatatgtatgaagaatgatttatcacaacaaagtcgatttttttaaaagtactattattagaaaaaatctctgaacgctaaaaggagaaaaaacttttatcattttaataagagcagacaaaggattgaataaaatttagtattgattcatgcaaaaaaaaatcctaacaaatgagaaatgacaaatagcttccttaaacataaagatgaactattcttaacaggtgatagcagcatctcaactcaatggttacacataaaagcgttttctttaaaatcaggaagcacgtaaagaccgtcatcacaacttagtttaacattgaactaaatggatcatatccactgcattaggacaggaaagaagacatatttttataatagatagaggttggaaaggaacaactgttgttaaaagaataagagaaacaaaaagaatcaaagaaacaaatagcatatgtttccattccatcactttggtattaatcacacttgtttctggagaccatggtgtaaaggaatgagccaggattactgaagggtcctgcagtgccagtgaccacaagacaagccagaaccaagttaacttagagtgaattggcctattctttaatactgctcagaattacaaactcccatataatctgtcacttaaattccattcaaattaataaaatctaattcatttgaataagacttaaagtgatttgattctactgcatcaaattctgctcagtggaatcagtccttgattgaaatctattaagttcaattcagtaaaataaatttaaatattatgcaatacaattaatttttaattaattaccatttcagttcaggtccattttgatctgaacttcaattctacatttctaaatttggtccctattcaaatcaataaaatgcagcaaaatccagtgtaattctaaaagatacaacctgaagctaatcaactgcatttatttctattcacccctaatcagatgagtttagtgacattcaatcacagaaagataaaatgctcacctttaactaccaaattgaatgtttacattagaacttcagaattaccaggttttcccaaactcacatcaccatctgcagtagggactccacaggattttatcttgactcattctttgtttggcttatatattaacatagaacaatgtagaattggatggttaggaaacaaaagagaatattgctatcctgtttaataagctgaaatcataggtaagttgagataatagacttttgcatctatgagaatgccaatacatgattttttattttatttttaaagttcttaatttaaatagtaaaagacaggaatttttgactccagaccatggttataaaactgagaaaaaaagtattaaaaggactgtattattcagaaaaaaataattgggaattaaattgagatgttactatagtaacaccattatcacctctttgtatcttaccaagcaaacaaggtcctggattggtatcccaatggcacccagtcatctgggcctctttgtttctttatagatgttcccaagtgtccagtgaactccacctaccactgtccttttcccaggtcagtatatggcagactggtctgatggtaaggatcacagggacactgagtctcaaactcttcctctgagattcttattctacaggacaggggatctatattgtttacaagatcttagtggaatcatagggaaattgaaaacccttccctatacttacctcccacccgtgggtgaaaaacaaaaaaatcagaagttattactccacggcttcacctcccccacttcatcctcctgtaaggatcctgagacttcagctaccatggcccagatcttggaagtgattctgtgcggattttccacatgtaaaagaagaggaagctgtctgtatttaagccagagaactttaggactagtagcctgtttccatttccagtccctgggggaggggttcccatcaggtttagctttaagcccctatattcctggaagcgtacacatccatactggggaaaacaagaaaattctggccggcttgatcttccaaattacagctatcagatgatttggaggactctatagaggctacagcacctccaaattccttctctgctccatcccatcctggagattattataaaagcttttacctttcttgttatctaggacatttgcactggaaggaaagtttctcacaggtgcaagaatgttttgaatggtctagaattgcaccaattaaggatgcctatacttagtaagtgtatcatcaccattcataacttaatatggattttgtaatcagatcagagtgctcagctgaaatttacttataaagtggagaaaaaagatttggtagtggtaagaaaggaagagagaaggaagtaggagatttttctgagcatgagtcgcttagaaaaaatcctgcactgcaagggccttcaaataaccaaatgttaccagagagcagagcctgggaaggactgccaatgagctgccggcaggggacactgggaacaatagtgaaaagcgtgtttgtgctgcaagggtacctgttctatttcctcagctgaagagcccccagggactctttaacagaatttgtagataaggttgtaattgtacatatgataaaactagttctcatcaagccaaaaagatgcttttacgttttcattttggagattatatacccttgtggtgttgtttttaatatcctatagaaacagtgggaatgaaagaaattaaatgtcccagagactgtgctgggtcttatctcagagggcgccaggatcatatttatttaagcagcctgttaagttactctgtgtagcccagaagttccgaagaacacattttgaaaatcacaggtatgcacctcattttcatcaagcagtccccaagcattcgcccttgtgcttctgaaacaacttcttgttattggtgaaaataaataacagaaatctattggtttctttttctttctttctttctttctttctttctttttttttttttttttttttttgagacagagtcttactctgtcgcccaggctggagtgcagtggcacaatctcagctcactgcaaactccacctcctgggttcaagtgattcccctgcctcatcagcctcctgagtagctgggattacaggtgcacaccaccacagctggctaatttttgtatttttagtagaaacggggtttcatcatgttggccaggctgattttgaacccctgacctcaggtgatcctcccacctcggcctcctaaagtgttgggactacaggcgtgagccaccgcgcccagcttattggtttttttaagtaagtcttggaaaactcctttcctttctagcctattttctttctccctttcccagtttaatcatccacaccataataaacccttcaccataataaaacttgatctgaagtgagtacaaacagtatagtgattatatttaattcatttcatatttggctgttttaatacaatatgccttactttgataatttagctctagttaacttagaatgccattcatcattacctaaccttgttgcagtgaccatagctacttaatatagttaaatacaatcttcatattctgaggttagagaagttcttgaactcttggaaatagataattcagttatttctttcctcaccactttttgcccttgtcttttaaaaaagctttccatttttattgcctttaactgctattccccaaagccaattaacaggtaaataatgatttgtaaagctaaaagtagcatttcattagcatagcactggaataagggaattctttgctcaaaataaattgaaccgttctcctcttgctgaatataaaatacacaacaaattaataatttattttagttacagtgatttaaccaaattagccaatgctaataacaaagtctacaatttcctttctctctggaatacgtttttcttattggcattcttttgcagtagatgtggaaagagctaagttaagcattttgtgctgtattttaacttattttcctaggaaaaagaacagaacaacatcaattttgcatcagcctcactgggggcattcgttatatgaagactaaagtattgtgacttgagaaagagtgagggatgggagaagaagctgggaaaccaggctgctcttgccaggtcactaacttgccacctccttgcacctgtactccttgcacatggaggaaatatttcagatcatccccttaggtcccatcctgttgtgtaataagagtccctctctactgtaagctgagggtctgccatatgagattagcacacagcctggatcccatgcacagctcagggcttctactggaacacccaccgtaaccgcccaaggagttcaccttgcccgctgcctagacagagtcgattcatcaagacaggggagttgcaatagagagagtaactcacgcagagccagctgtgcaggagaccagagttttattattactcaaatcagtctccccaagcatttggggatcagagtttttaaggacaacttggcgggtcggggggaagccagtgagccaggagtgctgattggtcaggaatgaaaccacagggagtcgaagctgtcttcttgcacagtcagttcctggatgggaggcaccagatcagatgagccagtttattgatctgggtggtgccagctgacccatcaagtgcagggtctgcagaatatctcaagcactgattttaggagaagtttagggagggtcagaatcttgtagcctccagctgcatgactcttaactataatttctaatcttgcggctaatgttagtcctacaaaggcaatctagtcaccaggcaagaaggaggtctgctgtgggaaagggctattatcatccttgttttaaactataaactgtaagtttctcccaaagttagttccgcctacacccaggaatgaataaggacagcaaggaggttagaagcaagatggagtcgattaagttagatctctttcactgtctcagtcataattttgcacaggcggcttcaccactgcccaaacaattcaacaatgaaacttcctttcctgggcttctgagcactctctgaaggtacagtgggaaccagctgtctctcttcttttcccctagagtatgttccttgtagtctcattctgaaggtaaagctgattgttatcttctccttttactgagaatgtcctaatttttacaaagaatactgggccacacacagctctctgattcatgcaaattattactgtctgcaatgaaaatgaaacacagtgttaggttgtttctactgatcactcaaaggaacaatcataaattgggcagagattctgagatatataatctttcattggttatttgaggtatgggcaggacaaaggagtcatctgctagacaaacctttaactccacttttacaggtgcccgatttgtttcttctcctccaccaagagtgttagtgtcctctagtttccaaaaacagtgatactaaccaaaaattcctttgagagaatttagcatgaggtcagctttttgaatgcaatgcaaaaaatgaatatgataatcagttttggtaatgtttctatattttcagggtcaggctgtggcctgcccagcctcaaaggcatttcatgaggtcaaaatggaaccatctacctttgtcctctctctataacatggccagagatggaatcagccaagacctagtgtagcttttgggccaaatgaccttaacatttctttcggtggttgagatgctgtggtttccataaatgggatatttcaacgcttatttttgaaactctagacttcataaggagaaaaatttattattggccatgggaagcatcagagaagctggatgctttaccacttaccctgatggaaaaagaaaggagaagcaaatgacttaaacatagaaagcaaacacagcccccgcatgctgggaccaggcacaggtggacagaagacacagcttcagggtggacctttatgtcagaaagcgggcatgtttctccctttggaacagggtactgagctctccctcttgactgtttaccagattaagtcaaatatactttctttaatgtgggtgccaaaaatggtcatgccaagggaaaataataacttccaaattaagtcaacacacagaaaaatcaagaaatttgtttggagggagagaatacctgaataactaactcattttcaaattcagagggcttgctcattcattacattcatcctggactccagtccctgttcattctcaactttaaatcacccacctgttaacaaaattattcttgaggaaaactactggaatatctgagaaagtaccacagtatttttttgcataattccaatatggtccctactttttgtattgtttgtttagatattgtgactgttcacatggtaactttatgattttcctcacctttatttctgagcactcatagagtcaagtgtacacttaacatcccaagagggtggatgagttattaccatggaattttaacccatatacccagatttttttttctttttttttgagacagagtctcactctatcaggttggagtgcaatggcgtaatcttggcccactgcaacctctgccaccgaggttctagtgattctcctgcctcagcctcccaagtagctgggattacaggcacctgccactgagcctggctaatttttgtagttttagtagagacggggtttcaccatcttggccaggctgatcttgaactcctgaccttgtgatctgcccacctcagcctcccaaagtgctgggattacaggtgtgagccaccacgtccagccccagagattttaattgactggctattttggcttactggctgacattacctctgttagattccactcattccccagcttctggcaaggaacctctgttctcttagcataatgttctcaaggttcatccatgttgtcacatattgcaaaatgtcttttttaggtctgaataatattccattgtatgtatacacaaatattatatgactctgcttatatgagatatctaaagtagtcaaatccagctgaatgtggtcactcaggcctttcatcccagcactttgagaggcagaagcaggtgaatcacttgagcccaaaagttggagaccagcctaggcaacatggcaaaaccctttctctgcaaaaaatacaaaaattagccaagtgtggtggcatgtgcctgtagttccagctactcaggaggctgaggtgggaggatggcttgagtccaggaggtcaaggctgcagtgagttatgattgctccactgcactccagcctgggtgacagagtgagaccctgtcttaaaaaaataaataaaatataaagtagtcaaatcatagaaacaaagaggtcaccaggggctgggaagacggggaagtaggcagttgctaatcagtgggcataaaagcttcagttaaacaataaaagtaagttctagaaatcagccatacaacaccatatcattaatgctacattggacactttaaaagttgtcaagagagtggatttaacattaagtgcattctcatatgctaaagtcatattaagaataagaaagagtcatccagtcagacgggttggctcccacctgtaatcttcgcactttgagaggccaaggcgggtggatcacctgaggtcaggagttcgagaccagcctggccaacatggtaaaaccctatctccactaaaaatacaaaaattagctgggtgtggtggtgcatgcctgtaatcccagctacttgggaggctgaagcaggagaatcctttgaacctgggaggcagcggttacagtgagccgagatcgtgccactgcactactgcactccagcctgcacgacagagccagactccatctcaaaaaaaaaaaaagaaagaaagaaagaaagagtcatccattgtcagggtcttcctgctctctgcttccattctttccactgcctaccacgtctaggcttttcttcccgccattcacctgaaactcctttcatcaaaatctctagtgaccttccagctgtcaaattaaaagaaaactcttagttccccatcttaatagacttcactatgaaatctgatggtgctggcccctctgctctctgggaaatcctcctgtgtttttctcccatcaccctggctgccttcgttcttgcactctgctatggtcatctccatctctggtacggtttggctgtgtccccacccaaatctcatattgaattgtaatctgaattgtaaccccatgtgtcaagggggggacttggtgggaggtgactggatcatgagggctattcccccatgctgttctcatgatagtgaggaagttctcacaagatctggttgtttgataattgcctggcacttcccccttcttgctttctctctctcctgcccccatgagaagacgtgccttgcttacccttcttcgtctgccatgattgtaagttttctgaggcctcctcagccacacaaaattgtgagtcagtcaaacctcttttctttataaatggttaaagacccagtcttggatcattctttatagtagtgtgaaatcattcttgggttttggtgggttttttgtttgttttgttttgttttgtttttgagacagagtctcgctctgtctcccaagctagggtacagtggtgcaatctctgctcactgcaacttgcacctcccacattcaagcaattctcctgcctcagcctcccaagtaactgggactagaggcgcctgccactgtggccagctatgaaatcattccgtttttgaaatgatgttgtaatctaaaagattccagcagcatttctcccacttccaatatgttctggtttgccctgatagttcctaaaacatattttcagctcagaaaatcctcctgagaaccagacttctacaatcaatttgtacattttgtgagcaaacccattatcttttcttcaacattccctagacttttgatgatgatcttccttccctgtgccctaccttcatggagcatagtaccatccccattcatacaaaccagaagcctggattaatccacagcactccctgcccatcttctcttctacctaaatcccaacagtcccagccagctataactcctgaaccttttttgtgtgtgttttctcttctcctccatttctactactattttattacttcttttctctattaacataagagcatcacatctagcctccctgaatccattttgcagaaatctatctttcatcttcctgttgatcttttgaaacacaaatttaatcatgctagttccctgcttaaaatcctttactagtttcccattattttcaggataaagttcaaacgtcttaaattgggggaagataaacattgaaaagaaaggataaaccaatgaaaaataacttcttacttggacaaaggtattttgcaatgtgaccttcatctgctgtccatctatctcttactatctactactgctcctctcagcacatctcttcagcccaattctactacatatgaatatagtcctatacatattttccaaatagaagtttacctttctgtctttttacattctgctccatttgcctaggaggtcttacctctcttatgtccttattgatctgtgtaatgcatacttgaccttcaagatgcagctcaactattttgcctcctctgggagaccttcctttatgacctcatttgcctcccccactctcctctgtgttcataatactgataaaactgttctccaatctgtatctttttcttccattctgttgagttgcttctaatgtttggcacattgtgggaacccagtggatgtttgatgattggatgaatgaatgaatgagtgactattaggccaaatgataaaggagagttgggggctaatctgctgtgtggttaaaagaactacttaactcttctagacctaaatttctttacccataaaattaggaggtcatactcaaaaacagtgaaagtttgtgcttagctccaatattctatgatctccatgacttagttcacaaaaaagcatgaccagtcacgagaattgtatggtgtagaatcagttcatggcccatacaccttcattgcggactgaccgcaacttggcttccagtttactaaatagactcctaaatcacagaagtttgaatgtaaaattgtcttccaaggagagaggtacatattcccatgagaaatcttaagcttaacactcccactgatattttttatcaaatatttctactattgacataaatttacctttatgcttatgtttatatttatatacatgtaaaattgtgatatatacttttgaaaactcgtctaagcttaaaagagccttttgaagtatagaattaaaagcttttttaaaaaaaacaaatttatttctgtaggtttttgggtaacaggtagtatttggttgcatgagtaagttctttagtggtgatttatgagattttggtgcacccatcacccaagaagtatacactgaatccaatttgtcatcttttatccctcacccccttcccaccctttcaccctgagtccccaaagtccttgtatcattcttctgcctttgcatcctcatagcttagctcccacttatgagtgagaatatacaatatttggttttccattcctgagttacttcacttagaataatagtcttcagtcccatccaggttgctgcaaatgccattaattcatttctttttatggctgagtagtattccatcatatatgtttgtgtgtgtgtgtgtgtgtgtgtgtgtgtgtgtgtatgtgtgtgtgtgtgtgtgtgtgtgtgtgtatgagaaacagtttatttatccattcattgactgatgggcatttaggttgcttccacatttttgcaatggtgaattgtgctgctataaacacatgtgtgcaagtatctttttcgtataatgacttcttttcctctgggtagatatccatttgtgggactgctggatcaagtggtagttctacttttagttctttaaggaatctccacgctgttttccatagtggttgtactagttcgcattcccaccagcagtgtagaagtgttcccctttcaccacattcacaccaacatatattattttttgattttttgattatgggcattcttgtgggaataaggtagtattgcattttggttttgatttgcatttccctgatcattagggatgctgagcattttttcatatgtttgttggccttttgtatatcttattttgaggattttctattcatagccttagcccactttttgatgggattgttttttcttgttaattcatttgagtttgttgtagattctggatattagtcctttgtcagatagatagactgtgaagattttctcccactctgtgggttgtctgtttgaaataaattgacttttaagagggttgagtgatgttcagactatcagagtattcctggggaagtgggtgtaagtgtggcagtctaatgactgaacccaggtctgtttctaaatatacctttgccttttcttgtagatggaagcccttacacttggtgggttggcaaagccaacgagaagcactactactggggaggctctgggcctggaatccagaaatgtgcctgcggcatcgaacgcaactgcacagatcccaagtactactgtaactgcgacgcggactacaagcaatggtgagtgcctgcgggcagcacagccaggctcaccctcccagtgtgcctttgtgtcaaactcatgtgatagaagaaagtttgaaaagtgctataataatacgataatagggtagaaaggtctggaactaacccaactgacaaatgtcaggaacatactgaaaaatataaaagcagaaagaggtcagtgcgacaagggtatgcatttagaaactgagacataattgatgtgttcatattttattcagagaggaaaataatgagccatgttgtagacagtgatttgcattataaaatgtgctgtgtaacaatagagggatggctgggggcgggaagccagtgtgcatgagtgcaggcagtcaacagcctcctgcggggagcacaaccacctcctgcaatgtttgcgttggggatctggattggaaaaataggagagagagagagagaagggaaaaaacaaagaaacagaaaaaatcattctttgctcttgtcttctgtaagtgcttgcctgtctacttttctttcatacctggaattgtttataactctgatacaaatcagttcaagaaagatctattttgggtttcttcgatccctttgctggcttttgttctgccccgcagtgaatagctgggtctgtgtcagtaacagataaagataagatcagctgccattctttgtgaaaaaggccccagaagtttaggtggaagactataaacctaagtgtgattctttgcagaagcacatatccagtgccggctttctacatttttagaagtgttgagaggctccatttctgcttctgggcagctgtgcacatagccagtcatggtcatgaatttccccatatgcccagccatggttttcttcagttcacctatgtagtatgctatttacagggacagtttacaagacaaattcattccaccagttaaccaaaaacaaattctgagaacgtaactttatatgaatttcaggtaggatgtctgcttactttctgaaagttatatttcttctagtaaatataacaaattacaaagcctatctatttcaatggcttagaatgtgtgtgtatatgtgtgtaaaatacttgtaaatagctatcattaatctttaattatggattattgtaaagaagagatcatgataatttttaattttatttctttgaaagatgtatctacacacacacacacacacacacacacacactgtatacaaagattggaagttgggaatggagttaaaagggcatggtctttgaaattaaccttttattcattcgttcaatcattcattcagtgaatcatccaatcagtcattcattcaacaaatattgatcaaatacttatgagtcagcaactcttctaggcactggggataaaataccaaatgcaaagaacaagaatccctgtcctgactcacattcttgttcttgatgccttttattactagttgtgtgttcttaagccaggcagaccttctcccatccatttgtctatccaacattaattccctacctcttcaggaagctgacattgggttcagcctccccaactaggagaagtgggaacagagccccagctggttcattgtccaggcagcccagagtgccctgccaccatcaccttgtcccaccacagaggagagaagagggattcagaaagagtaagatctagtacctgcacctaagtgaacttcatttttatcagacatcatgctaagttctagggatacagtgatgaatggaacatggtatttgtcctcaggagctccaaaactagttgaaggaaacacacatgtgcacacacaaatagataacataatacagtcagtgttgtgaggaaggtgtgtgcaagatacaacaaaaactaatgaaagtggcggggcgtagtggctcacgcctataatcccagcactttgggaggccgaggccagcagatcacctgaggtcaggagttcgagaccagcctgcccaacaaggcaaaaccccgtctctactaaacatagaaaaaattagccgggcatggtggtgggtgcctgtaattgcagatactcgggaggctgaggcaggagaatcgcttgaacccaggaggcggagcttgcagtgagccaagatcccagatcgtgccactgcactccagcctgggtaacaagagtgaaactccatctcaaaaaacaaacaaacaaacaaacaaaaaaaaactgatggaagaaattttcaatctaactggaggagtgaaggaaggaatccataacgtcttggaggaagaggcataaacttgaaagacaaggaaaagcaagggccctgggacactcgcccttgcatggtggtcttggagaagaagcatgacggagctgggccaggctggggaactgtctgtgcagttgacagttttgaaaacattaaggccctagcatgacatctgtgtctaaaccctgagggctaccattagtagaattacaggttgaaaacatagattttttttttgagatggggtctcactctgtcacccaggatggagtacagtggcaaaacctcggcccactgaaacctctgcctccccggttcaagcaattctcctgcctctgctggcacctgccaccatgcccagctaatttttgtatttttagtacagacggggtttcaccatgttgaccagactggtcttgaactcctgacctcaagtgatccaccctcagcctcccacagtgctaggattacaaccatgagccaccatgcctggccaagatagatctttattttttttattttttatttttttttttgagacaaggtcttgctctgttgcctgggctggagtgcagtggcgcaatctcagtgattctcctgcttcagcctcccaagtagctgggactacaggtgcccaccaccatgcccagctaatttttgtatttttagtagagttgtgatttcaccatgttggccaggctggtcttgaactcctgacatcaagtgatctacctgcctcggcctcccaaagtgctgggattataggcgtgagccacggcgcccagtcacaagattgatttttaaagatatatattagcctctgaagccatttcaaagaacatgtctgaattcagatcacagattagaagacattccattccacccttattcccagacctcctcctctggcaagcttcaattgagttctaacatttcacagttactcagggacttggtcactgctggtgtcttgttctcttctggcttagcagcagctaagacatcccactcctttgcttccgtaaagtttgtctaatatttcataataaaggcactatagcttgagcaaactgaaaagtataatgaatatttttttttttaagagacggagtcttgctctgtcacccaggctggagtgcagtggcatgatctcagctcactgcaagctctgcctcccgggttcacaccattttcctgcctcagcctcccgagtagctgggactacaggcgcccaccaccacgcctggcttattttttgtatttttagtagagacggggtttcaccatgttagccaggatagtctcgatctcctgacctcgtgatctgcccacctcggcctcccaaagtgctgggattacaggcttgagccatcgcgcccagccatgaatgttttttataataaatagctcttaaaatggtcttccctttttagcacaagaaagaatgctcttggagaaatcttcttggtctttgaattcaccagcacctagcaaaggccctccttcctatgtggatgctttagatatttgggagtggatggggttgcttctagagacactttctaaagctctcaggggcagtgaagagaaagttgagcttgatgcgggtagaccttacatccaggcccagatttgccacttttgggggaggcttttaacctctctgaaatttaatttattatctgtataataaaaataaatcttggcaaatttttgtgatcattaagaatatagaatataaaagccttctataaattatactatatgggatagttatttgcaattctattgcattattttaaaatttattttctttatttatttattttgacacagagtcactctgtcaaccaggctgaggtacagtagtgtgatctaggctcaccgcaacctctgcccccagtctcatggctcagcctcccaagtagctgggattacaggcacgcatcaccatgcctagctaatttttttttttttgtatttttagtagagatggggtttcaccaggctggccttgaactcctgacctcaagtgatccatccacctcagcctcccaaagtgttaggattacaggcatgagccaccacaactggcccttatcacaattcttaatgattccaattgactcttaaatgaaaataaatgaaaacagagcgtggcaagtaggccccttcatgctcttgacctgctgtgtcgtaggcctcaagtctaattccacaacgccacatgcagatgttatgaaacaggctttactagagaaagttataaatcagggatcatcatcagaagagcaagtacaggtctccaatcccatcatccctcagggagacgtgcgaaagccaggctattccgctgaatgcaccaagggcattcgttaccaggaagcccctgcttctctcacttctcacaaagcaaaaatgacagcaactttgtcagtaggggaaaatcagatgcatggggcaccaggcagtctgggcataggtgcctgctgtttacaagtgttgtctgggagtcagagcccctccaggaacagggaggaagccagagccccttcttgaagctgactttgggtgtagtctctctaactaggagaagtgaggaacactgtccaggcaacctggagtgcactgtcacgatcattgctgttcagtttttttgtttctccaaacacagagaagggctgggagattatgggaaataaaaatgtagcacatacatccaaatgaaactcacatatgttaaaccacgtttgttgtaatgtcagggtaaaaataaaggttctattaaatctcatgcttttagatgctttgtccagttaagaaagctattttcaataatctgaatcacaaagcatcattggattaagatgaactaagaccaaaatgaggacaaagtacccgtgccacttcctttctgtgtgatctaagtcaggatatttcacatctttgttttcttatcagcaaaatagaaatagatagtatagtacttcccaagtcatgtaaggatcttggtaaattgctgtcataaatgaaagtttaaaattacagtgtgatatattatttttattattatttgaatgttgaatggaaccttagctaaaaattattttaaaatgtcttaaattacagatgcataaattggggccctgaaaaatgtaaattactttcaaaaaattacagtagaaatgaggagtagaaagaagaccaaagacacacatctccaaacacccaggccagtgttcttccacaatatcaggatcaaggaagtttttttaatattgtttttatctatctttttaatgatttcagaatgtaatttttaactagcttatatgtaagctttaaatttaaagcttaaaccacagaccacattatatgttctttttctaagaactctaaaacttagattgaatacttattcttatttactggtgtaaaatgcataaaaatggagccaggataaatgagattgcagctcagagcatgattgggtctcacaacgaagctgcaatggcctgtgagtacgatcaccatttcaataattgcctgattatctatgctgggagaagttttgcgcagttatttctgagattgaatgtaatttaacatttatgatttactattcacagcaatagtaaatattcccacctacagtgccagaattctaattacacgagtcttggtctcagctaagtggccactgctgggtaattcctggtctcttgcagcctgactcaatgagctaaatcaccatatctgaaattagcaattcgaaaatgaaattatcagggaaagaattgccattcattgcgtgagtacccttctcttattgtagaatttctggatagttatgtcctggccaagatgggcacatacatggtggaaaataagtgaagtgaaaagccgttagcacagtctttgtgttacaattagtcagcagttcccacctcaacattagaaaggccaaatactagccgttgtgctctctttcgctgaccctaaatggaattggcttgtctaacagcctttttcttcctgggccaaaaataatccatgaccaacttttatagcagctgaggggagttaactaaaaaatatcttcgatatttcaaagccagaaacatatttatttggttgggtcagcttactatccaacacctaattctgaatatttttaaaaataatcgttataattttttgtccttgtttataagaaatttgattgaatcttagtgacttttttcatgaagttttagactgcctcttactcaaagtgaaatatttatatatgcattctcattcgtcatgttgtttaaataatagtagttacatgtcagccactgttcatgtatgtttcatatactgtgtcatttaaacatctcattgactctatgccaaaggtactacatattttgtctttattttagaaatgctccagagagattaatttctcccacaaggtcatatagttaaaaagcagtagagcagagattcaaactcggggcaagcaactttagactcatccttaggaattacacaccaagactgtattagcctgttctcatgctgctagtgaagagacacccgagactgggtaatttataaaggaaagaagcttattggactcacagttccacatggatggggaggcctcacaatcatggcagaaggcagagggaaaagtaaagccacgtcttacatggctgcaggcaagagaacttgtgcaggagaactcccatttataaaaccatcagatctcatgagacttagtccctaccaggagaacagtatgggggataccacccccatgattcaattatctccacctggtcccgcccttaacatgtggggattattacacctctgggtgagatttgggtgggaacacagccaaaccatatcaaagatgtaagttctgtataaatttttcacctgtgtactatatacagcacaatttcattttttttccaatttttattatggtaaatacacataaaatgaactatcttaaccatttttacttttacaattcaatggtattaaatgcattcattttgttgtgcaatcatcaccatcatccatctccagagccgtttttatctagcaaaactgaaacgctatacccattgaacagtaattccccatttccctctcctcctagcccctggccagttaaccttaaataatgagttcagaaaatgtgattaaatatagagtttattccagctcaaagcctgaggatagccaccagggaaacaccaactccaagtgaatggggtcagctttccaaagtgggaaagttaaggtttcacttacataggcagaaatagagaaggttaacagggttgcaacatttgccatataaggccagcacagatgttacggtcatttgattggttacagtttgctatgttccaaggaagattgctttaacattccataaggaggggtaatggtctcgaggggtcttatttctggaaccatttggtcttttctaatcatttacaggacagaaatgaggaagagatttaatctataatcagagaagcagaagttgcagctgcacgtggcataactcaggccacataaccacatttctctcaaggctcaaaataatgtaaagttccaaccattttaagtttgaattatttgatttcacaccaccatcgttctattttctgtctctgtgattttgactgctctaagaacctcatgtgagtgaatcatatagtatttgtctttttgcagttggcatatttcacttagtataatgtccttaagttttgcctattttgtagcatgtatcaggattttccccctttttaagatggaataatattccattgtgtgggtagaatacattttgcttcttcattcatttgccaagggacacttttatttccacattttagtgactgtgaataacgctgctacgagcacggtggtacaatttctttttaacgtctacttttactcacctctgtagtgctcctgatttggtttctaaaaatctcttattttaattttatattaaaagtattcattatgacaaatacattcaaattattttctgaatgtgacctgatttcaaatcctagtcctattgcttgctagttcagtgaccttcagcaagttataaaagctgtcaatgactgtttccttaaccacagcatttaaatggcactcacagctacctcacatggtagaaagggagtttaaatgagaggatactcataagggagaaggcacatccatatttcactagtaaatgctcaagaaatattgattccaattacacccaagcacacacagataagggttagctcatgggttccccaggagcagcctcttcagtattcaaaaacaactcattgggcccctctgttctgacctccttgcctgcatgccttgctgccaccctgctgctgacactgccctcctgagatccttactctgccagctgcagctgtctcagcctgtgacagtcactgatgcccttatggagagatggagagggccccctactcaacctcagtgcagtggaaacgaagctatggctttcagcaagacttgacaaggattggagctaacagaaattttacactgagagaaacttgcaactgcttcctgaaatagccactcttcaaatccaggcaggagcccagcccctgagaccctgccaagctcccagcgaagcctcctatgggtctcaaccctgctttcattaatgaggctcctcaggcatttggatccaagccaaacctcctccaagccccagaggaagaagaagttcttcttcatcccaagccctacctcagttcctacaggaggaacatttgcttctcaggctgattgatagtgcaataattaaatcccttaaggaggaaattcccagcttaagccacaaaggtgtgcgtcaatcacctggcctgaacgggagcatcgctgtggtctgttctgggacctgggtttgttgagtgcatttctccaagctaagattccagtcttcagggacgcctcctgtaggacaacagtctaatgcaatgtgtgcagtgacaatatcagtcaagttttatttcatgatgtctcctcataaagagaagagaaggtaaagtcagcaagctcctccttctatgatttcatgggagaaaaagccaagacaaaaatgtaacacatgtccaaaggataaaaaggagcttccagggataagccagtttaaatccagatttattgggggaggaaggagcatctctcatactgctggcacaaggtcctgctaaatttacagtattcaacagaaaaatcacttcgcaaggaatattccattttaattcctgcccccaaattcaggagcaatatggaagtacttgccaggcatgtccacagatgaaaagccacaaaagtgatctctcaggaaatagagattttaccctcagtgacaacactggaaatcactttataaccactgcttccattccacctgctcccaccttagacaaacaaacacaaatggtttttacagcttcagatttttagggcccaacaacaggcagttcaatgaaggaaagataaagaaacatggacaatggatatttaaaaagaatttctgtttcataggttttaaaaaaggtttctaacatcagtctggaaaacagaaaccttaatacgagacagaaggtactgcacgatggcagctaggagcctggctatagagtcagaccatctacgtttatgttcctcctccaacactcagccagttagtaagacctgcctgtgcctcagttttctcttatctacagtggagatgaaaagagcgtgtctccagagatgatgtgagaatcaggggacccaagcaagctgagcatcattctttgtcctgtcagtggcaatgggactggaaacataacctttagtacaactgggtaggaatgtatgactgaggttacttttttgagggctatttgggaattgccatcaaaacttgaacactacattctttgactgaatccttcaccatatggcatgtaccatcttaaaaaaaatatatgttctaaggtggcatataccattttttgtagcagtcaaaaaaaaaaaataacctgtagacagcagaaatgtccatgaatagagtttcagaaaatgatgttataaggctggccaaggaatgaagtagatacataaacacttgcacagaaagatggccaagatgaaagtgaaaaaagcaagttgacaaatagcaggtataatacgagtctggtgtttcttttttaaaaaaaaaattatttaggctggtcgtggtggctcacgcctgtgatcccagcattttgggaggccaaggtgggcagatcacctgaggtcaggggtttgagactagcctggccaacatggtgaaaccctatgtctactaaaaatacaaaattagtcaggcatagtggcacatacctgtaatcccagccactcgggaggctgagacaggagaatcacttgaacccaggaggcagaggttgcagtgagccaagatcgcatcactgcattccagcttgggtgacaagagcgaaactccatctaaccaaaaaaaaaaaaaaagaaagaaaaaaaattatttttgagaagggtctcactgtgttgccccagctgaaatacagtgacatgatcttggctcactgcaacctcgacctccccaggctcaggtgatcctcccacttcagctgggactataggcacaaaccaccacatctagctaattttttgtattttttgtagagatgggggtcttgccattttgcccaggctggtctcgaattcctgggctcaagcaatctgcctgccttggcctcccaaaatactgggattacagttgtgagccactgtgcccagcctggcatttctctaatgtgtataatccataacctttatacatgcatacataatttctagaaaatctacaaaagaaacaattacaacgcaatagattaaggatgtaggactttatggaggacctggcttgtcccattgtacatcttataagctctttgaattttttgccatgaacacatttaacctgatcaatttaagtatttaaaaatagtttagaaattaaaataaaaaataagaatcctagccagcatcccagtacataataaaacaatactaaattcttattttaagaaaaatcagatcaaagactaattttcacatcatcaacaacaaaaccaaacaaagcatcttactggctctcctggccccaatattggaaggaatttctcagcaagctggaggattcctccgctcagcgggcgccgtgaaactgagaatattcataccattagccctgtaaccacatgcaaaacaaaatagttttttcattgatctgagttctgtggaactcatgtttgtgctcttaaatcttttggaatccttctggggaacaatcacttgacatcccaatactcagtggtcttattcgtgcatattataggaatatgatattatgaggagtactggtatcagttatgacaccagttgctaaactgaccagaaagattgttgatattcaaataaatgtgtgtgcatgtgcttgtctgtgtgtgtgtgtataaaataaaatgttaaaatggacagctatcaatatattttctttctagatacataaacggagatgccctcctgatctcatgaaggccattttcattaagttaagctttgttcattttcattcagttaagctttgtttaaaaaaaaaaaaaaaagatattgctttaccagtgatctgggtggcgggcgggggtgaagaagaagaaaaaaaaggaaactcttaattttagtcctatttagccccaaagcatgtgtttcagtattagagcatggccagagcagttttcaaaagggttacaccatcccgtgtacgttactccttatactgactccactgtggtttacttggcagatttgagctatgctgaagttgcctcttaacaggagattcctagagcgtctaacagctcaactcttttaggagcttaactactttttaatatgtgggtcagggttaagagcctcaggcaagggcttctgccctctttcgttaggaatttaccttggggatgaactaaaaaacttcaggaggctcatccaggcaggttccagatagctcaaattgcaaagctacctggaaagccactgtgtttctgcagccctgtgagtgaaacacctgttattggcaatggggaaggggaaatgtcctgtctctcccagttccccaaagaagcataaaaatgatgtattatatactgtctcagggacattttggtgccaacccacttggcacagcatagaatcctcctgtcacctcatggattgtatcatgacagaagggtaattgggcaccggagaagatgtcagcagagtgtcaatacggtttggccactgcccccaaataatattgatgacagcaaagagagcgattaatcaggtgtgatcctgtcaaatgttcagagtgtgctgtgggtactagaaatagatatagcctaccaacaaaatgttaaatggacttaaacaaaatagattatttagtcattttgagaaaagcagaactaagattcaaaagagctttttttctgaaaaaaaaaaaaaaaaatacagtgtatttcccattagtatttctctccacttgcttgaaaaagagggagagctgttatgttttctgaaaaaaaaaaaaatgcattctgcccaaaaaatcaatcatggaaaaaaaaagatcaaattaaaagagatgtcatgggatctaaagaaaagtgcagacgcagcaattgtaaaacacgttataattgtggacctatctgtttatttattctgtgtcccactgaaagttcaccctcacaccctccctaccaggccagccatctcctcccattaccccctcttgatattaatgatgctcgctcacttgtagtttcccacgtgtaaaaccccattgccttatgtattatcagttgttcaccattttccatacatggattctgtctcccctgggcctttcacagacacctgaccatctgtgaccatggcctttctcctagttctaaatctaagcaatggtattgcaacaatcttccaaaataacttccagccttaaaactctcttatcctacaactctgtctataactgtggccatcactggcttcacattagaatcacctggaaaacttaaactattacttatcattaggccctgcctcagactaattaaatcaaagtctctggagattatttttggccatctttgattttgcaatttcctgaggtttctaatgtgtagccaaggttaaaaaccattgatatagggctaggttaagctgcatataacagaaaaataactaaacaagagtgcttaaacaagatgaaagttagttcccatgcatgtaaaggaagtccaggctccttccagctctctgttctggtgttattcagatttgacatcctcctcaggatccaacatggcttctagagctccagccattatgcttccattccaggcagaaggtagaaaagagaggaaagagagcatgccttttccttccaagaatgactttacataccacttccatttacgtatcattggctggaactttagttaaccacgactagcagcaaagatggctgggttctgtagcctttaactgggcatgaatatgccttcctaaaaatgagcattctgttaccaaggaagaagaggaaaatgagcattaaggggcaactaagagcctctgtcggaagtgttaattcttcaaaggggccctgctagtctcctgttcacacctacagtaggtccctgtgatctccagaataaagtccagactcctgcagttctggagtccctcctcaccttgcattctctgctttacctcactcacactggggccattgtaaggatatttgtattttctcatcgctggtcctttacctacacctaaaataactcttcacatatctgcgttttcaacatcatctacttctgcagaaccagcgccagtgctgcttcccaaggaaacctccctgcctttgcccacacccctcatgtctagcaaaagtccatgcataaaaggcctgcttcctgagggtctcaaagcaaattacacttattttaaagttattttctctcttatctgcaattagatgcctgggtatctgagttctctctcaaattacaagcttcaggaggtcaagcaccatacctcatgtgtattataagtcattcatgcctgtcacttagcagctagtcaacatctatttgcaatgtaagccaaatgtgtagcactttagagaatccggttttttgtatgtatttataaactttctttttgcattgagtcataaacccacatagacatacactcatctctgctttaggctttgtagatggttttagttcacatagcaaaaattggaaagttactttatattcaatagtgaggtaaatcatccaagtcagtttttaaaaagataatgggtgtgtactaatatgtatgtccatactcacatagacactgacacgtgtatacaagtatattacatgcacatcctacattactaaatgtgatgtataatgactttattaatttttttggaagcatgctagttgtcttaggctaatttaatgcccggtattaaggtgaaatcaattactaccttttttcatcaggactagaggaggaaaaaaacaaacagaaaaactacccttatgcaggaggaataattctaaagacagaaatacaggatgtttggaaatgaccatctgtgacgatatttacctgcttgtccctgtcagccctgggaatggtgtgtctttaccttaggttactatattaggcagaataatggcccccaagatgttcacattctaattcccagaacctgtgaaggtcctacttcatgtggcagaagggactttgcagatgtagttcaaggtacagactttgagatggagagattatcctggactatcagtgggtgcccagtcaaagcacatgacttcttaaaagtgagaaaagaccctttcctggctgtgatcagaaagaaatgtgatgacagtagtaggctcagagagatgctatattgctggctttgaaggtggaggaagaaatccatgaactaagacataaaggcatcctatagaggctgaaagagacaaggaaattgactctcacagaggctccagaaaggaacacagccctgacacaccttgatcttaatacagccagacccatggtctgaattctaatctacagaaccataagataatatgtttgtcaggttttgtttttgttttgagacaggtctcactgtgtcacccaagctagagtgcagtggcgcgatcacaactcactgcagcctcaacctccctgggctcagatgatcctcccacgtcagcctcctgagttgccaggactatacgcatgtgccaccatgtctggctactttttctttctttttttttttttttttgagacagagtcttgctctgtctcccaggctggagtgcagtggcgcaatctctgctcactgcaagctccgtcccctgggttcatgccattctcttgcctcagcctcccaagtagctgggactacaggcagccgccaccacgcctggctaattttttgtatttttagtagagatggggtttcacagtgttcactaggatggtctcgatctcctgaactcgtgatccgcccgcctcggcctcccaaagtgctgggattacaggcgtgagccaccacgcccagcctacattttctattttttgtgtttttctccgcgttgctcaggccagtctggaactcctgggctcaagtgattcacccaccttagcctcctaaagtgctgggattataggcatgagccaccgtgcccggccacatttctgttgttttaagctacttcattggtgttaatttgctaggcagcaataaaaaattaagtttccttcctacggtggtgatgtcatcaaaaagaccccgtaaagctttattttttcctctcacattggtatagagtgaaagttcactggtaaaatagctttgcagaaaccttaaaaagtatgccttggccgggcgcggtggctcatgcctgtaatcccagcactttgggaggccgaggcgggcagatcaccaggtcaggggttagagaccagcctgaacaacatggtaaaacccgtctctactaaaaatacaaaaattagctgggcgtggtggcacatgcctgtaatcccagccactcaggagactgaggcaggagaatcacttgaacctgggaagtggaggttgcagtgagccgagatggcaccactgtactccaacctgggtgacagagggagactccgtctcaaaaaaaaaaaaaaaaaaaaagcatgtctctgaaagtgattttgtggctaacaccctgtttccctgcctgtccatcacttgctgatgctgagagcttccagcctacgaagaggatgtgcagggccttcgttcactgataaccagctctaccagtgaaggactggttgtctgtgcctacctgtgatcaggtctccttcaagtagatgattatatagcagttggcaggaattttttaaaactcagaaacattcatttatacatccaatcattcagctcatgtctgagtccctgctatatatcaggcacagtcagactatctggcagtccttggaaacacagggtgggtgggtagttttaagtcatatgcctcctgctgaaagacagatttaagaatgtgtcttcacaatccctacaccactgcaatttcacgtatgtgcttctgctcctgtcttttttttttttttttttttttgagatggagtctcactctgtcacctaggctggagtgcggtggcgtgatctcagctcactgcaagctctgcctcccgggttcaagcaattctcctgcctcagcctcccaagtagctgggactacaggcacccgccaccacgcccagctaattttttgtatttttagtagagatggggtttcaccatgttagccaggatggtctccatctcctgaccttgtgatctgcccacctcggcctcccaaagtgctgagattacaggtgtgagccaccacgccctgcctccttttttttttttgtttaacaggcagagaaatgattagataatgaagacgttatttattttttattttcataataatgaattaaagaggatcttatggacattctgagctttcccattgtaacagcctcatttatggcagacgccatttgcctgctgtccacaccgtacttaatttggcctcaatctgtatctttggtgtattaatctcctcatgatccagataacctcttctccattaacaatggggttttatagctaggacagtgcctggaaagttataagcattattattttctattattattatttaggagatgttttgggcagcttactacattgcacagaagctatctcatttcctagggactttgatgcaatagtcaattgtaaaatagacttttccaaagtcattcatttcatccattcctttaaacacctaatttttgagttcctgttatgcacaaggtagtctgctaagactaatgacaatgataggtgaatgccacccctgctattatcatctttagggctttgagaagttacttgacttttctcacttcagtttcttcatctttaaaatgagaatagtaatattactgaccttgtgaagatccccatgtttatgcaatatgggtattgttttatcaggcctttgtatttcagaagtttataagcctcatgaacaggagcaggggaccaactagacaaggaaagaggcagatctattcaacaaacatgtgttgagtacttactatgcacaaaggcaggatatcaatatggggggtaggaattcaatggtgagtaacgctgagacatgtggtgggattttagagcacacattttgcaaatcaaagagaacttgtgaatccctgtaacagccctagtgaaaattgttaagaatgattctggcaagtcccatattagccatatacaaattatccccattatagacttcccatagtgtatatctctagtataaaaagcattacaataatcacatttaatccttgttacattttaaatacgcatgtcgatgcaaattacaaatatcgaaaggaaaatgaagacagaaggaaaataaatcaagaaattcatttagagaaagaaaaatcacaatataaaacagccaatctttcttgttaagagcagccctcacatttctaaatgtatgaattggttttgtgttgactgtgccccaaccctgcttatagtatgtcaatattgggagaaatccatcactgacactaacatggcagccctctgaggagtcaagccaggggcatctagaggggcaatgcccaggcttcactccccctccttttgaaaggctcaggttgccttatagtcttccataaaaatactgagggcttttccaggactgctcactgtgtgataggaacttacatctatagggcatgtggtaacatgcaactgaaagcttagatttttttctagtgatgggtcacattctacactaggtccatcttgccattggtgccctgaagtgctttgtctaggccaactgatgcagtccacagagtctaaagaccactcaaactactcataacgtttcttgtggctgcccatccattccagttctaggagtagtttagaccatgttcatctctattaattatctcaagtctttatgcagaaacagcaacaaaaataggctatagaggtatgagaagtggttttgaattgttagtaaagagaggatgcaaaaatcagtttgtttgttgtcatttatttcaagctcaatattagatgccaatgttagggactatcaacatacaaagaacattttttaaaaacactcttaatgacaccttagtcaagtgtccaggttataggagtttccagcaagcatcagctagaccacacctgaagaattataaatagtactaaaaaaccaaaacatggaaaatgaggtcaggaatttgataagtgtccaatataatgataatgagcaaaaaggaaggaaggaagggaggggagggaaggggaggggagatgagaccactgtccatgcaataatccctttcccagtgttaacagttgaattgtgtccccacaaaagatatattgtgaacgtgacatgtttttgacatagagtctttacagatgtactcaggttaagatgaagtcattattaggtgggccctaattcattattactgttatcctcatgagaagaggaaagacacagggacagacacacatggagaggagaatgccatgtgaagacccagactcaaggagaacaccacgttgggagggaggcagagatttaagtgatgtgtctaccttccaaagcatgcccagggttgcctgcaacaccagaagctaagagaaaggcctggagcagattttcccctaggcccttctctccgtttaaatttatttttaaaaattttttagaggtggcatctcggtctgtcacccaggctgaaatgcagtggtataatcacagctcactgcagcctcaattgccagggctccagcaatcttcttgcctcagcctccgaagtagctaggattataggcatgcaccaccatgcccagctaattaaaaaaaaaaaaaaaatttctagagattttcctttgtaggaattttctgtgttgcccaggctggtctcaaagtcctaggctcaagtgattcttctaccttggtctcccaaaatactgggattacaggtatgagccaccatgcgtagcctcctagagccttcagaaaaaaacgtagtctgcaaacaccttgatttcagacttctagcctccagaactgtgagaaaataaatctctgttgttggaagccacccagtttgtggcattttgtcatggcagtcataggaaatttaatgcattcagcaatgctgccagagatggccattcccctctgccagcacattcctaatgtggtgccagtctcctaagccagtctgatgatgttggacagctccaggcatttgctgagggcttcccaaatgctgggcaccactctaagcacttttttcttttcttttcttttctttttttttttttgagacagagtttcactcttgttgcccaggctggagtgcaatggcacgatcgcagctcacccaacctctgcctcctgggctcaagtgattctcttccctcagcctcccgagtagctgggattacaggcatgtaccacaatgcccggctaatttttgtatttttagtagagacagggtttctccatgttggtcaggctggtctcgaactcctgacctcaggtgattcgcctgccttggcttcccaaaatgctgggattgcaggtgtcagccaccatgcaagcccacactaagcactttatctgcatttccttatgtaatcttcacaaaaacctataaaataggtacaattacttttccaactctgtaaataaagaaaccgaggcttagagaggataattaacctgcacaagaccacaccattcataaggagtgaacgggaggcaatctgatgctgcagccatgatactccacctcctgtagagaaaaggggaatgagtgtgatggttaagagaactgaaagtaagccgggaagatggaacagagaaggaggcatggagaaaggtgaaagatgtaagcccagtcttagactgtccttgtgcagagtatgagagccaagctgtacatagagtagacagagggagagtcatccacacctctcaagtcagaaagaaagagaatgtggcaaggtgtggtggcgcacacctgtaatcccagcactttgggaggcctaggcgggcggatcatgaggtcaggagatcaagaccatcctggctaacacgatgaaatcccgtctctacaaaaaatacaaaaaaatttagccaggcttagaggcacgagcctgtagtcccagctactcaggaggctgaggcaggagaattgtttgaatctgggaggcagaggttgcagtgagccaagatcatgccacggcactgcagcctgggcgacagagcgagactccatcagaaagagagaaagagagaagagagagagagagagagagaaggaaggaaggaaggaaggaaggaaggaaggaaggaaggaaggaaggaaggaaagaaggagcagttttaggttcacagcaaagtaccccctaccccctacacatataatgcagacaaacacacacaagcgcgcgcgcacacacacacacacacacacacacacacacacacacacagctttcccccatgatcattcaacacagggtagtatatttgttatactcatgaacctacattgacacattatcatccaaagtccatcatttacattgggtttacacttgctgttgtacattctgtggattttttattttttaattttttttttgagacggagtctcgctctgtcgcccaggttgaagtgcagtggcgtgatcttggctcactgcaagctctgcctcccaggttcatgccattctcttgcctcagcctcccgagtagctgggactacaggcgcccgccactcggctaattttttgtatttttagtagagttggggtttcaccatgttagccaggatagtctcgatctcctgacctcgtgatccacccgcctcggcctcccaaagtgctgggattacaggcgtgagccaccacgcccggccattctgtggattttaacaaatgtataatgaaatgcagctatcattagagcatcacacaaaatagtttcactgctgaaaactattctctgtattccctccattcaatcctcccctcccctcaactcctggcaacaactgatcttcttactgttttcatagttttactttgtccagaatgtcctatagttgaaatcataaaggatatagccctttcaggttgagctaattttattttagtgataaaaaatgttaaatagtatgtagaagaatttagggatgctgacactgtgaaaacaaatatatttaattacgctctacttggagtttgtttaaatcagatgtaaatgatatttgagctgattataccttcttcaaatggagtcttatttgaaagtctagtatgaagagatattaaaatggagcatgtctgggcaaagggaaaaagagattaggagttccaacaactccacacctctccccacgcctcatcctccatgatggaccttggagacttacatgaagcctccagtgcttcatgaaacacagcattaaaaccagatttcagagattaggactttaaaaatttagtgaatttataatagaagtatgatgaaaatgtccttttcttccataataaaatgggaaggtacattctataaaactgtcaaagtttacctgatgtttgatttatgcttttaataccttcacatacactttcttgagtttgttcaatactaatagtcaaaattcaaagaaaattaaagtcaacatctttttacttgttgaacacattaagtcactgtgatctacatgtaattccatcctctccaaattaaaattaaaattaaagttggattgactggtatacagattacagttcatgaagtctcgttatataacctttgaaccaaagtttatcttataaacacgtaagataaatgtcaaacgggaaagtaaaaaagattttataaaggaaaatagaagaactgaaggcacaggataaatctacatgaaaaaaacaaagagcgtttttaaacacttcttcatgtgaattcaggtgataatacaatggagttattttactcttaagacagattgacatatttaaacatagttctgatgatgtggagatgtctacagaatatatttcctctctaatttaaattatttataattgcatagttagttacaaagaataaaatcaaattaattactaataaatgccagagaaacatgtttaaattgacattcacttccaaagtcagctcctgcataatcaccacaaatttttaatatttgctacaatatgacaataaaacaattgcgtatattacagagtagaagaaactccttcaaagataaatatgcatttattctatttagttgtagaatgataaagataatttttttagaatggtctaaggataactttttcaagaaaaaagatgaaaaatgttctgttcccccaaactatcataagcctgccagccacacctctgccttatcatattcaacctgagtagatgacagtcgccacttatgccatattgagaaaaactctgatggtctgattagattcattgaaatactttcagtattagtagctaaatagggttctttttaaagtttaatttaacctaagagttgtaaaaatgaaataaatattattttaaatattgtagaataagtcaaacacttttagtttcaaatggattgtcaagataactgatgtactccgtaaatatatacatctactatgtgttcacaaaaatttttttaaaaagaattggtaggcataggctagtaaattgaccaatatcttcatttgcttaaaataaatttctaaaaccaagttgttccttgagacatatgcaatatcttcagaatttcatgccataagattaactatacttgatcaataaactttgaaattttaaaataaatacagaaaagttctttctcaattcagaaataactactgatattccctgggtgacttttttctcagacaagttagaaaaccaccaatttgactagattgggaaattccttaaaaggaaattagtgcaatggccgagaccttgactctgggatctcctaagttagagtcccaggactacctaccgattatcaattaaatatgcagtcttggtgatatggtttggctgtgtccccactcaaatctcatcttgaattgtagcttccataattcccacatgtggtgggagggacctggtgggagatcattgaattatggggcagtttttcccatactgtcctcatggcagtgaataagtttcacaagatctgatggttttataagtggtttccccttttgcttggctctcattctatcttgcctgccaccatgtaagatgtgcctttcaccttccaccgtgattgtgaggcctccctagccatgtgaaactgtgaacccattaaacctctttttctttataaattacccagtctcgggtaattagcagcatgagaacagacactcctaatatacttgggaaaattatataacctctttaaacctcaatttctcaaagtgagggatggtgaacagcagggcgaggatgagaaagaagatgctagtgtaagtaatagtacctccttcacaaagctataatatagattatatgaaattatgtgtaaaatgcatgtaacataatcagaagtgttaggttttactgctactcatgagtagcttatttatttattttttctcattagaagaaaactttaaagcgatgaattgtcttggtgaaaagtattaggagactcttggctatgggtaaaaatgtcagaaaacaatctataggctagagtcagtgcaaaggaagttatgtttttggtagcctaatataaatgtaggtcgtgtttcctgatgtcagcaacattctaagaggcggtcagttactctcacacttggaactgctctacctgactatgtagtgggttttgggagagtcctaaaaaccacatcttataatgtgtcttctataaaatgttccacagagttttttataaaacctttaaatcggccgggtgcggtggctcacgcctgtaatcccaggactttgagaggctgaagggggcagatcacctgaggtcgagagtttgagatcagcctgaccaacatggagaaaccccgtctctactaaaaaaatacaaaattagctgggtgtggtggcacacacctgtaatcccagctactcaggaggctgaggcaggagaatcgcttgaacccaggaggcagaggttgcagtgagccgagactgcgccgttgcactccagccggggcaacaagaacgaaactccatcccaaaaaaaaaaaaaaaaaaaaaaaaaaacctttaaatctttatatgtgatctgtttatgtattgagttctgctcttattgatcatgtgtgtccatagaggcaagatagagcagtcaaattgtgatgaccagtatgagctgcatttgaagttcagctacacagaattttagaaagggatagaagagatattattcacataaatatttaaagactaattggacactatagggacagcatgtaacatggaggtgaggagaaggactcctcccaatgcttcaacaagaacacagctgtgtagataccatctaacgctgcctctttttcagaaaagaatatcctacaaactcaggttttactatcagtatcacaaaataataacattattatgaaataatgtgatttaaacaatatttaaagatatgaaaggtacagtttcaaaatacaaagtgttatacaggtccagccatttagagatagactaatccattatctactaacttctggtttttgcaaatagtatactagaattcatcctgtaagtattaaattttataaatatccaaaatgcctgtattttgccaaaaagtaaagccaccctatttcaaattttttaatctcagtacctacttttaggtaagcccattgtaaccacaaagaaaatacatacagagcagtgttccccagcctttttagcaccaagggacagttttatggaagacaatttttctatggaccagggttggtgggggatggtttggggacaaaactgttccacctcagatcatcaggcattagttagagtctcataaggagcacacaacctagatcccttgcacacgcagttcacaatggggctcaagcttccatgagaatctaatgccgtcactgatctgacaagaggcggagctcaggcgggaatgctcactcgcccgcctcacctcctgctgcatggcctggttcctaacaggccacagactggtaccggtccatagcctgggagttgggaacccctgtatagagcacatacaaaagaaaaacagaaagaaaaaaaaacaggaaaggagaaatgggacaaaataaatacaagacaaacaaacaaacaaaaaaggttaacaaaatggcaatagtaagtcaataattaccttaaatgaaaatagactagactccccaatcaaaagacagagtgactgaatggatttgaaaacaacaacgacaaaagatccaattaaatactgtctacaggagactcactttaagtttaaagacacacataggctgaatgtgataggatgaacaaatgataatctatgcaaatggcaaccaaaagagagcaggagtggctatacttagaatagattttaagtcaaaaactgtcataagagacaaaaaaggacactatataataataatatcagcagaaggaaggctaattcaccaagatgtaacaattttatatgcacccagcatcagtacctctaaatatatgaagcaaacactgatggaactgaagaaagaaatacaatattagaagacttgcatatcccactaaatagcagatagacattcagacagacaaatcaataagaaactatagaccaagtggacctaacggacatacacagaacatcccacccaacagtgacagaattcacatccttctcaaacacacacagaacattctccaggatagatctcatgttacgtcacaaaacaagtttcaataaacctaagattaaaatcataccaggtatcttttctgatcacaatggaatgaaatcaaaaataaataacagaaagaaaactgaaacatttacaaatgtatgaaaattaaatgaaatactcttgaacaatgaataggtcaaataaataaatcaaaagggaaattagaaaatgtctcacgacaaataaaaatgaaaacacaacataccaaaatgaatgcaatacagcaaaagcaattttgaaagagaaatgtatagtaataaacagctgcataagaaaagaagaacgcaaatcaacaacctaacatacctcaagaaactagaaaaaggaaaacaaacttagcccaaagttagcagaaggaagaaataatgtagattagagcagaaataaacagagtaaaaaaaaaatagaaaaacttgaagaaatattttctaaaaagataaacaaaattgacaaactaaaaaaaaaagagaaaaaaactcaaataaataaaataaaaaatggaaaaggagacattacaacctgatggcttcaatgctgaattccaccaaaaatttaaagaacttatgctaatccttgtcaagatcttccaaaaaattaaagaaaaggggatactttcaaactcattttataaggccagcatttccctgacaccaaagccagacaagaatattacaagaaaagaatactacaggccaatatccctgctgaacatagatgcaaaattccttaataaaatactagcaaaccaaattcaacagcatatcaaaaagatcatacaccacaaccaggtaggaagaaggatgtttcaacataaataaatcaattaatgtgctgcactacattgccagaatgcctaggaataaacttaagaaggtgaaagacttgtatgctgaaaactatgaaacattgatgaaaaaaattaaagatgaaaataagtggaaagacgtcccacgtttatgacaggaaaacttaatatcattaaaatgtccatactacccaaaggaatttagagtttcaatgcaatccctatcaaaattccaataacattcttttttctttattttattttatttatttatttatttattttgagacagggtctcattatatcacccaggctggagtgcagtggtgcgatctcagctcactgcaacctccgcctcccgtgctcaggcgatcctcctgcctcagcctcacaagtaactggaactacaggtgcatgctaccaggcccagctaatttttttattgtttgtagagatgaggtctcactatattgcccaggctgatctcaaactcctgggctcaagtgatccacccaccttggccttccaaactgcgaaacttacaggcatgagccactgtgcccgccccagcattttttacagaaatagaaaaaacaattccaaaactcatatggaaacacaaaggatcccaaatagctaaaacaatcttgagaaaaagaacaaagctggaggcatcacacttcttgatttcaaaatatattctgaagcttcagtaattaaaacactaaggtactgtcataaagacagctttatagaccagtggaaagagggcccagaaataaacctgtgcatatatgaccaactgatcttcaatagagatgccaagaacagacaatggggagaggatgatttcttcaataaatagtgttggggcattgtatatccacatacaaaaagaacaaaattaaacccttactgtacaccatacataaaaatcaactcaaaattaattaaagacttaaacgtaagacctgaaactgtaaatccttagaagaaaacgtaggggaaaatcttcatgacattggtctttgcaatgatttcttggatatgacaccaaaagcacaaacaacaaaagcaaaaacagagcaagaggtatactatgtcaaactaaaaaacttctgtacagcaaaggaacaatcaatacagtgaaaaggcaacctgtagaatgagacaaaatatttgcaaaccacatatctgataaggcattaatttccaaaatatataaggaactcctccaacttaagagtaaaaaagcaaacaaactgatttttaaatgagtaaaaaatttgaatagacatttatccaaagaagatatacaactgggcaatagatacataaaaagattgttcaacatcactaatcatagggaaatgagaatgaaaaccataatgagatatctcacacctcttagggtggctattggtttttatttgagggggtttgtttgtttgtttgtttgtttgtttgtttgtttgttttgagacagaatcttgctctgtctcccaggctggatggctattgttttaaaaaaaaaagttacttggtgttattaaggctgtggagaaattggaacccttgtacattgttggtgaaaataaaaaatggtgcagctgtgtatatatatgtatggaaaactgtatagaatgttctcaaaaaaattaaaagtagagttgccatatgatttaataagtccacttctggccatttactcccccaaaattaaaattagaatcttaaagagatatatggaccccatgttcactgcagcaatattcacagtagccaagatgtggaaataacctaaatgtctatcaaaagatgaatggatacagaaaatatggtatatatgtatatatgaatggatacagaaaatgtgagatagatagatagatagatagatagatagatagatagatagatagatataacagaatatcattcagccttaagaaaaaggaagtcctggctgggcgtggtggctcacacctgtaatcccagcactttgggaggccaaggcaggcagatcacttgaggtcaggtgttcgggaccagcctgaccaacatggtaaaaccctgtctctactaaaatacaaaattaaccaggcatggtggtgggtgcctgtaatcccagctactggagaggctgaggtgggagaatcgattgaatccaggaggcagaggttgcagtgagccaagatcgcaccattgcactccagcctgggcaacagagtgagactctatctcaaaaaacaaaaagaaagaaaaagaaaaaggagtcctgccataagtgacaatatagatgaatcttgagaacattatgctaagtgaaataagtcaaccacagaaggcaaatactgcatgattccatttatgtgaggtatcaacaataatcaaactcatagaagcaaagagtagaatgctggttgccaggggctggcaagaggggaatacggggacttgctattcaatgggtataaagttttagtcatgcaagatgggtatacaacgtagtgcttacggttaacaatactgtacacttaaaaatttgagagagtagatctcatgttacctgttcatactacagttagagtattagtcctttttcacactgctgataaagatatacccaagactgggtaatttaaaaaagaaagaggtttaattgggcttacagttccaagtggcttgggaagcctcacagtcatggcagaaggcaaggaagagcaagtcaagtcttacttggatggcagcaggcaaagagagagaacttgtgcaggggaactcctccttttaataccatcaaatctcattagacttattcactatcatgagaacagcatgggaaagacctgcccccatgattgaattactgcccaccaagtccctcccacaacatatgggaattcaagatgagatgtgggtggggacacagcaaaaccagatcaaatagaaatagaaatcaaaatagacaaacaaaaaactagaaagaatctgagagcctatacttcaaggtgttttacctaagagatctgaggaaattacaaacatgatcaccagcactgaaatcttgaacttggatcaaagtaaccctacataaccacaaaatgacagggatataagtctcagagactttaaatgaatataacaggttcttgtagataactcatatacagagatccaaaaatgaaaaacttgttttacatcctattcacaatatgtgtagtacccttttcccaaatacttgactgataaaaatacatacagatttttaacttatccagtctattacagtttatttgccaactcttagttccctcttgtgctacgtttaaatttataagatgagtacagagactttttgaataactaatttaattaatgaattttaaagttaacttttgtagagttttagatacgtcctttggtcatacagtttagaaattacattgaaaagtaatctaatgcaaagttttttgtttttttttttaatttaaaaggtttgagtaaatctttctttctttttttttgaggtggagtctcattctgtcgccaggctgcagtgcagtggtgcgatctcggctcactgcaatctgtgcctcccggggtcaagcgactctcctgcctcagcctccagagtagctgggattacaggcacacgtcaccacacctggctaatttttgcatttttagtagagacggggtttcaccatgttggccagaatggtcttgatctcttgacctcatgatctgcccgcctcagcctcccgaagtgctgggattacaggcgtgagccactgcgcccagccgagtaaatctttctttaaaaattactgaagctgagtttaatatactgtatttatttgcatcaactcaaaattgaattttatgccacctttttggtcagttgtgaattgaaattttataactgaaattgtttacaagattatgttaaagtagggctgagagaatgaattttaaagtatgattcaaggttatagattaaattatgttcttatatattttagtcactttttgaactattacaaatatctagtaaattttttaatgctctgcccctttaattctggtcatgtaatttaggactgaaaggtgagctttatcttggaacaatattatctttcatttatatgatagcaaaaaaattaactatactgcctttattcaaaagtgcttaaaaacaactatatgtttactctctccacttcattattttcttcctcagtgcaaatatgtttatctggaaataatgtatgcattgtagcatgcagaatgtcaagctattttaagagatgcaacataatgcttgctataaactcttatattcagtcctcatttcataaaactctcatgtttaacttgaacatgctttcatgtaaaagctcaacttaaaagtgtgcctgtttggatgataagaaaaaaaagcaaacaaataaaataactacacctatcttgtactctttaaaatatatatgttggtttttaaaaataattgcactaagctaaacatgagaacctctatattagcaacttacattaaaagcaagtcttttttgggaaagcaaaataaaattaaaagacacatgattttagatcactgatctgagtacacagatctaatctctttgccagggttgtgtatactgtacacgacatttattttatttttttttttttgcactcacttattttgatccagtggatcttgacctattatcaagagtgagtgaatattgctagaagtggtcacttcagtatgacttaatctgaagacagagaaaaactggttataaaagaggaaatatattagaaaggagagtatttttgtatctagcaacctggaatatgaatgtaaaagagaataaacagttcaacacagaatgataaagggtgccattgagagggtcttctggagttggttttgcttcattcaactatgaaatgactacatgtattcatttatccctcccctccctcattttgagggtataataaatgtgtttctcctttttctcctctttcttcaactctatctccttgaaagagaataaacaactaaaaacaatgctgcacccccactcaccttgataagcagcatgagtctattaaattaagcatgcttgacactcaaacaccaattttagggacagagtgctcaaaatagaaagcacaatggtgacatcctgttaccgtctctttgtgcccttggactcataaataaagttctgcaggtttctgtgctcccttgatacaaaataaagaaaagtgaatgagttagaacaagctctggcagccatcagtaatgttgcaccccattgctgcaggacaggagacatccaattatggagcaaggtcagcctcagtctctaccagtattttctctggtggtcaagagaccctcaccccctcaccaccaccaccaccaccaccacgattcccttctacctgatggtgctccgggactttatttttggatccttcactgcttgacttaagaggaggaagacatgataggccagtcagtcttggctgggttgtgggaaaagtgagaggacagaaccagattggtcagtttgtgaatcttgtgatcagctacttttagaatttatttgttgttaagtttgaccaacaaatttccatatccttcatgttttctcacaaagatctttaaattgcctttcccagcttcccacctaaatacattcaaccatcataacacattccaaaatacagtggttgcccatggtttgcccaatactgggcaataggcactcagatcccagttagtgaccaatatacctatgggacacaaatcatatcaatgaggcacagctgcagggtgcatgtctactaaggatactgctcatctgaaccctcagactatacattctggtaccttagttctgtctcttggtgccctttcctgcgggtaacccacattcttattctctctccatgcggcatgggcactctctctcctgcctgagtcatagttcctggagcagactccacccccatgtttcagatcctgcctgagtccactgaatgaaagcaacaactcctgcgtgtcactcacaattccctggatgatactaaaaagcaatctttctctcattttcgaaacccctttgagatattaatgacttcctagatttttttcaggacttagagattatttcagaaataatcatataataagaagcattttgaattggagactcaaattgctctttagatcatactatataatcttaatgatgatgacgatgataatagtagctaccattgaacaaatgcctactatgctaggtgccttctatcttaaccatggttaattctcaggggcagtcctcaaaagttaggatattgttcctatttctcaggtgggggaaatgactttcagcaggagtaactatttttattcatcttatagctttaaattggcagctagattttgaccccatgtctgactcgaatttcattttatttccacaacaccattcactgcgtagagataagaactgtgagctggtctaataattttttcttcctgcaatagaagtccttttctaaaatttgggtcaactctcagcactcgtaaaaatatgcatataaaaagggaaagaaatggaggaaaatattttcccattaaatactaagacctactatacactaagctacagtatttaaagcacacaatactaggaccaattggatggattatgataaagagactagacactgacccatacataaaagaacttggaatattatagaggaaacacgaagaattaatgaaaaaaggaaaataaatgatgttgcattaattgaatttcaatatttgaaaaagtaaaatagctttccctcctgaaacaaacaaaaaattcagggagatattggatctcaatgaaaagaacatttaaatatattaaaaaacaaaactttaaatatattacaggaatatgaagataatacctttatgatatctgggtaacaaaaggcaaaccacgtaaattaagtaaagcaggattttttttaagtaactaaactggtacaatttataaagtacacatactcctttgaaaaagtaggtctcatgtgaatctgctcaaattccagggctgtattcactttcaccaaacactaatgacctgaggctattgtatttttctagttttcctgttaaaaagagacatgagagtgttgactctcaggtgtgagatcttgactgatcccacacctagcccaactggaggcttaaggctactcatcacagagtccttctggagccaagataaatgcctatgaatctcaacttttattcacagctttcaatattagattttttaatattagattttaatatttttcaatattagatttcatcatttcctgtgcccatttccctagctcaagggttcacttatctttgataagtttattggctagatgtatgtacgatgactcactctccatcacataaaacatacaattttgacagttgataaaaagatgttcgcataaactataatcatataattaaatatgtaccagaaacctaaaaaatagggaagagggaagctgatagtattttactcacatttaactaaaaagccatacattttaaatctatgaggtaagaagaaaaatcaggaaatctgcctgaacccattagtgactattcatgtaggatttttttttttaattttattttttttgagacaggctgtggcccaggctggagtgcagtggcacgatctcagctcactgcaacctctgcctcccgggttcaagcgattcttctgcctcagcctcctgagtagctgggattagaggcacctgccaccacacctggctaatttttgtatttttagtagagatggggtttcaccatgttggccaagctggtctcgaattcctgaccttgtgacccacccatctctgcctcccaaagtgctgggattacaggcgtgagccaccacgcctggcctcatgtagaattttatggtcacaagcctgtagttctagcagggaaactcaacacataaaaaggaggcctttaaatgcattgtcaagaatgacgaaaggagctaagtatcattatattctgatcaaaagaaaaggcaagtgtccatttccaatctctctttctctctctctctctctcacacacacaccccccagcagatttgtaaagaaaggtaaataaatcccccatacaaaaagtttccttttttccccacttgggtctgagagttgttcagtttaacctgagttgccattagtgtccttcgaagctataaattttgcttttccatgcaattgtttcaaaacaaagaaaatctgtgactttaaaattactttagagccaagcatggtggcgggtgcctggggtcacagctactttggacactgaggcaggagcattgttttgagcccaggagttctgcgtggtagtgcactgtgctgatagggtagtcgcactaagtttggcgtcaatatggttaattcctgggagcgggaatcatcagtttgcctaaggaggggtgaaccaagccaagtgagaaacggagcaggtcaaaatttccattctgatcggcagtgggttccacctgtgaatagccactgcactccagtctggataccatagcaagaccctgtctctttaaaaaaaaaaaaaaaaaaaaatggctttagaagcaattttacaccctaacttaccaatataggtagcggtccgactttatcgccacaggaggaaaaaataaaaagcagagtaaaacttacagagcaatggtagatacaatacgatcaatacaatcttcaaacccaacttcactgagcatgagtttctacacataaaagagattctttcattatttcttttttaattatttatttatttatttatttttgagacacagtctaactctgatgccctggctttgagtgcagtggcgtgaacacaactctctgcagccttaaccttctgggctcaagggattctcccacctcagcctcctgagtagctgggaccacagacaagcgccatcacacctggctaattttttaaattttatgtagagacaagatctccctgttgcccaggatggttggtctagaattcctgggctcaagcgatcctcccacctcgggcaccaaaagtgctggaattacaaggcataagccatcataaccggtccaagaaaatcttttagaaaaccccatcaaacaaatcaccatactatttaactgtaagtccaaacaatagtttcaatcgtaatatttgaagcaactagtataaaaagagaaactcataagctagcttacatttctgttgtcaaagagtaatttatccttgctggagttggtttggaggtattaatagccggaattatcccaacaatattctggcaagaaactatacacgtactttctgatgtgctctgatgtggccacagtctggcgctgagagtagctccaacatgagggactgaagcaaaagggtttcccaaagaagcactgtgccccggagactggaaggagaatttgaggaagacattaggatgaggcatctcaggggtgtaagagagagaccctggaaggcatttggggccatgacttaattataagctaggaattgcgtgtgtagaatttacaaagtaaacaaaatggcagccgagggtggggatagttcacacccttagtaaaggctcgacattatagaatctgcctcatactaggattcccagtagcttttctggaaataggtctccttcctctcctgccagccctaaaataatattggtaacacacacaccaacttctagagagcactcacaaaaaaagttgtcaccgccaagtgacctcactgcttctccctggagagctttgcagacagaaaatagctctgtgtctttataaacaaatcactctgtgaatggcagtgggtacacaaacatgtcgattctcttccagagttcttactcgctcaattgccaggtttgcttctattttggttacagaattaaaatgtaattagttgtgtttttaatgagtccaaatgtgacacattaagattcagtaattactctaaaatgataagctgtgattgaatgtccccataaacaagggacatttaaaggcagtaccatttcttgctcagttgttactgcttttaaaaccgtcactctttcctgggtgaatacagttttaggatttaaatgattacgctggattattgcacatatttacagtcagagccagctataccgacatatttaaagtgtgtacgttctttgatcatgtggccatgtctacctaagaacctaataactgactttactgaatgttggctgtccaggttagtacctcattatgacttactggcttttaagacacgtttattttatgtggcatcagtttttctcttcaacctgatgcaagacctcactgctatttctgaggttctttatgtccttagtgtttggcagggctcacatcaggtctagaaaagtggtgctagaggttcaagatccaatacaacaatggcagcagtaattgatgcacttgccccatacggaaatctgatctcttaacccacctgtttcctaggctaactgaatcagcagcatgtcagtagctgccaatgctgatcaatttcctagtgacattggtaacttaaaaaacattgaaatagttaagttcgttgtagaagtaagcctttcatcctacagcaaatcaaaaacaaacaaaatggataaatgttttctgataacttttaaaacagtttacctaagaggaggaattgtaaaaacttaaacataaattgagatcatcccacctgattttttaatattcgtaggaagcctgttcatgatattccagtcaactactctagaatcctattttggtatctcagtatctcgtgcagcagtgaatagcactgctcaatattttagaggcttcatatttccttagagtcacaattgtcaccctaaaatttagatctaataatcctactactgtcctgtgtaggaaaaaatacagaaagcatatacttcttatttcccagccttcaagtatgtgaagactgctatcaagaccactgtgtcttactggccaggcgcagtggctcacgcccgtaatcccagcactttgggaggccgaggtgggcggatcacgaggtcaggagatcgagaccatcctggctaacacggtgaaaccccatttctactaaaaataaaaaaacttatctgggtgtggtggcgggtgcctgtagtcccagctactcgggaggctgaggcaggagaatggcatgaacccgggaggcggagcttgcagtgagctgagatcaggccactgcacaccagcctgggcgacaaagcgagactccatctcaaaaaaaaaaaaatccccgcttccaacagcagttctcctggaaccctaccttcccctgaattttgtcatatttatcaatgcctttcttatggcaaccagaagtatatagagcagttcagttcacaaagggctgtaaatacagtaggacaatacctatctcactttactttggacaaccagatgcttcaaaacttgctgatggtagattaacttttcatgtaactttatttattttactgttggcacacacggcatttttgtgtaaagttttctaatgatttttacatgaaatgatgtccagttataaatctctattctataccttgaatttaaaccaacaatttttttcacttaatcctattgtattatgtggtgttgtttttattattctaatctatttaaagcatattaatctcactctgaaagctgtataaaaacctctaaatctgggccgggcgaagtcgctcacgcttgtaaatcccagtactttgggaagctgaggtgggcagatcactagaggccaggagttcaagaccagcctggccaacatggtgaagccccgtctctactaaaaatagaaacattatctgggcgtggtggcacaggcttgtaatcccaactacttgggaggctgagccaggagaatcgcccaggagacagaggttgcagtgagctgagataatgtcactcactgcactccagcctgagcaacaaagtgagaccccgtctcaaaaaaaaaaaaaaaaaaaaaaaaaaaaaaaagcctctaagtttggttcatctgaaaatttcatgagtctgcttactcttacaagtccttgctcataatattgaacaaaaatcaccaagaatagacatgtgacacatacaccaacagaagtctctccccagcagttcaataagtggaaggtactctagctagcatctccatcgttcaactgtaccccagtatatcaacaaacacattatgagtggttcaaatgaatgcttttctgaaatgatgccatcctcaatggggaagtttcccagtctatcaatctccatgcagcataatttgtagaagtcctacctttcatttctagatgctaatcgatcttctattcaatggaagatctagcctactggtgtctcattttttattcttcctacaatttagaaaatcagatcagcataagaactttatttttaacaaatattaatataaaagtattacgtgtttttctactgcccatatctgttctgtccaagccatgtacattcatgttaaataaataccgtcttttaaaacataaatagcatggttactccacattgactcctgatgtcccaagatgttcaagatgcagtaaggagaaatattattttaaaacaattcaaagggagtgaaaatggtagcacacaaaggaggcagcatttcctgcttctcacaagaccatctgcctgtattgtgggcaagattttttaaaaatcctaactgaaaagaaaataatgttaagagacatatgcccatgtttacaagctgagggaaattgacaagtgtgtctgtttcgccagtatttttacagtcaactgttatacataatggggaaaattaaaatcggtaattacttttctagtctgccattgttttaaatgtgcttggaattttccttaagcatccattccaagtaattatttgtaataggccagaacacttaaagggttgtagggatggatacacagctattttacaaagtgaaatactttgacaataacaaattatttttcctcctttctctccccaatgttggctgagttatgtttatacctcactttgtagataatccttctagctacactttttttaggcacagccattataaaaatcttctgtttgggcttggcactgcttagaactagaaattgctatttgctgcctgccaattacagaataatttaaggtttgatgctcccaggcacagtttcttgaaatacacagaaaaaaatatattaaggtggatgcataatattttttctgcattgcatagcttcaattgcctgtatagaattatatccaaattgctaaacaaatcaattggagaaaaattatgtcttctaggaaagtgttttgtaatggttttactactctttcttttgataagatcatagcaaatattttacaaaaattttatattatttgcaactgaatgatttcaatctatgaaatgtgatgggtataaatattgatataattttaacataaaatttaaacttctaggaaataatagaggaagatgtgatttttttaaaatcaatttggaataattaagaagaaaagaaaaaagagagttaattaagtttcccggatcttttcaagtctaaaatgcaataatttttcatctttgtatattcgtatctgaattatccatcatttgcagtacgaagcaggaaagcggtaaagcaaagtaaatttgtgatttaaaaggatcaagtatatggttgaagactcaaaaagctttttatttgggacagtagaaggaaatgtgctgattatcatgagaacaacaaaaaagagaaatgagttatttatgtaaccctgtcatcatgcctacaacacctcgaagggcagtcaggcatagtctgttatcaggaaaagcaagcaaacaaaagcctttatatatatatatatataactaatcacaaacatgctcagactccagaagatggtaaaataaaataaaataaaataattttattgacttctttcacctaggtgccttggttgcactccctggaaaccattcttcgcattccccacttacttctcttttcttttctttttttttctttttcttttttttttttttttgagacagagtcttactctgtcgccccaggctggagtgcggtggtgccatctcggctcatggcaacctccgcctcccaggttcaagctattctcctgcctcagcctcctaagtagctgggattacagatgcgcgccaccatgctcggctgatttttgtatttttagtagagatggggtttcaccatgttggtcaggctggtctccccacttttcttaattcacccctgaaatacactacccaaacacgtagcaactgaggtctggaaacttcattcttgacttcttctaaggaaggccactttcttcaaaatacagcaagacaaacacatctagctcctagcatgacttcagtgtgaaaaggctgggcttgggagagcagcaggtagacatgcctattaacattgtgctgccatgtttactttttttttgtttacttaaatcatggacagaaagccaagtgtataagtgaaaacccaagggacaatgacatggggtagactgcagaccaagaataagcaggaagttaaataccaagatattcccccaaaataaaccagatagcttggtttatatggaagaaaataaaccagagtaccactaacataagcatgacagaaggttttacacaaaactttagcagaagtgggtccaaatttcagctagtttcaggaatagttggtcgaggatggttctccaaagagggtggaattgtgctgttgatcagctgccctcacatgagcgatttgcattttcttggcgagaaatagtcgctgaagtcaagcagaagagtacgtgagaaggaatagctgtgagaccaggacaagccaaggccacagtgggatattctcagtccgtctgggtctctagatttacaaagaagcatgttgaatctgtagaggcaaatgggaagctcccccttcaccctctaaaggttagctgaaaatgagtaaatgacaagagggggattaataggaggaaaggacatagagaaggtaattaacatgcttagggacaggggaatcacaggaggagaatgacccaataatccagtgaggtcctgacacttatttgtatacccttcttcacagggacagggttgatgaggagtgtagggataaatgacttacaggggaaatgaataagcccaaagcacggtggtctgggacaaagttcctctgagctctaggacaggtggagggaaggtgagtggttgagcttcactgtaatcaaaggttatcttattatgcagataaagcctcccaggtaatctcttggagctgtcttgagaagaatagatgaaaagtctttctgggtgcagtggagactcccagtgtctcctcttctccagtggttaatctttcctggttgtttgatgagattcctagggaggaggtcttaagacaattgcatttccttttaaagggttttcctagtcagataaggaaattccggttctggtacagtggctcacacctgtaatcccagcactttgggaggctgaggcgggaggattgcttgagcccaggagttcaagaccaccctggccaacatagggagaccctgtctctacaaaaaaaaaaaaaaaaaaaaaaaattagttgggcattgtagtgcatgcctgtggtcccaggttctcaggaggctgaggtgggaagaattgcttaagccagggaggtagagaggctgcagtgagctatgatcgctcaactgcactccagcctgggtgacagagaaagaccctgtctctaaaaaaacaaaaaataaaattccagcaagagtagctcccaatgcttcaggaaagaaaagagatcagagtggggcttgggagggaacactggagagaccttggttctgaggcttatttctgatgcctttaatttcctttaattcaaagcatgccaaagagccatatttttggaggagtattttctgagccccaagaactcctcacaatgcaaaatggatgcctggctttcatttttttaaaatgatttatttaccttaaaaataaacttggattcatttgatcttcataatccctgtagataatttaggcttccaaaggaaacatggtctctattggcctaattaccaataaccaagttaaattccatttctgtacagaatttttttaaaatttacctcacaatctagaaagaggagaaaaaaataccttaaaaattaattattttcaaagccatgtatatgcagatttggtcatggcttattcagaacacattagaattattttaaattctaagtatcctcaatggtgaacttaaaatttcattctagggggaggggggcatggttaatgagtagaaaaaaatagaaagaatgaataagacctactatttgatagcacaacagagtgactatagtcaataatgactgaattgtacattttaagataactgaaagagtgtgattggattgtttgtaacacaaaggataaatacttgaggggatggattccccattctccatgatgtgcttatttcacattgcatgcctgcatcaaaacatctcatgtacccccataagtatatatacctattgtatacccagaaaattattttaataaaataaaaataaaataaatgaaataaaattttattctagccattccaggaaaaaaaaaaagccccattttgcaaagatgattataaccatatatatcatatgattatcaccttgttttcatacacacaagcatatatgtatgtatatatacatatatatttacacacacacacacatatacacacacacacatatatatatgtgtgtgtgtgtatatatatacagttgacccttggacaatgcaggggttagggctatgtcctgcacagtcaaaaatctgcatataacattggactccccaaaattttaaccactaatagcctaccgttgactggaaaccttacccataacataaacaatcgactaccacatattttgtatgttatgtatattatatattgtaatcttacagtaagctacacaaaagaaaatgttattaagaaaatcataatggccaagcacggtggcccacacctgtaatcccagcactttgggaggctgaggcgggtggatcacctgaggttgggagtttgagaccagcctgaacaacacggagaaaccccatctctactaaaaatacaaaattagctgggtgtggtggtggatgcctgtaatcccagctactcaggaggctgaggcaggagaatcgcttgaacccaagaggcggaggttgcagtgagccgagaagaaccattgcactccagcctgggcaataagagcgaaactccgtctaaaaaaaaagaaaagaaaaaagaaagaaaatcataatgaaaagaaaaatatatttactagtcattaagtagaaatggatcatcatgaaagtcttcatccttcctgtcttcacaatgagtaggctgaggaagaagagacgaggttggtcttgctgtcccaggggtgaaagaggcagaagaaaatccatgtataagtggactcacacagttcaaacctgtgttgttcaaggatcaactgtgtgtatatatatatatatatattttttttttttaggtttattgcaggaacaaaatcctctctccaaagctataatcctgactggctcaagatgtcttaagaaacttagaaacacagctaggaataaattacagcccaggctagttggttgttctcccggaatgagcgaattcaaaaggaacctggttatttagcaagaaatagactcagtgacctcagcagcattctaatgcatggaaaggtcagagaggtttcgtaccactctgctgggtcagatggaagccagagaagctgttggggtctccttgaaggttgaccctgggctgcaggtcaggaaacccaagtaggattccaggaatggattgctaagaagcttcgaggagaatggcttccacccatgactgagaattgaattgaggtccaggtagaatgggtagtacctggtcacagcccataagaaataagaagaggctatgatttgaattggtattaataacaaagaagaaaagcagcatttacttcgggcacaaggccagccagcctgctctcagaagctaaatgcaagtgacattttcttgtcaaatcccaacttttacccatcaaaggcttggggagaaagggaatccattgcaatgagttggttctgtagatagccctgcagaatcctggggggtgtttcacacgccagagaccaggatgggttgcggaaagcagttaactaccaagtatagtaagggaggcacagtaactcacctggaattgactttgcaagctgaagactgttttcaactgtgactgtgccattaggattaatgcaattcatacagttggctagcacatcagataaatatgatgaattgtccttatatccttagtccagtgagaactggcttttccatcacagcttaagctatacacatagagaggcaaaaaaaaaaaaaaaaaaaaaaaaaaaaagaccttacagttttgtttattgtgcttatcacaagtgctggaaactcacattttcattgctaatagccctctttgaaagtttgttgacatttcagctgatctttaatgtgctctactgttataatacccttgggcaaagtcagtttccaataggaaaatagacagcttctgggtacccctgtggaagctgcacaaacacaaacagactggcaccccagcctgcaatacctggtgagctctgctctgtccgaatcacagaagggtggcagaatatataacctcaaagcatgccactttggcataaggattatgttgaagtaaaggctcttgaaaaatagcagatacaagaagagcactttgaccttcctttttcttcctaaaagcaggagataaatctccaggggaaagttgttgtccctgtattgggaggaagaaacattcttatcaccagagatagggagtgaaggtcaagagaaatccgtaccaaaaaactttgttaaattaaccttatctgtctcttcacttttctacaattaactgctctggcccaagcctctttgtcttgccatgttttcacaaggtgctcctcttcatccaacttaggatataagcatctgactctaactgcttctttgggtcttcattttcctatgtgaattcccatgtccatttaaaatctgtatactcctatcttggtaattatctgatagcgatttaattctcaggcccagccgaggactctcagagggcagagagaaagttgtgccttccaggatcactgtatttgggagcctggaagacgaagaatggagcccagtaaatagagagggaaggaaagacatttaaacaggttcctaaagagaatgtgaggacacgtaagaacaacagtaagaaaaagtacagaaagaaaaatttacaatctattctacagagcaaattgaggtatttcttctgtaatagggaaagaggaaagagaagattcatgactgaccatcagtaggctttatagtggagagagaattgtccaaacctccgtataatcaagcacatatcctgattcttagaatatatgttccaaactaaattaagaaagggtgatgctggacagaagcagttattaattctggggtcaacaggataaaaatagtcagaaatgaacgttgtggtttgggaatataagcagctgaattcaaaataagaattctaatagaaagtgttaaatcaaagagcagttcataaagtcagagctagaccttgggtggggggaagagcaattcaaaaatttagagcagcatgtatcttaaaaataaattttattgaaaaatgagaacacatggacacagggaggggaacaacatacaaggggggcctgtccgggggtagagggcaaagagaggaagagcattaggacaaatacctaatgcatgcggggcttaaaacctagatgatgggttgataggtgcagcaaaccaccatggcacatgtatagctatataacaaacctgcacattctgcacatgtatcccggaacttaaagtaaaattaattaaataaaaaaaaatgaaaatgaaaataaatgttgttatgagaactcatagtggcatggccccaattttagaaactgagcttaatacagttaataggtaaatgttagatgaatacctcaaactgaatgttaatgccaaaattaagatcattctttggttcaaaatatagagcatgtttatatcttaattaaaagcagtcatacttaaatctctccttttcggccaggcacggtggcccacacctgtaatcccagcactttgggaggctgaggcgggtggatcacctgaggttgggagtttgagaccagcctgaacaacacggagaaaccccatctctactaaaaatacaaaattagctgggtgtggtggtggatgcctgtaatcccagctactcaggaggctgaggcaggagaatcgcttgaacccaggaggcagaggttgtagtgagccaaggccacgccattgcactccaggcagggcgagaagagtgaaactctgtctcaaataataataacaataataaaataaatctctccttttcattatttatagaaaatcatagtattttggcacattaaattgaacatatttctttaagtaattaaatgtacgcctatcataatgtattcctcctggtacttaactatcatagattattagcagtttagtgtttaaagggaactcaggactgagagttttaaaaacttagactcacagtaagaaagtcatctcatgttgatgaagtataaatatgcacatacacacacagacacgtcacatgcaggtacataactaaaatgaaagcttcctgaaataatacttatttacactttgtacagaatcgaatgcactttatttcctagtctttgcattttaaaaatatacttattttttttaatgctgctcctggttccccaaattgaaattactatctaccaatgtatctcaatttacagtttggaaaacactgccttagggaatagctagtctaattttgcacctgagaaacgtagagatttagggaatattcccaaggtcacgtagtatgtggcaaagcaagcctgtgctgtcttctaagttctggcgtaatgagttttccccaatcttacattgttacattgttttcaagatgaatggtcatgtatagtgtactctttgcctctcaaatttgatgaagtaagcattattccgttgctacgtgtcttgctcactttgcgttttcttagtttcataggaagcatcagttgtgctaagttttatttgtgtgttccattgtctcttccccctaaactgaaagcttcctgagaatagtgtgtattcttatcaatatcccctaaaccaagctgagtagtgtgaatgattgaatccttagaaagacaagctcatgtagtcaaatagtctaaattacatgagtgggacaaaaatatcagcatccaggtagccacagatgctcttctttccttctaagaaatacgattctcattccatacctagatgatgggttgataaggtgcagcagaccaccatggcacacgttcacctatgtcacaaacctgcatgtcctgcacatgtatcctgaaactttaaattttaaaaaaggaaatatcaattctattggttatgctgattagagtaataagtggagagggaattgagaagttctaagacaagctgtgttagtatcctagggctgcagcaacaaagtaccataaacagagtagcctaaagcaacaaaaatttactctctcaaggttctagaggccagaagcctgaaatcaaggtatcagcagggccatgatctctctcgtagcttctggtggttgccggaaacccttggtgttcttggcttgtagacacatcgctccaacctcagcctctcttgtcacgtggcattctctctgtgttttctgtgtccaaatttcccccttcctattaggacactagccattggattagggcccatcttaatcaagtatgacttgattacatctgcaaaggtcatatcgagaagtaccaggggttagaacttgaaaatatctttttggaagacacagttctacccaccacagaagctacaccaatttacatgaaaaagaacctaagtagatctagaagagttggagagagaaatgggatagaagggagatgagcaggaagacatgaaagcaaacaaatgagttatcttcaggggagaaaagtgcttgtccagtgtactatggagagacgcataaatgaagatgactttaatacattctgctttgcatcatgcaacataactttttttcttttggtgcctctcacagagacctctgtaaatcctaaattatcttttaagactttgttcaagtcagattttttagagttatttcagatgttatgttattgcaggaagcagctcacaagtgacctagcattaaagataataaaagctaatgtttttatgtgagtagaagatatagcattgcatttaaactatagtttcaccattatacagaaggaaaagaagacagcaagcagaagagacaataatgatatattgaccttactgaaagatgatgacataaagcagtaggatttatcattttttgtaagttactgaacattgattcagtgttatgcatcttgttcttctatatattaagcaattatgtttatttctagcactgaaaagcatagttattttcagccaataattgctatttgaatgctatagttaatgtttttataatttttagatgacaattttattttaattaactctcttagaaacaatcatttatttatttgctcagcaatatgtgttcagtatccaaagtgtgttagacacaattcagtatatccgtcccctatatcgagagtctagttagagtgagttaacaaaagcttttattcatgggaatttatagtataaaagtgtacaatagtataaaaaggctgaaagatttctatagtgatttcactatgaagagatctctctgatatttttcttccctttcaccttatccagtctccaacgtttctgtaaaaaacagctacacccacttttttcttcctgtcaggtgaatccagatagtgcagcaaagttgagccaccgacactgaatttcccaccacaagtgaaacagcagaaaaggctttccaagttcactgtagggaaaataaaagccatgtgatatttattgcacatccaagtatatggattaagattaattcctctggagcaataatgatcacactttttaaatcttacaactcgttgatagtcatcaaaattgaagatccaaaaagcttttatttttatgagttttacatatcagaatttcatgtattagaaattaaaactgacaaactttaaatatttattttaagacaaatgatatactttaaatattaatttaagacaacattaaaaaccctctacttattagcataacatgcttttattttttaaaaaaactacattattccaaaacaaaaaaagattaatgagaagagtagtgttgttccattacacacccatgagtgaatgagagtgaaaaaggaaattgatgtcttaatattattatgaaaattatttggtccaatagttaatggatcccctgaaaggtattcagaacccccagttgtctcctggccacatttagagaatttcagccctagaatgttctgatatgtagtggaggaaattgattctatagtacagaatcagagggcaactcactggcctgctccccacctcagctatcatatgatgcacagtccctgaccaagtggatcggaaatgtctcctgttgtaggtcaaggtatccctgagaaccacaaactgagatatggacaaaagagcaaaagcgccgtgcacatatcttgagatgcaggttaaagaacaaaacaagaatgcatgtattttatctcaggacactaagtctccaaagaatggcttgtgatgggggtacagacttgacccaagaattactgactataatcaaaccacagtttaacagaggtgctatttatagtgaaaaattttcccccaagcaagaattccatagtaaagtaagatcacagttgcacactgcaaatctttaaaagaaaattccagaatttatagcttacttagcctacttagctacttgctttgctcatatataccagttctttcaactaccacaaaaataataactatttgaatatactcaataaacaggcattgtgaaatttgaattttacaacatagaatttggttactgttcctgttaaaacacaaaatacatgagtgaatatttatgtgtatatttttcaataatgttttccaaatgacctttggagaatatctcaagatgattatttctttggcagggggcaaaaaaaaaaaaaagctatcagtgagataagcacatcaatcgaactgttttcatttgagccatgtttaaatgagctaggatgcaaaatagaaattctggaaatatccaaaagaaagatgtacatgtcctctgatttctcctaagtctggacagaattggcagcagaggctctaatgaaatcttgcaattagtctgagaagcccattcagagagcttcactgtgttcagccttctgccgctgacacccttgcctgaagacacatgcccatatcgaagcacatgcagatgcctttcctcatacctagaccctgaaatgaccatggaccgcaggattctcatgtgagatttcagtttactgcttaatttttcatcttgattggacttttcatccatcatatcaggaaaagctgaatatacagacccagacatagataggtttggggacaggaagaagatttaattctacttagattgatcccattttttcttttcttttctagaaatgagtgagatcatttgctgatcctgaggtgtggagggaaaaagtcttggctagaggtgtaagagaatgtgtggaagatggaattgactaaagaaagtgatagggttgtcctgcaggtctgaggacccaggtgatattcatggtctccatgtaacgcataactggtcagcaccttttgtttgcttgtttttctccaagttttactgcttagatgcggtaaaataacatctggcattcccagagttggttttccaagtaatgtcacttactgaggcaggaaggagaaaaggtgtttgaggtttgaagagacaggggaaaaagtctgttaagagaaaaggagtgaaagtgaccagaaataagttagtaggattgacaggaactaaatgggttagcatgggttagcagagaatgagatgtaaactctgttggggttttgctgacaaatacgatggagagagctgaagttgtttgtttgtttgtttgtttctcaaagatgtgataattacagtgaaccttggaatctaaactaatgaagaaaaggagtgaggacaagagagtgaaaaagtgatagtcaatgaattgaaggtcccaggagaagaaatactgtatttgagaaccagagtaaatgaaatggaaaattaaaggcagtggtcagaagtcagcataactagaataaaagtttgaaaagataatgactaagtcaagggtatcaccaggggagtaggtggctgaagtgcaatcggatgaaaaaacagtgggaaacgagatgctcaaagaaatgggaggttcgtaggtcactgtggtccagaattgcaatgattatgtattcagttccggttaaccaagaaattaagcattttgcaattctaaaatcatcagttgatatactaaaattaaagtctaaaatgccatgaacattatgttagatacatatatattaaatggaaatcaaattgtatacgtaaaaaaagatataaagaagaaatatagggctagacatagtgtcttatgcctataatctcagcactttgggaagccgaggtgggaggattgcttgaactcaggagttggagaccagtctggacaacatgaggagactctgtctctaaaagaaaattaaaaattagccaggtgtggtgtcatgcacctgtggtcccagctgcttggaaggctgagatggaaggattgcttgagccttggaggttgaggctgcagtgacagatgtttgcaccactgtactttagcctaagtgatagagtgagactgtctcaaataaataaaccaataggacatattaataaatactgtgatcttaagcaaagacgctttaactttctagagcttagttttctcatctgtatcacgagtaatttgaattaaattatctagaagttaattctttgcctgaaatggtttgtttcctttatccaatattactcattgattataatgatcaccaaaaaatgaatacttacgtgaatactagagaaaaaatattgcttaattttgaaaatacaaattgcttatttgtagaagctattttggttttatttgtatgtttatttaaagtttgcgagggaaccagggttatcaggatcactctgatctgaaatctgagatttgggtaatctcacttctatccaaaaatctctaggacatcaagctcatcaaggtcttcagatgctcatgatgcattaattgccctttgagaataactgcctaagagatggatgtttatattgattttatggtagatattttcttcttcatgggagtggaattccttttacaggttgattcacaaacctagagccaaaaatataactgaactattacagatttaaagtatagattgcataattttgtaaaaatattatcatacaaattctaacatatcgtgagctgaattatactaccacaactaaaactcaattacttataggagtcagacgtatattctaataagacagacactgaaattgctatttttgtctgctggccaaattaactcccaactcatcagtttgcctcccattccctaaagccttgtgcatatgaattacctggcactattgctaaatacagatttttttgcagtaagtgtagggtggaatctgtaattccacatttctaacaaggtcccaggtgtgtcagtgcaacacatctaaggaccacactgaacataactctatacaaaaaggctccactttttattaaactgtgattctgaaaacccaagtagaaatcaggtttttaaaaacttatcattcctttctttggctgttgagacttgtatttctccatgccatatcagacaaattgcatttacctggttccctctgaattagcaatcttaggaacttcagctactctcagattctattccgttatttcagagttcccagtggttggctcaagtgtgagtgcacattcaggttttccagttgcctcatagcgtctttccatgaccttctcccttattccagctcctgcttgggtgtctctggcaccttcttaggacagatgtgggttgtccaatgctcaggacactgaatccagctcaagtacccaccatgagtttgatgcaaggcaagcgagccccaaagtggggcttagcccatgagggttcttggcttctcccaggaaagaatttaagggcaagccaatggtagggtagaagaaaacagctcttatggaagtggccgtgttacagttctgtgattgctcccacagagcagggctaccccacaggcagtgtgctgagagtagcaactcggggcagttctgcagtcatgtttataccgaccttgaattacatgtagattaaggagcagcttatgcagacatttctagaaaaggggtagtaactttggggtcatcaggtcattgccatgggaaggggtggtaacccccaggtgttgccatggcgatggtaaactgacagggcatgctggtgggtgtgtcttatggaaagctactcctgccccagtcctgttttagctagtcctcaacttggttcaggatctgagccccacctctggagtcgagtcccagttggtacctcaacttcaagtgaagaaagtcacttaattcagttttttgttgcccccttaccaataacttgaaaccatttgagtggcctctcatcctattcaaaactactcctttcccttaagcctaaaacattatccttggaataagcctcagcacctcgactctctccttcctttaggctcagagaactgatgactacttcatgccaatacatccttggcaagccacctagtaggctgccattcccacagcaagcccagcagaaccatcagagtcatggagtggttatagtttaggctcttaagttggaattcccaaggacactataacatagtgttcctgcatgggtgagggaaaaataataactggtttttatggagggctaggagaggtagatgaattacctggtgcaaagccggagtcagcatctgtaactgatgagtgagcaggacaagttagagttctatgaggaagctttatgccgtcactggcaaaatttgaggcagcaaaatgcaaaggaactcaataaatggtgagatgattaaccaatgaggtggtactgactccagcagtggtgttattgaaagttcaggtatattcaattataacacattttaaatcttggattgcctgaaatcagcctgccaaatatgagaataatccaggcagacaaggacaaagaacattacacaataatgatactaataggcagtgtcctgtacattgtaattgtacaatagtgacagtaataggcagtgttttccagcatcaactggagtatcatttcctatcccaagtaagttaaacacaggatgagctcaacatcctaaggtccagaggagagtggacggtagtgagttatgctgtctccctgtggtgcccagggactctctctctgtcaaagatgctgtatctaattacctaggctctttctttctcctttcctcctcctttcctccctctctccctccttctctctctctgtctctctctttctttctttatgccctagaaataagtctttttcttctttcccagaaatcatggtgataagtagaagcctgcatgcaggaaattattgaatataacaaaaaaacatagttggtgaagttaactcaagacaaaaattatatacaaagaggtaattgcatatagattagagaagtccagtgtattccctttttgtaaaacgccttctgaatcgagtatcttttgattccatacaattctgtctcccctcacatctgacctattcatgtcagagatctcctacctggctcctttttcatctagtaattaatttatatccctgtcctaacttctatctcctgctcccctcaacattatatctctttttataactaggatatactcaaatgaaaaaatccatgtatcttactatcttctgccttcttctaaatagttgtgcttccttttgatctatttatttgctacaccaggaatatttgacatttcctggagaagtaggaatctcttgtatgctcatttgaaatgagctagtgtggttatttaacaaatatgcagagcaacaatgcacaagatgatcaaaagatatacgtggagaaggaagttctctatttcacaccactgagttacattttaagcatggggcttgtgaactaataccactgttcaccttctcaaaagggcatggtatttaggaatggcattattacagttttctacagttttccaatagaagacattaaataaatgagagaacatttctattgggcaatattaaaacctttacttccacatccactgctttcgccagcttgaacagattagttattcccagtagattattctcattggtaattctgtaataaaagattctagatattgtgcattttcatcactggcattacaatttttatttcagaatcttggtcatcgaatattcattatctaattataataaaaatgcatgattcccttaggaatgcctataactaaatgaatatgaactttattaaaggaattaaattaggagattaaaattattcaaagggggtaacaactttattcttaaagaactgtaggattgcaatactaggaaagaaagagaataggaaaggcaacagaaaagtagtaaaaagaaacagaaacaaaacagatagatccctgatgtgctatgatggggaatagagtattaatttaattattcagttataaataaactaaagcctaagcctagtaaattatgtgctccttgaagattagagttaggactgattaatctttgcattccccaccagaccaggcagtgcctggaatgtagtggacactcaataaatttttgttgaattaataaggaagcaaattctatatgaaaatgataacaagtttatgagtactttttcaagtcagtttgcagatacaagtttaaggaaattcatactcggatatagttagaatgtgtatactgaattagaatgttagtctatgtgctttgggaattaattttgaagctcaggaagctatgcaagaggcagccaagctcagaggaagggtgagagacttgatcagctgcccctccctgtcttgaactatttcctgttatagatggaaatcatccttcattacctgggaaaaagtatgagcccaaagcagaattagccttctttatacatgtgttgaatttgtgttcccatcatattaagtattaaaggaaatgattatgagctgtttgttggacagtaaagggaagtgataatgataattttaatatagttaacattagcttgaaacacatgaaactgatatttttgtgtgtaaacacctaagtgaatattgacaatttcacatggtttaatttaatattgatcaaatgctacgtggtaggcactgtgctaagtaatgtatagtccattaatttgtttaaatttcatccaaaaagctttgtaatagatgaggaaattaacaataagttagggaacttgcccaacatacaaagaggacatagaaggtaaacagtttaacatcagagtcccttttcttaaacagaatactatcctgccagggaaaatatggatgtcataaattatgttatcaaaatcttgccttccaatcacttatttatgtcaacaaaaatgtgacaataagatataccatggttaattcacagtgcgaagtgtctgcttctagaaaggtgaaatttgcttataatacagttattattataccactgcaatatcgaggtcaagttctatggctacaaaatgacataatctttactcaagaaggtcacattgcagtaaagaggacataattataaagagtattacatcactagagttagatttttttttgttggtcaaatgactcaatccaaaaagtaggatacatagtaagaatgtgctatagagacaaagagataaatatctgaaaccaaggccccagaaaattaacaatctatgtcaaccataactgtattatccatgtgagtcaatttctatgggaaatacagttctgttatctatggataatacagttcttcctagaggaagaagcaattaattgatcttggaggggtcagggagagtttcatagaagatataacaactttacaaggcttgagggatgagtgggattgcattaggcagagaaaagaagaaagacatcctagaaaagggcgcaacatgtacaaacagaggaatgtgtgacagtaaacagtcacgttgaggaacagtaaatggtttatgtggctaggaggcaagtttgataccacattatattctgtattcctaaaacacccagacacgcgaaatgctgaaacagtaacttggactcttttgtgaagatcccaggactggaaatttctactgtgtcctagaaagcaatgataagccaacgatgctgtttccttctcgagctataactttcatagagggaagtgcacacatcttaaatggacagcttaggcattgttacatattagtatacccatgaaattatcacccagatcccttgcttggaagaccaaatgtcttttttcccccctcagaaatttattaccatttttcagaattaatattttctaaaacccaatataaaacattatatataaccattatggactgaactgtgtcctctgaaaaactcatctattaagccctaactcccaacatgattgtatttggagacagggtcattaaggaaattatttaggtaaaatgaggccacaagaatggggccttaatgcgatgggggtggtgcccttataagtagaggaagaaacacaggagaggttcctttctccactttagttcatggaaaggccatatgaggacacggtgggaaggtggccctccacaagccaaggagagaggcatcaccagaaaccaactctaccaacatgttgatcttggacttcaagctttcaaaactaccagaatataaatgtcgtctaagccacccgatccatggtgtctcaatacggcagcctgagcagactaatccaacagtctcgaagaattaaatttagaattggtcatcaagattttgttcacctcaaggaaataaaatgactcaatcctccacggatttgtttccatcattttcctttcctattttcagattatttgcaacctggagactgccctgcaaaagcacgtggcaatttccccttctggatcctcacaggagaaaaataaattcacattaacaaatattcagatgctttatttattctgaaaaaaataaaaaagtgaaattgctaaattgctaaattgagtttttcactggtcaaaatttacatagcccaataggtgtaggctccttactccttttgaggcattttctctctcttgattaacagtgatggatttttattgccccacttctgagaggaggatttatatgtcttttaatctgtgtaagttggactgaatcataaatggttcaccctctaaattacagagtaagtttgccaatagagatgaccttgtttattaaaatctaattaactgaagttttagaatgtccctgagtgggttgctgaatttctgattttctccaaaccaatatagatcaaatatccagctggctggagttaaccacaaagctctgaacctcactgtgaaattatctagttaattcctctttcagacattttttccaaaggtacaagcccaagaatcctttaatatgttggccatcctatttcagaaaagccatgtgcccaattatgagttggagaaagaagcccaggtgctccttgttcactgcaactgaaatgagaggaccctggagtgtaactttcattccccagcaatggtcagtcagaatgtctctgatcatgtgccacttttcatcttctggacaaagttctatgctgcctatacacataaggcagtaatattcatgactttttactgccaaccttggaaagcaatgttggcaaattgattacagacatatgggataaaacataattaattgattcagttcctagtctatatacaaaattgcttaatgctaaaactcctctagtttctgccctattgcttcttccatttctcattccaactttaagagtttaaggtttgtctcttctctctcatctcccatttaattatcagctattgaactttttcttcatgacattactagatccctttgtgtcccgtccaccgatgatctccatattgatatagctgatgtacatgctttaattttttgataacggacatttttgcaatatttaacataatataccacctcactcccaccccaccctccagaagctctctgttcccttggcttatagtacatataattcttttggttccttcagaattttagatcctgtattttcaacttctttggttcattcttcttctttcatgctgacactgacagtgctctcaaggctctttccatggctgcattctgacttgcatttagtcccagtcactgagagatattttgaagttctgtttttatttgggccacctcaccctgaagagtaagtacttttcattgttgtagctgaggtggtgtgcctttttcaaacgtctacgtcccacagcatcttcgagatattgataacataaaaacaaatatcgatcatcctaagggccttacagacttcagagatgggtaaaagaaaccacttccaccttcaaatcagtcttttgtatccactaggggagcaaaatgacctgctgagttgaagtgggaataacaaagtatctcaaagatgatgtgatgtttgtagagaaaagtttgtggcagtaatcgatacaggaatcacttatatggatctgtgttacttggagggggctttagaaatggcatcaagaagaaaaaaagcaatgcttcttggtttaaaaaataatgcttttatcattgaaaaatagtaccttttaagatggccaaatccccaaaataaaaattcaaagcatattgtacttccttctgaggccaaatgcatcagaactaatgctcttttgagaaaaccatgctatttaagcaaaaatttagggagtggagagtccgattattgtttttcatgagtgttgaagtctatggaaacaatgaaggaatgtacagaaagtaaattagataaagatttgatttataaaaattgtccaggtttagaaatttttatatatccaaacagaagtcatgaattaggtttccccaggctgtgaactagactaaggtggcatgtaccctcacattccaaagctgagtgccctctctgtccgtgtcacccagttaccctccttgggtgacataagagaagcccaacaattcctgggggtgtctcagagtccagcaggaaagatttatttgcagagttgagatgtcagcatattccgtctgcccacaaccatcatcaccatcatgggagtggactatcgctgtttagtttcaagggaaagaaacatggatgtgtggaatgaagccagccatgagcaacctttaaaggcacccacccaggggccatcaaggcaagagtgaggaggagtgtgaactgtgcagaaacagaggggagttgtcagtggctgggtgcacatggcattccagtttctgcacttatttattggttataaataacgcttcagaaacaccgagaagtcctagactattcactctaattttaaaagaatactgggccattataagggaagattttccccttgactacttttgagatgccaggagttggccattaattgctagatatgaaaacacatggaaatggcaaagaggctacacatcaagcattccctctactaatcatgcaaatgagtcatgatgtacaaaatgtaaggaactcctgtttagggaaaatatgaatgtagatgcacaaagtaaaatgtatgtagtccaaattagtcttctagccagtaaggcaattttcctatatgataaaaagaatggatttttatatcatttaaaggaaatacattgaaattattttagaatttaaaaaatgtaaacatgcatctttccttcttaaactctagagtatcggagatttgatctgtttttttctagctcagctattaactggttgaataccttagtctaggcattgttttattcctagtctattacctctgaaaaatgagggtagtaattagattatctcccaaaatattactgttctaattgcatgtggggaaattgcgtagaactacaaagtcttgtcatacaacctacattaactggttgagtaccttagtctagacactgttttattcctagtctattacctctgaaaaatgagggtaataattagattatctcccagaaatttactgttctaattgcatgtggggagactgtgtaggactacaaagtcttgtcctcaaagggctcacactgcatatctacgtgaagaaatattggcccagataaactaaccaacttacttttacatagagacagagccaaggtagggtttgcctttgcaaatctaagtcttgtacccctttcaccacgttaatgagatatggatcttctaattaaatattaatttctaaagaaataataagccccaattacagaaaaaaaaagatactaaaaatatttcaagagcattcaaggagcttcaatacaagaaaggcttgttgttgggtttttttcatctctctccattgatagttaagtacatacgggtagctattttagagctgcgcctagttaacgtctatgtttattcatgtatttattcaatcatgaaacacgtggagccggccacttttatttgaatccactttaaataaacacttttgtgttgattgtacaaagttccatgaaacaatatatctgccctcagggaacttgctttccagaaaggcaaatcaaagaaaaacgttttgcaaagaatcccgaaatggttacaagggctttctaagagaagtctaaattgaacagataattgtctcacattttgtaaaaggcctagactattctcactgaaaagcagtaattgaatctgtaattactttcatttcactggggacataggcatggattctaaagatctcattgtcatggttgttttcttaatcactctcattgcttcctagcaacactagcttccttccttccatgcaggaaagctcaacagtcaatggtgggcaaggacactatgagaaacatttaatggcacccacccaaggcccatcaaggcaagagtgaggaggggtgtgaacagagggacctgccgcttatttgcctttctgatgatccagcccctgtttgttttatgaacaaaggctttaacttctgacatagaagcgatttttgaaaatgaacgtaaaggaactggcaaactcagcccatgggtttcccttttaagaacatgaaatcacctcctcataatcatttcagtgatgccaggaacgttcctctctctctcccattcaccctccaccattcacagagatttgatttctagaattttgtcaaaagacaaaattgcacaaaaaattaaagatctaattggcttttattagcaattctcaaattgggcaacaccccactctataaactggaatagctgtcccagtgccctgagtagaggagattggctttataggcagaaaaggtctgaagaaagcagaaacaaggaataaaaagtggattggtcatttcaaagttactttccttgtagggttaaaacagggggatctcttatcatgccagctcaggcaaactggtctccttctctctttttggttttgacaaaatgtcttgctctatatggtggtatgatctcagctcactgaagcctcgacttcctaggctcaagcaatcctcccacctcagcctcttgagtagctgggacgacaggcatgtgccaccatgcccagctaatttttagtatttttggtagagacagggtttcgccatattgcccaggctggtcttgaactcctgagctcaagtgatcctcccatcttgatctcccaaagtgctgggattaagggatgagcccccacgcccagccaaactgggccccttctgattgatgactatgactctcctgttatttggaaaactggtggctttcaaagttcacgttagttatgtggcacctagcacaagtgattgcatgttggtttggtctgagttgttgggacctactgcagggcctactccaaaacaatggcctcccataaaccctgtatgacagtctcattaaggcattgcttctacttaactggtttgttaagtgggaggtttaaggtttgtcacctttttctctgagagcaggttttagtagagacttggacagagggcatgtagcagagaggatacagaaagatggagctgagaacaaaataaatacaataaactaaaaattcgccatacttttaaaaatatttaacaaaaactaactttggcttgagttataggtttcctctcctgttttatgtgcattagatacacacttttaacaattagatagtttttggtattaaccatgaagtagcatcttatttctgggtaaagtctgtctatttttttaagttgttttaaacttttaaaacattttttagttatgaatttattttattttattttattttatttattttattttatttttgagacagggttctgtcacccaggctggagtgcggtggtgtaaccttggcttgctgcagcctcaacctcctgggctcaagcaatcctcccacctcagcctcccaagtagctgggagtattgatgtacaccaccatgcctggctaattttaaaattttttatagagacagggtctcaccattttgcccaagatagtcttgaattcccacctcagcctcccaaagtgctgggattacaagcatgagacaccatgcctggatgtgaatttttatttaagagatagaaagaataagaacaacccaaagattatttaatagaaataactagacattaatcaaaaatctttagtgtaagccattagtaaaataactttccaggaaaattcttataggtttttaccttttgacctactttttctaaacacttgctatggaaaaagtacagtgtatttgaggatgattgttaggaggcagaaaaggtggagaaaagagaggctgggctcagtggctcatgcctataatcccagcactttgggaggtcaaggtgcgcagatcacttaagtcaggagttcaagatcaacctggccaacatggtgaaaccccatttaaaaacaaaaaaagatggagaaaagagatacaaagatttagaggtaaagtgaacttaattgtctgaacaagaaatcaaacaaaagactccaaaaagtttagaagccatccttgagatgcagatttaatgctaaaaatgttggcattttcagaatattacaatgatgaatgttgacagtcaaacagaattttattgttaagcttgtcctggaaaaaccaagaatgtttgattgtctgtgattgagacacagtccctaaatctagtttggaaaagtgacagatgtttcaggttgggatacaaaagacaaattctaaataaggaatgaaggagagaaggaaacatggaggaaattggtgggacattctgtgccatttaaatatcttgactcttgttaatgaatgtctatatagaggtcaaaggtgaggaaaacagacaaatcatgggtatctaagaaaggtgtgttttctatccaggaagaaaggtcaatggaatacataaatatagtgatataaactttaaaggtaggaaaagcccttaaaaacagagtcagtaaagattttgtagtccctggttcatagtcacaaagtagaagacaccaaagccaggaaatacaccactttgtagttcattaccctgctacttctagtgagatgtgtgcaaaacacttgtcagaccttattgccaattggcatttgagactatctacagttcttttttttaataacctcattgaagtataatttaaataccataatattcatcgattttaactgtacattaactgtacaagtgtacaggtttttttagtaaatttttagaaaattcattgagttgtgcaacaaatcaacacaatcccaacttaggacatcaacattatccctatacgattcccggttaccatgaatttctgtttctactcccagcccgacaaccactaatctcctttctgtcctggtagatttcctttttcatatcagtaaaattagaatatgtgatttttttgtgtgtctggcttctttcacttagcataaggtttttgaggtttgttcatgttgcaacatgtattcagatttcattcctctttattgtctaataatatttcattgtatgtattaccatacttttatccattcactagttgatgggcacttgcgtgatttccactttgggcctcttatgactaaatctgctataaacatctacctaaaaggctttgtgtgaacatatgctttcatgtctcttgtatagatatccagaagtagaattcttgagtcatatggtgtgtctatgtttaactttttaagaaactgccaaactgttttcaaaaatgactgggcacagtgtcactttagtgtaatccaagctacttgggagctgagacaggagaatcatgactttacagcccaccccccgagcaatgtgtgatgattccagtttctccaaatccttgtcaacacatgttattgcctctccttttgattatagctatcttggtagtgtgaagtagcatctcaatgtagttttagttacatttgcctaaggaatgatagtattaggcttcttctcatgtgtttatgttgtatttgtacttatatctatgagatatcttctgtagctataactttgacttcctgaattctgtccagaaatttctagtttgggtgatgctgtgatggaaatgcatgaaagtatgcagagtaaacattttttaagggttactaaataatcctgaaacttcacaaaagagaagtccatctactctgctagaattactgtataggaaaactcagtgtaatcattttcataatatttggtagaagagcaggcttattgtaaaaactggggatgtttatttttctttagggcttcatttttctactttttcattaagctaaggataagattaaactgcctggaggcttctttgctttctcagcacaataaaaaagtcaaggaaagacagcaaagcaagacagaattcttcagaaaaacaatactgaagggaaataacagtaacaccaggttagagaaacaaaatccatagaatcaagctttacttgagtaacaatgctgatggaaatagcatgtaagagtcttagttcagggcctattggaaatggatgatagaatttttccaatgtacaagcccactaacagatataattagcttattatgctaacatgataaatagttactgaatatctccctaaattagattgacctcaatctgtaaggatcgtaactttcaacaaaggctcgttttgcttgcaaaaagattcacacaagatgctcagatggacaacataaaggtatttcagaggacccctctccagaaaccaaattggttgtggaggctaggcacagtggttcacaccgtgaagccaggagtttgggaccactctgggcacaaaagcaaaagcaagacctgtctctacaaaaaaaacatttaaaacagtgggcgtggtggcatgcacctgtactcccaactactcaggaggctgaggcaggaggatcacttgaatccaggttgagcctacagtgagctatgattgcaccactgcactctggcctgggcaacagagcaagaccctgtctctaaaattaaaaaaaaaaaaaaaaaaaaagtaggttgtgctgtaggatcacaaaaactttgtgctggttaaaccactttactgcctttcatgaattagtttccacaactaatgtagagtccgcttctttgagagtttcacatgccattgcttgtggctttccattctctggatccctgtttagatctttggtcaaaagtgaccaaggaggcatctttatactattttctccttttattattttctcagctgacaattctttccctcttttgttgattgggtaaggaatatctgagtgttattactactagctatacggcaaccttttataaacttcaatatagcattacaaacattggttgatttgggcatgaggtagttctagaattcttttttgcttagtatggtatattgatagattaggggtaaatgtgaataaaacattgcagatatctttgaatttatgacttacaagtaacctcaatatttcagcctagctaaagacatctttaaaaggtaattttcacctcatctataaatgagagttaaaaggaaaattcttttaatttacatagtggtgttttggcttatattctgttttggtttttcccctttttaagacgaaaagtccaaggaggggatccagatagtgtgaatctgaatccagactgccactggtaaactttgtctagctaaattctctgattctcattcttctcatcagtaaaatgagaataatgtacattatctcacttaatgattattattctcacttaatgaatcatgatattaaattttcagtatcattgaccaataatgcaaacattttcataaaacgtggcttataaatttctatcatccctgatgttaatcagtttttcttgcaaaataattaagtaatgcctgcttttagtattaaaaatttttttaagttcaaaacctactaaaagtctacatttataaaattattacaaacacttaaaaattatatttccaaattatgagagtgtgtagatatgtgaattcctataaggttatacacatatcaatttgggcaatacaattacataataattggaatatttccaaacacttgttttaaaaatgctttctcctagcactagtttcataagaaggtagtacactgtcactcatcatatataaaccaacattactggctgggtgtagtggctcacacctgtaatcccagcactttgggaggctgaggtgggcagatcccctgaggtcaggagggcagatcatctgaggccagcaccagcctggccaacatggtaaaaccctgtctctactaaaaatacaaaaattagtcaggtgtggtggtgggcacctgtaatcccagctactagggaagctgaggcaggagaattgcttgaacccaggaggtggaggttgcagtgagtcgagatcgtgccattgcactccagcctgggcaacaagagcaaaactccatctcaaaaagaaaataataataataataaaataaaccaacattaccaagtgctgacaatgatcttgagcaacctgaattttcatacatccctggtagaaatgtaaattggtacatgcttttgggaaaactgcttgaaattatccactaaaattaaacatgtgtactttatgacccagcatttctacttttaggtaaatgcttgacataaatgaaggctaataagtaacacatctataagaacattcatagcagctttattcataatagccaaacactggaaacatccaaatgacaatagaatattcattcttattgttgtattatattttatttatataatacaatcttttgtattatataatacaaatacatgcaacatgtattatacaattttttgtattacatataatacaattttttgtattacgtataatacaattttttgtattatgtataatacaattttttgtattacgtataatacaatttttttgtattatgtataatattttttgtattatatatactattttttgtatcatctaaataaatatttaaagttgggtagaaggagctaggcacaaaggaatgcatagtgattccatgcacataaaggtcaagaacaggcaaagctcatctatgatgacagtagacaaatttatggttacttctgatggagtgtactgattgggaagggcatggggggtgcttctagggtgctggagctgttctaaatcattatgtgggtcatggttgtacaggggtgtgtgtgtgtgtgtaaaattcattgaactgtacctttcagattttcatgatcattattcatttcattacagaatgtcatagagattccaccatttaaagaccttgtttttataaaattacccatactatcttatagatgctggaagggttaaacaatgagagtagccacaagtagcagagcaccttctcttcctacaggatagatctcacttgtaccaaagctgacatatgactgcctgctatgtaatgcacagtaaatttaaaaatttattattaattaaatttatttctcactgttacaataaataaattgaagtgtagatggtttctgtcctcttgcatgtttctttgcatttattctcagtacatatttttgccccctctttggtcccttcccaaaccccttgctcaactttggaaacttgattgagttacacaacagttgcctaccatgatagtcagtgggatatttgctcaataaatttctaaagcaaaaatggacaattatgccccattatgagttagaattggcaaactctataaaggaccacataatatacattttagactttgggggggtcttatgtctctgccatagcttcttacctctgtagttgcatcatacatagacaatacatttttttaaatggctgtatttcaataaaacttttttatgaacactgaattttatagcatcacaaaatattttttcatcttttttaaaaccatttaaattgtgaaaattattcttagctagcttttgagccatacaaaaagaagtgatgggcagaatttgggtctcaggacttagtttgcagagctctgatttagagtcatgtaattttaagtaataacttgaatctcaaccttcagttccatcatttctagtaggttatcaaattaccatatgctgttagagagtgcttttatttattgttcctttaagaagcactaaatattaagtttaatatcaaaggctttgtttcctctttggcatgattgtaattcataagacttctaataaaagagggtgggtttgtaaaaaattccacagatatttgaggcctagtcattagtagctacagtgtcaataagaatcacagtacttttctgcattatcttaattctgatttgataaataattattttttaaaaacccttcattttgaaaacaatgaaataactaaggcagtatataatgcatttatttgaggccaactggccaagttctgtgactccttcctgggtttctatgggtcctgacacatgaggaaacaaatattcactgacattcaagaaggtcagaggtacaagtaactgctccacactgcatagcattttcaagacaggcctccaagttggttcctctccattccctgcactatttgctaagagacatgaatgataaatctttacatcattgaactgtctgtctcattctcctgtcatccaaaaatcagggtgggatttttctgatgagttctatgtgcaatttcaaaattgttatttctattcagactgaatagtaaaaaatcatctgaaagggtaaatttgaggaatgacatcacactgctttgtgcctcccacccattcactcccaaatgagggatccctcagccacagcagcagaaaaagaggacaaaaggccactgattttccatgaaggtgaaatctgtgctgcacgggctccaaaactcactgcacataactcatcttaagcccatctccaggaacccctcctgggtttctatgctccattctagagtcagtactttgcaactagccttgtctttcctcctttaggatggatacagggtagacttgggagacctgaaacaagataaatatagagtcaacagaagaacaaactcaggaggaaagccaactgggctcaaatctcggctccactcttcattgtagatggaaatagacacttattgaatacctgttctgtgctggaaacttcacataaactgttccagttgttaaactaaacaagaagagaggaaggaacaaaaggtgtcccttatttaactcatgtacaatagggaagaaaacttctgaaggaactgcttcaaatagggttttgtttcacatattattcaagcgaccaggttgactttgttgaacttctgattccatgacaacagcaaactctgcatgtgtgctcagggtttgacatgctgtggtgtactctctacctaaaagagtacgcagcataatggttgtgaatctctggaaatcagggtgtcgcttctgttttccagaagatgaagatgccagaagggcttctgagcaatgtgctatgagaccacctatggaagagagagaacaactctttaactgtggctttacttagtaaacttccaaacgattactgaaatgtcatcattagacaacgtaagcaactagcagaaaattcatatgtctaatgcagcctcctcattctttttctgtctttccctgtgatccaggaggaaggatgctggtttcttatcatacaaagatcacctgccagtgagccaagtggtggttggagatactgaccgtcaaggctcagaagccaaattgagcgtaggtcctctgcgctgccaaggagacagtaagtttgcatagcagctatggcttgcactttcttatcccatttaaatattgtttccaggctcctcagaagatgcctgcaatcagacttgctctcctgtagctcctacagaaacatcacacaacccaagcagagataacttagaggaggggaacagccataaagcctccagtacaggagccgagatttgggcataaagtggggatatccatctttcctctatattcatatgtaacaagtttgactacctaagtttatgatgatattaatagcaatgctaatagcataaatgcagtactcaacagctgtgattccacggagtgctgctgttaatgccattaggatgactatttatatcaccataaaccgagtttatggtgatataaatagtagcattatggcttaatgtatcattgtaaacttggattatggccatataaagtttgacattattgctatcaaacttcatcatcatcagagcttgatggtcccttgtaagccaaagattgtttctgttaactatgtcttgctttcaagattagtcaccccagagaggaatttggggctgctagcttggacagtgggaggtaagggagttggagtgatggtccctcctaattaagggcaccattaggattttatgttgtttgatacccttcggtgtgctttatgtgcagtcagagggaaacagtgacatggttgcactgtggggattctgcagcgagcatcctgggcatcgttttctctcttctttctgggacacgtggtttaggcaactctcctgagagttctatgcttttgtgattgtgtgctaggcatccggagacctagattctgctccccaaatagctgacttgccaggagacctcaggcaaacccctccattgtcttagctgtggtaatgagaataccacacacatcccaattcctcctggggaggctgtgaatattttagtgcctggatttggattcctcctagcaaagcattatgtgagatggaatattattaccactttgtaaatcaagggagaattagacctacttgataataaattatagcgtccactcaaagagatgtcctaaggaacgtaatgatgcatgcttaacagtttcctacttagtaaattgaggttgtcagcaattaagcaatgccatgttcctaatacaaaagggagatggactttgtactgatttttctctacttacattgaaaatgctacctgtaaaattgagactggtcaagatctttatcacgcacttattgaacaataatacttcatttgtttagtcaggcttagtaaaactgtgcagaagaaatttaatttcaactgcctaagaaaaggatattcacctaaagcaatagtatatatgcattttaaacaaatattataagaaatgaaatacagtgttgctctaaaattaggaagactgtcatgtgttgtctaatgaaaatcatttttgttatggaataattactcattagcatataaaggtaaaatatttctggcttaccgattctaattctgaagttagctttgaatttgagaaagtgttcccattaaataattgattaacttaatatatttataaaaattccacttctgcaaactttttttcttgtctgttttgttttgctttattttctttttttgagacggagtcttgctctgtcgcccaggctggagtacagcggtacgatctcagctcactgcaacctccgcctcccaggttcaagtgattctccagcctcagcctcccaagtagctgggattacaagcacacgccaccatgcccgactgatttttgcacttttagtagagacggggtttcaccatgttggacagactggtctcgaactcctgaccccgggtgatccacacgcctcggcctcccaaagtgctgggattacaggtgtgagccactgtgcccagccttctgcaaacttttattaccattcttaaaaaaaagattctaggaacattaaatagtagatgctgcagtatatgagcactttataattaatattagcttatttgttcttaataaatcagcctcaggaagaatttattgtgaggctgtcattcatctagaactttcctaggtgctctggaaagtaagaaaaagaagttcaaaccatgttatgtgaaatgaacatgaaaaaatattggaaaacacaaattggcttataatttaattttaggctttgtaatataaaattattgcaactgataatcaagaaaggagccatagaaggtgtatttcaggcagactttctttttaaaaaagagaaaatgagaaaagtatagtggtcattgttcatttgcatttctattctagggctgttgttcttagaaacatttttagaacctattatcaaaataaacttatttattcacattacatgatctcagtatacttataattactgtaacttcagagaaactcttttaaataatattttacctgatatttcatgaaagcaaaagcagtcaacagttaatggcaattatgtagaatacttttgtgtctgtgtgagagagagaaatctcattgttttccaggcaaccgagaataagtatcctacctggtactcgaattgcctggtagcagtcagcagttgtgaagcccatgttccctttaagaatgttctcacggccgggcgcggtggctcacacctgtaatcccagcactttgggaggccgaggcgggcggatcacgaggtcaggagatcgagaccatcctggctaacgcggtgaaaccccgtctctactaaaaatacaaaaaaaaaaaaattagccgggcgtggtggcgggcacctgtagtcccagctactcgggaggctgaggcaggagaatggtgtgaacctgggaggcggagcttgcagtgagcagagattgtgccactgcactccggcctgggtgacagagcaagactccatcttaacaaaaaaaaaaaaaaaaaaaaaaagaatgttctcacatggacacagtagtgatagagtgttccgtatcaactgcattttccagtttttatacatatgtgatctccctggttacacacagcctcctgtgaattgggcagggcaaatattagtctttctgccttacaaatgaagaaaatacttctttgaaaatggcatttacacagcaaatttctgagcatactttcagcctctgagaggcttcaggacaaaagatggaacagagaatagaaatagctgtgtctgtacaaggtcagagttgttttcccaactgtactctcatccctgagccaattgttgattaaattaaaatgccttaaaatgtttcatttgggttttatcccaccactagcctcagccacacatgtcagttaccaacatagtacaaacattatagggattacatttatgtaatttaaaaagtggcatagtgcatttttcctgctgtttatagagatgaacttactttgtgtcatttactgaagtctgttcaaacctacagcttataaagactaaacctattgttgaaaaatatctttcagtttgaggagttgagtgatgacagccctcagaacctgcctcttgaattaggccccagttccatcctctagtctcagagaatgaaaccatttttgtgggctctgcccaaccatttcagcagttttggttgatttcatcatgcctgctgagtttcatttttgctttgattcgtctgaactcagacccatataatcaaaatgctaaagaaaatcagtgcatgccactcagatctgctgcatttcccatatagttctgtgaaatgcttatgtccttacaggtgtgtgtgtgtgtgtgtgtgtgtgtgtgtggttttttttttctttcattctttcttttttgcaaagcctatccaaatggaaacttcaaatcaaatgacactgaaagtatgagtggtgacggatggttcgctgaaataaaaagtgctgtgaaaatacaaatccccctcttaaactacacgtacgcacctagaaagaaacaaaagaaccatttggaagattaaaaatcaatgatcaggtagacattgtttcaaattgaaatatgtaatcatctttgcagatggctgccaaactttcatactttcatgaaattagttaaaaaaataaaagacttccactttttggaggtagaaatctcatactatatatgacgaatataattaattgtaggaatatagtatttgctagacaattgctttattttcagccatatgatgtaaaactttactgtactcctctagggatacggggactgtaaataaatactttggagcaagtttgtcagaaccataggaaaggtttaaaaaaaaatcaaatgttttcagtaaacctgggtagaaacaattccagaaaatgtcttattcaagggcttcttccaaggccatgccagaaacactggctgtgaagctggcagacagagcactggagtcacactgcaggattaagatgcaaattcagtttctcagagctacggaggtgacccagagagacaaggaaggaaaggcaaggcagtagtgacacatctagttctggaacactcagaggacagacaaagctgtgtgtaaacaaataaagatactgatggagattcatcaagatgatggtgaatatttgttctttgggaaagttattttatgtgccagactaataggaaggccattatcttttttttgcaagaattttacaaaccaggatcataacctgccattcccttgacaggagagataagatggccaggcatggtggctcacacctgtaatcccagcactttgggaagccgaggcaggcagatcacttgaggtcaggagttcgaggacagcctggccaacatggtgaagccctgtctctaataaaaacacaaaaattagcagggtgtgctggtggccgcctgtaatcccagctactcaggaggctgaggcaggagaatcatttgaatccgggaggtggaagttgcagtgagccaacatcgtgctgttgcacttcagcttgggtgacagtgtgagactccacctcaaaaaaaaaaaaaaaaaaagcaaaaacagacaaggcaataaggcaatgcctcggtctccacgttgtttctgtaccaatgaaacatttccaacaggggcgcacatggcagtaactctctttcagaagataatacccacgagcatacataggccacatactctgtgcagtgaatagggactgaaggagaaaccacttctcatctgggttcaggaagcaattctccttattgagaggaagcagctctccaggctccagagaagagttcaaaatttatttatctcctttttctttgctgcttcaggcttggaaaaggcaagaaaggaaaagggactagcatgcaggttctaaaccaatcactttcgattcattttctctcttgattctctcaacatcccttaataggtgatactgttgacaaaaaaaaaataaaaataaaaataaataaataaaaaagtaccctgtaaaatatttaaagaggtttatttaagccaaagatgagtggccatggcccaaggtacaggctcaagaggtcctcagaacatgtgtccaagggctacaatttggtttttatatgttttagaaagacataagacatcaatcaatatatgtgaggtatacattggtttagtctagaagcaatgtgagagtgtggcttacaagtcataggtggatttaaaaatgttctggttggagattggttaaaagagttaagttattatctgaaggtctggaattgatagaaaggagcatctgggttaagataaggggttgtggaggtcaaggtacttattatgtagatgaagtctcctaggtggctgcccttagagacaatagatggcaaatgtttccatttagacctttaaaaggtgcttagactctcagtaaatttcttctggattttgagggcctggaaggggaaagatctagttatgttgatagagattattcatagatgtgaattttcccccacaaaaaaactgcttagcagggtcatttcaaaatatggcaaagaaacatgtttgggtgtgaaatctttttatttcttcctttttctgtcatgtgatgttatgctagagtcaggttaaaatttggtatcttattgctacagtctgtaaactgtcatggccctggtggaagtatggcagtgaggacaaccagaggtcactcttgtcgccatcttggttgtggtgggttttagccggcttctttactgcaacctgttttatcagcaaggtctttgtaacctgtatcttgtgccaacttcctatctaatcctgtgacttagaacttctaaccacctgggaatgaagtccagcaggtcttagccttatttcgagatggagttggtgcttagatttttagttttggttcacagtacctttgactccagtgtactgatgaggaaacagaaacaatgttattaggtgctttgccaataagtttcagagttcagactggaatctacctagttccaaagtcctcctttctactctattcaatcagagctgatgttaggataaaaatgggaagaaaaaaaaatctcttatgctctcggggagtggctgggtctagctgtttgctaatgagggggtctagggaaacatccctattgccctgtgaagggtcactgaaaaaccaactcacaaggcaggttaatagaagaaaaggcatgcaaattttactacagggagaatcacagaatgatttctcaccccccaaaggagttcagaagcttatatatcatcctggaaaaacaggttttgggagcaggggaggagaggaacttcactttcactgtcaaaaggactatttactggctgggcgcagtggttcatgcctgtaatcccaacactttgggaggctgaggcggatggatcacttgaggtcaggagtttgagaccagcctggccaacatggtgaaaccccatctctactaaaaacacaaaaatcagctgcgcatgttggtgcgcacctgtaatcccagctgctcaggagactgaggcatgagaatcgcttgaacccaggaggcagaggttgcagtgagccgaaatcacgccattgtactccagcctgggtgacagagcaagactctgtcaaaaaataaataaataaataaataaataaataaataactatttacaagttcatctctgttcctagatccatttattctctctggtaatcccctcaacagaattcctcttctctccactcccataatctatttttccaggatggtaaataagcttctgaacccccactgggggtggggggtggggagtggtaatccctctggggctctccttggttctccacatgtacatgttaaatcaatatgtatgccttttctccatttaatctgactcttgggagttgatttatgtttttactttttttttttttttttttgcgaatcttcagagggcaaaggggaagattccattggctcttacactggcaagctgtgtcttctaacttactcttacatgaagggctggttctgaaagcagagataaaaaaaggataggtgacaaaaactgctcccagtcccatgcttagtggagaaaagatcccccttgattttgcacccctctttttgacaagtcatcaaacaactgatctttttccacttactgcatctattttggctcccctaacagtgtacttcttaaaagtaaaaacaaaatctaattcacttgtatattctcagtagtatcacatgcctaacacctagaaaggattcaacaaatgtttgttgaatgaggaagaaaaataatacatcagagcagagggagagtgataatgccaggtttggcctgaaactcagcttctgcccttagggcactcatcaccccaagcagagaaatctcagggcgctggggctttggagttctctaatggagccacaggtgctgggccaactgacttcctacatgaaatctggattttagaccctgttttcctagacccctcatttcctgcttgggtacagctcttgcctctgccttttcttttttaaagttttcattacactgtgtactgatttctggctcactttgcttccctactattgttctgaaagcttatctctgattcagccccacccagaaaagagaggttgcctcaggcaatctatgtaggatgataataggtgtattaccagcatagaggaccactttctctctgtctctccattcctgccctggccattaattataatacattcgatttacttgggtttggtcttcagccctcatgcttttgcaacatcatgatgggctcatacatgatttttaaaaagagcattaacatcacaaatctcagaatgggtaacgtttgatcattcccagtaactatttcctgagaagatgctctaaattgtttttctttccccattttttcccacaaaatgtggctgtatatttttgcctcacgtatagctcaaaacaagaccaagaatcacagtgtcctaacagtggaagcgtcttagagatcaaccagtgcagaacctctcattttacagatcaggggtctgggtctagagaggttaagtgactggcccaaggtctcagagctggtatacagcagagcacatcgagaaacagtttaatacagccttcatccttagtaattccccagggccaagatgaatgttgacacccaaagaggaaactttgacctggaacaatgaccttgggtctctgcctatcaacagctgagtgggtatcagaactcttaatcttactccatcatgagatcaatcatctggaaatcttgatagaaaacctacagccacagaagtgagggtcagtggcagaaagttgatgacttctgtttttttgttatgttttttgtttgtgtgtgtgtgtgtgtgtgtgtgtgtggttggttttttttaactttttagggttgataatagaaggcatgaaaaaaaaaacaaaagcaaaaacgccctggagtgatgtgtagaaatcattaagctctattttttcttaatgtcccagccttcactgctattgccatgggctactaacaactgagaagcagtagtgggtctaagaacaagcagaaatagtgaaattttcaggatcacaacctaggctgactcccattaatggattgagcccaccgggcatttctgaggtcaggtccaattacaaatgctgtagcttttacaagtagatggaagccttcccttttatcttccagattccagagtgactttaaacaattagaagaaatggacaattcctgcgaaggaaatcagctctttaagattactcagttactcaacttcagctgcaaactcactgttgaaatgggacgtaaaattggttacagtttggaaaaaagtctttctgttttacaattgacatgatatttgtgtgcgtgtgactgattttcttacctgtcctttcaaataccatttgtatttggaggaatcgtcacatgccacagaggaattaacgtgaatgagctgatgccagacttggttctgcaggtctgtgttgtcaacaaagagtcaaattctgtaaaatatttgaagacatttattctgagccaaatatgagtgaccatggcccatgacacagccctcaagaagtcctgagaatgtgtgcccaaggtggttgggacacagcttggttttatacattttatctattttatgttattttattttatattttattttttgagacagagtcttgctctgttgcccaggctagagtgcagtggcatgaccttggctcactgcaacctctgcctcccaggttcaagtgattctcctgcctcagcctcccaagtagctgggactacaggtacatgccaccacaccccgctaatttttttatttttagtagagacagggtttcaccatgttggccaggctggcctcgaactcttgaccttagatgatccacccctctcggcctcccaaagtgctgggattacatgcatgagccaccacgcctggcaggttttatacattttagagaggtatgagacatcaatcaaatacatttaagaaatacgttggtttggtccagaaaggcgggacaactcaaagcggagggtggtgggggtaggggttccaggctataggtgaatttaaatattttgtgattgacaatttgttgagtttgtctaaagacctgagactgatagaaatggaatgttcatgttaagataaaagattgtggataccaaagttcttttgaagtcttatagtggatgcccttagagacaatagatgacaaagtttcctattcagatcttaatctctttaggattgggagggtctagaagaaagagatctagctatgttaatagagattctttacagatgcaaaatttcccccacaaagaacagctttggaggcccatttcaaaatatggctaagaaacatgctttggggtaaaatattttgattttcttccttgtctcataatgttatatgagtcaggttggaaaataagtcacaatatataggttaaataaaacccatctgatgaaaatttattatttgtagggcatgactccccacacctcttagataggaatttgggcaagacttaaaaaaaaacaatcagagtttagtcctcagtgtggctggatgggttctgcctcctccatgtcctctctctgggtgcctctcccttcctgaacttgttactctctgcagaagaaacagcatccccagatgcaggcgggagatttctctgcaaattgaatccccgtaatttggtttctctgctgaactctctgaccaatctctcaccatttgaagagaattagtcttggcctattggatctaaacatccacagtgtggagcatactttggaagtgacagaaacacggagtgaaatagagtctaacctattccaggatcagctcctgaaaacaaattcaacctaagagactttattgagaaaaacgagacatggctctgatcctggatcagtttatgtttcagtgagggtgaaaattttaacaaagtggaggagattaggatggaagtttggattcctagtgggactttgagtggaaagctgagaggcctcatgtagttgtgctttacaaacattaatgtacttagaaaccacctgagatcttgttaaaatgcagattctgattcaggaagtctggagcaggacctgagatgctacaaggtgtggctgctgctagccaacaggccacgcttaggccagcaaccttacatagcagcatggtgaacagcacagactttggaatcacacccacctgggtccaaatcccaactttctccctcactaaccatgtgcctttggacaagttccttaacctctctgggcttctacttctcacccagatccttacctcagctgcaaatgagaataattgtaacatcactgagtttgctccagtaaagcctgattgtccccagtccttgcacatagtcagagctctctaagtgttagccaacatcatcattcttatatccatttgctgtggaaaaagtggcaggcttgatatcagaaaagctctgcccatcttcctgctccatgttcctgtccctgtacccttgacttcatgccttttcttggagaagacaggcctagtctcaggtgacagtgtagcatccagccatttagcttctcctaatttggaggtgctggccacaatacctgattagagctcaactgcattttctgagtccccagggacaatgtccttccacataagcaatctctcatttccttctcatcatgtggatctcagcttcgatgttaattcttctaagaggacttctttgtccactcagctgacatagccactcacacctccctacagcccttcttaattttcttcatagaatgtgccactccctggaattatctctgcaatgcacaactcaattctgacaccaactgccctgagttagcacagccttcacaagttaaaagcacagtccccaacaaaacagccttctcttcacacaccagctgcaaacttgggtggctctcaagccactcacatttctgaccaactgactacaaatttggggttgctactattctttcagggtcaataattcactagaatgactcacagaactcaggtaagtgctatacttataatcagagttttgttataaaggatacaaatcaagtctagccaaatgaagagatgcacagggtgaggtcgggggaagcttcagagacaagagcttgcatgtcctctccctgtgaagtgagaattgtaggagttaaagaaagaggaaagaaacacaaaaggcagctcaacagtcaaagacaggtttattttggagaacaaacctaagaggggcttctggctgatttcagtcaagagcactctctcttacagactaagagtatttaagggttttagggtgagagagcttatcacaggcttggactgtttctgtgtggaagagaagtttattgcagggttgaaatgtctctggttggaggggggttatcttggggctgacatctctccggcctctctggccagaggggagattatcttggggctggcatgtctctggctggggaggggtttatcttggggttggaatgtttctgattggagatatcatttgtggtttatggtcatgctgaccttagcctgatgccctttggacttaggcgatttttttatcaaggggaactttaaaatggcggtgcttgtccaagatggtgatgctcctgctctgtcaagaattccctactcttctggtacaccagtgtgcatcaccaaccagtgacgctcacccaggctttgggtgttcaatgatttattgggatctcattctgtaatcatgattgattaaatcattggccacatgattaaatataatgtttagcccccttttcccctcctccctggagatcaggctgatatcaggaagctcaaagcctcaaccctctatcaggtggctggtcttcctggcacacccagcccccatcctgaaaccacctaggggcccaccatgagtcaccttattggcatggacccaggcatggtccctggcgctcactatgaataacaaacactcctatcacttgagaaagtcctagggtttagaaacttggtcccaggaacctgggacaaagaccaaattaatgacctgttatgagtcaatctcttttctctatttatttgctttattgtcaccattgtccctaacagtagacgggaatctcaggcagaagtctgtatcatggtgccaaggacaatgcctgccacattgaggcactcagacatgtgttcattaaattaatatgaatggttaaataaccacaaaagatgatttaaattagcatttccaagtaacaatggaggcagtgcatgaggcacttcatgataaattgcagaaaacttgcacagacaataattgttataaaggtccaagagaagcactatcacttgatttatatgcacaactatttttaacctcaacagggttttgcacatttattcatcttaactaaatgaaaacttttattcctttgtaccttgaaaatcccttgaatctgatgattatctttaaattaaggattaaaaaaaaactcttttgctaagtttttatacattctttggcaattctaaattaagatgcacatgaagtattaaatttatataactcattgtttaatctaaattagattaacccccttggcccttcagagatccaagtagaggcttccatacttttgtttatccatgtctcaaggttattactgacaaaattacaattagtcagtacttcatgtccattgttagggtgctaagctgtgagctataaactacctcactctggcataattaaaaccgtgttccagttcacctattttatgatacctacttggctttccataaagcttcttttcacactcctaactatgtgcaggtctgggaaacttgggaactttactgaagaaaactttaaacataagcttcttcttgaagtttgctgatagttctgttatagcagtcttactatcatcaggataaaaaaattgtactaaactattgtaaaaacataagatttgtattactacctctttttttttttttttttttttttttgagacagagtctcgctctgtcacctaggctggagtgcagtggcgtgatctcggctcactgcaacctccgcctcctgggctcaagcaattctcctgcctcagcctcccaagtagatgggataacaggagcatgccaccacacccagttaatttccacgcccagttaatttttgtatttttagtataggtgaagtttcaccacattggccaggctgatctcaaactcctgaccttaagtgatctgcccacctcggcctctcaaagtgctgggattacaggtgtgagccaccatgcccagcctctattactacctgtaaaataaatcctaattcaaaagtcgccatgtgtatgtacataggaaatagtgcatttgaactggcatttacctactggcataacaaattgctctttggaatagatgcctagtcccaagttaagaagaaaaggggactcctgtgtcccatccatagtttctcattaagtccaagagccaattgtgctaaagtaaatgaatatcttcaagctaacctataaggggtggtgggaatattagttgctagaccaacacttaatcaagaatctctcacactgtctaagggtgaatagaacaactagacttgtagaggattgcttaatctttttatgaaaaagtcatgtgccaattaagattctagccatacctccttcagggttttcttgacttactcaagctttagacaatgaagtggctcaataatcttttctgtaatccctatgtctaatgtattaagtattccttaattcaatttggtagattaccctaatcgattttgttttctggtatttaaacctttagaatttaattatattatactgaataggatacaaagtaggacttgagcttaaaagatggcctttcatttcacagaaaagaaatttatatgtcaagtattttgctgtggtattctcattgacatagctgagatgataatgtaaccagttcacgacgtcaggattgctatgagagaaccccgttactgggtgcttgatttgctcttttggtttatccaaagatactgagtttgctctgactgcctcggttttctccattttaacaaaggcaaaaaccaacactttgtattaaataacctaaaccttggcattgaacttgtcaaaagagaaaatgacctgaacattagagccaagaagatactctgttgtattttactttgttacttaggtatctttatttattctttacttatatatttcaaaaagacatagccttcctttatggaaaaattcatttgttattatttaagtacaacagatagatagatgctccaaaattaagtctgagtgttttctttgcctgcagaactgacagtttgcttggcttatgctgataatccccaaaaaagtcgcttgtgtcttgaacatccataggaaataaaactgtagttccgggcagtgtcgataagaaagcaaactttacaccttcacttaggggttgagaaagagaatgagctattgattccactctgaactttagatggccatatcacatctgaaaccagtcatttcgtggtgggcagtattaaacccgactttgtcttatgactttacaaattagcgaattatgttgttatgataagagaacccaacaaaagtatctgagtttggaacatcaattttcaggatgttatatatttgagaacacttctccactgctcctctaactcctctagcctacctaactttaatagccaggcctccttcctacctgtttccttcccccttcacaagaagcacctattaaggaatcaagaaaaaaaaaaggatgacacttactttcggaataaagtaatatagtctctactatttctgctttcacacagatttgccctcctttctggcacaattacacatacacacacacacacatgcagatatacttacgtatgcacacatgcaggtatgcttagaatttagcattaggctgggtgcattggctcacacctgtaaccccagcactttgggaggccgaggtgggaggattgcttgagccccaggagtttgagaccagcctgggcaacatagcaagaccctgtatttacaaaaaaataaaataattaaccaggtttggtggcacatgcccgtggcccaactacttgggaggctgaggcaggaggatcactggagcccaggaattcaagactgcagtgagctatgattgtgccactgcactacagcttgagtgacaaagtaagacctgtctcaaaaaaaaaaaaaaaggaacttggcatttgcaatcctgaacctactttaacccaaggtaatatggtttggctctgtgtttccacccatatttcatcttttagcttccataattcccatgtgttataggagggacccagtgggagatgattgaatcatggggacaggtctttccagcactgttctcatgatagtgaatggctgtcagaagatctgatggttttaaaaatgggagtttctctccagaagctctctttttgcctgctgctatccatataagatgtgactttctccccttgccttccaccatgattgtgaagcctccccagccatatggaactctaagtccaataaacctctttcttttgtaaattgcccagtcttgggtatgtctttatcagccatatgaaaatggactaacacacaaggtaaccacaactcagggcttaaaacttctggacaccagtgtagttggaagatatagagaggaagctgaagagaaatgagaggcagccttggaactcgttcctctcagataagggggaactgctatagttgtactcatgggtatgactacagcaaaaggatacaaagcaaagtcagcaaaaggaaacgtgcatgagatgaagtccagaggaaaccaaacacaagcttccaagagactcccactggagtccacagaacacacttaattcccccagctattagttgtggcatcatgtgtgaaatgctgtctacaacagaggctcactagagactcagcacccaaggttttattgggtactggtcacaaaggcagcccctaccaggcatgcacccaaaacccagactcccagaagaaaggcagttgtttagcacaaaccacattgtttgtaccaacagttcagcatagtggggcattcttattaatcagttaaccctcctgaaatctaacttggtgggccagccatgggaagcacttctccagcacaaggatgctgcctctctccttcccctgctccccaaacccttctccacactcttttccctctcccttccatagaagtattaagaagatgtgggaacatccagatcttcaacctcacaccaccctgcatcacactcctgacaccatcatactccacttccacctggctttgtcctgcctcttctaattcttttgttgtttttttttttttgagatggaatcttgctctgtcacccaggctgcagtgcagtggtgcaacctcagctcactgcaagctcctgccattctcctgcctcagcatcccaggtagctgggactacaggcgcccgccaccatgcccagctaattttttgtatttttagtagagatagggtttcaccatgttagccaggatggtcacaatctcctgacctcgtgatctgcccacctcggcctcccaaagtgctgggattacaggcatgagccactgtgcccggcctccctgtccgaattcttagagaaggaaaagaaaaaagactgtgctcttttcccttgagctgatcctttgtatctcatggcctgcagtttctgctgcatccattccccgggcagcaccagctacataatttgcaaagtccagtgaaaatgcaaatgcaggaccatttgtattgtgaattttaaaagagagacaataaaccaggtgccaggcccttctgaggctgtgagggtcacacacctatgtttctacgtgctagcgaaagcacaaggtcaaccctagattctgaatatcactggggcatggcagaccttgcagatgtggatctgcaagcttggtttctctaatagctttgaaccacaagaaacatttatgtgatgaaaaccaaactatatatggcaaaaatatttaacacaggggcttcttatatgtactggcaaaccatatcatattattgagttttccctaaacttgattacagaaattacctggggttcttatcaacatgcagattcccacacagctcccctagagattttgatttggattctccagagtggagcccagtaacctgtttttaagaagttttctagaatatttttctgacagggaaagtgtagaaacttaggctcagaatatttgggggcagacaggcctatgctgaaattctccatttatcagcagtgtgacattgggaaagttatttaatttcactaagcttcaatttcctcatctgtaaaatagaaataattgtgctagtacaaaaggttgctatgggaataaaatgagacaaatgtctgtaaagaacttagaacagtgactgctacagtaagctgtcagtaatcgtagttataaatattacagaaaaagagtagaactcatttaaaaccctcagttttgtaatactagatgaattaagcttaaatgcaaattgctaaaggcaacagttatttctgtcaaattaaactcattcagaaataataaattacaatctgaagtgaacaaaaggctcaatcagtcatcaatggtaaacattttgagcactgctatggtctgtttttgtctttccaaaatttatatgttgaaacctaatcacccacatgacaatatcaggaggtggggctctgggaggcaattaggtcatgaggccactcccattaatgggattagtacccttgtaaaagagaccccagagagcttattggccctttctgccatgagagacttcagctggaaggcacgatccataagccaaaaagtagaccttcatcagatatcaaatctgccttaatcttggacttcccagcctccaggactgtaagaaataaatttctgtttttcataagctacccagtttacgatattttgttataggtagcccagacacactaagacaagcaccttgtgttggcagtgtcacgatgcctccgttcttgtcttcttagtttaaaagaatttaaacagctgggtgtggtggctcaggcctgtaatcccagcactttgggaggccgaggcgggtggatgacctgaggttgggagttcaagaccagcctgaccaacatggagaaaccccgtctctatttaaaaaaaatactgaattagctgggcgtggtggcacatgcctgtaatcccagctgcttgggaggctgaggcaggagaatcgcttgaaccgggaggcggaggttgtggtgagccgagatcacgccattgcactccagcctgggcaacaagagcaaaactctgtctcaaaaaaaaaaaaaaaaatttaaacaagagacgcacagtgaagcgggtgcagcataatttattgcaaaagaaaaagaatactttgaaagttaagtgcagaatagacaggatgctctgagagagagaggagtcagggtgggctgccggggaggatgagacagaaaagattggcgggagggagactccccttatgggagtcttacctgattattcctaaggaggtgaaaagaggtgttaccagtaagcatgttctgggtggttctctgggtgcacatgcgcagtagccgcacatgcgtgttcatacgtctcatgtctcattaacatcttaaatctccacctaggggtgtattttataccattataatgaacaaagggtcagtctgaggacggatgaaatcaaagtgcgcatactctctacagggggagtccctaatgaagatagctttgcttgaacgagctcaattaccaagcgaatgctggggcttattgtattgactgtgtggtcaccacggttgctgcgtcctaagaacatggtcatttcttttttcttttttttttttttttttttttttttgagacggagtctcaccctgctgcccaggctggagtgcagtggcacaaactccgctccctgcaacctctgcctcccgggttcaagtgattctcctgcctcagcctctcgagtagctgggattacaggcgcccgccaccacgtctggctaattttttgtatttttagtagagacggggtttcaccgtgttggccaggctggtctcgatctcctgacctggtgatccgcccaccttggcctcccaaagtgctgggattacaggcgagagccacggcgcccggcccatggtcacttttttgactacctatcctgcctcattgatagcaggctgcagatacagaggcgtgaccgatgatttttgcaatcaaggaattgatcatctatttcaggataagttagagaggtgagaagatgcatctctttaaaaggaaacacataaaggttaaagggcaaagcaaagagaatgagtaaagaccattttccgtggggattggtggagtgggtagaaggcttgagctggagaatattagacaatgattagccaaacgtaaagaagcaaaagtttcctgtagaaaaatatgcaaacatacacagtaagcattcagtaaatacttgaatgagaaaatgagacctgagttggaaccagaaaaaccgacaaatgccaataatcccagagctgaagatagtctgtagacagtggggagtttgttagccagaaataggaggggtgagtgggaaatctttaattaaaataaaacctttaatctttaattaaaatattaaactcttcacttgtgcttagttgcagagatctatgcctatgtagttttttaaacaaataaaacaaacattgccaataaaatgatgtaattcaataaagggcttacagtaggttccacatccaacaacgctatactgaaaatacacaattaaaacttattgttatattctcattatagaagtctttttttttgagacagagtgttactctgtcacccaggttggagtgcagtggtgcagtctttgctcactgcagcctctgcctcccgggttccagtgattctcctgcctcagcctcctgagtagctggaattacaggcacgcaccaccacacacagctaattgttgtatttttagtagagacggggtttcaccatgttggccagatggtctcctgacctcaggtgatccgcccacctcggcctcccaaagtgctaggattacaggcatgagccaccatgcccggccagtagaaatcttttttaagaagacttttaaaagctactcattttagacaagcctttcttaattgtgtaagaatgcttggaaaaaagtagtattttactatttttaataaatctgtaaaattattgatgactgctagcttttctgttttgcttcatttataagtgaatgaacagtgattgttgtgggttgaataacattccccaaaagagatgttgaagtcgtatcccctcatgcctgtgaatatgatcttgtaggaaatagggtctttatagatataatcaagtcaagatgaggccatactgaattggggtgggccctaaccctatatgaccggtgccttataagaagagaaagcgcacacacacacactctcacacacggggagaacactatgaaaaaatggaggtagaagttgcaattttgcagttgccctgccttaagccaaggaacatgaaggattgccggctactgccagagcctgggagagaggcacgggtgaacattctccctcagaatctgcagaagaaatgagccctgccaacttggactgtggatttctacccccagtactgtgggagaataaatttctgttgatttgagccacccagtttttggtactttgttaaagtagcctgaggagcctaatacagtgacttcctaatcaaagaatgtggaggcgcaattcaagtggtcttttcaactccaagaggattgggctgtgtttgttatggttaaaggaccattagcagttgttgaaaggataaagggaaggtacttcagtctgatgcggagtcagtgaggacacccaccgctcccctgcagagcagtgtcttgagagagaaagggttctcctctctgtaggagaagcaagctccattcctggtgctcctctgtatgatgggcatggctacctatgcctgccctccagaggggaagaagcctttgtgtttaggaccccgggatgatgttgacagctatgatcacataataataattgtatgataatgattgcagataacatctgttgcgtatctaccatgtgtcagatctagttaagcacttcacaaatcaactcatttaatcctcgcaagtatatagtccatgaaggtcatattattacccttattttacagacgtgaaaaccatgatagagattcagtaatttgctccaagtgacacagtgaatgacagagctggaatctaacccaggcaaattggctccaaagcccatactttcagcctttacagtttagcaaggctgcaccagaccccaacaaaaactagttcttttgtataacaagagaaagattccctggctgaattctagcagactagattcctcagtgccattacgggctgaggacttacaaacatgaggaaaagataatggctagtttggttttctaggtctgccttagcaaattaccacaaacttggtggcttaaactagagcgacttctctcaacagttctggagccagaagttcaaagtcaagcatcagcagggccacatccctctgaaggatctgggggaggatccccttcttgacttttccagattctgggggctcacggcagcccttggcttatggcagcaaaactcccaactctgcctgtctccacaaggatttcattgtgtgttcaagtgtcctttctgtctcatgtcaggaaagtctcattggatttaggacccacgctaatttagtgtgatctcaagtgatccttagcttaattacatctgcaaatacccagtttccaaattaggtcacactctgaggttctgggtggacatgaatttgggaatggggaatgatattcaacctgctacaatggccaagaaacatctacctagttcaaaagagaacaggatctactggaaagcttctcagctcttggagccccacaactgtgtctcctgggtcctagccttcagcctggctctcagcacagctctttgcggataacatggctctacactgcgtcgaacagatttggtggcagtgactcacctagcagagttctcagcagcccacctggaaggtcccatcacattgttgttattgcagatagcactttcactgttactcaattttttttctagtatcttgtgaacaatgtgtttcaaagtataggacgacttggtggttaatgtcacaaaagcaatcattggagttgtcaatcacagaatgacattacataaaagaattaggactcttcttgctcaagatgctttatacatgagcataaattgagagttatgtatatttggatagtagaaaagctatacattaatgtgcatcttaatgaggatgattttcttcttttgataaccaatgtgtctatgaagccatctagctaggtactggtgagaaaaatgtttcaaataaagtatttttattggagcatataaaagagttacaaaaatatttctgtaaaattttctggtctatttttttcaggttggtactttttaatggtttagctgttaaataagcttcatctattaacttgtattcagaaataagcttaattattcatcaattcatgctcaccttatattttatggttttccaaatggatgatatcttctatgtctgtacattttttattaaacataagtcattttatgcccataaagcttattcctgaaaaaattattttgctactaaaaaagatcattaagttcacaaattttctctccatggcttgatgctgctatctttctgcaccataattagttgcatgtatagttaattattatgagaaaagcagaacatctcccaatttctacaagatacttagagtttgatggtttaactatgttttctccttcatttctcccatccaccctccagccacgtgtattttcatggtaggaagatgataagcatacgctttttcaaaatgacagcaaaatgttcatcaggaacttcataaagctttgatagactgaatatatatttagaaccagcatttcaatggctctttaccttttcttaagaatttccttatctatgaccctcattgctagaaaaaaaatgcgcacttttatataaacacaacatttttcatataattttaaagagatttgaaaccctctgaaggctatatgtagtccccatgccaagaatgccagatttgggaaccaacatttcttatccatttataatgctaattaattatttctcttaaaaaatactctagttagcctgtaaaattcatttagatgacacatttaattttgcccaaaaccttgatttttttggaggaaaaaataatgtaagaaaatacattattttaggttaggatctttaaattctcacagtcaaccaccatggtttctttgtacgacctaagctcattcactggtgggcaagtgttttggggaccaggagtggatctgattcatctctgtatctgccacagagcctagcatgatggtttagacatggagggagctcaagtaatactgttaccggtacacttgttatttaattttaaaaattaggaatggctactgtgtaagtacataaacatttaagttcataaatttgtttacagttgaacacaaaaaggccatttgtgttcagatatgtgacctggggaagaaagatgaaatgggtattttgatcagcacggggagcagtcagtgggcctacagagaaggcgattagaaaagccttgtgctgacagtgcaggttctatgatatggaaagaactagtgaggaagatgcacatgcttagtagctcctaggaagagttctcaaggagcatcaacctctatgtgtccttcccaaggaagcagtgggccctagattggaggaattcaggataaaacacacagtcctgctaaccatttcttatcccagtcacctgaagggatgagatcagaattactagggaaagactttgcagtgggatagatatgcttccaaggtacttctcccagcccctaatacttcctgtttgctaatgcttaaaatctctctaacctaaaatctccctaacctaacctttcattttaacattagaggaaaaaaaatttgctaaatattgactgaaatttattcaccctaaatttaatcacaaaagtacaagagcaagcatacttcctctctgattccgtgaatgagaagtattgaggagccaaggttggagaaggggttaccattgagaatcggagagggcaccagaggtcaagactggggaaaaagacaaattgaaaagacattctatctttccctaggattgttccaattatcaatcctattagataagcatatgtagaaacctggtataaaagaaattattttgtatggctaaccactctccttcaaaaaacttcacaatttgttaagtttagataaagatttatcctcttgtttgattagtttccttagaaataaatttcattcttaggggtttcactaattaagataaatagacaattagcctcttggcagcagaagctacttcttatttatctctgtattcccaatgcctaggccagtgcctagcataaatattgtgcttaatcaggattataatatgtatatttcttgaatgaagataacaaaaatatctattacaactctaagtgatttattaattgatttgagaaaggatttatgttaacttacaaaagttcattcaataagaggttacatcaaatatttaaatcattgcaagaggaaattagaagtaaagccaatgaaatgaagttatatagctaataaatcaatttttcttagttgtaataagtatacaaaatctttctgcatgtaatgtgtatgctatcagcttaatataggcatgttttaaaccatgataaagaaaatattccaatatctcaaattctttcagaattatgccaaccctagaacacagtttctagtatgtgattaagccttctattttttaaaaaagtatttctcaattgactgctttacataaatcatataggtgtaaatttgaattattactacataaatttttcttagatttatgacagaattaaaatagccttttaagtcttaaaaatattaataagaaaagctcaattatgtgaacacagctaataatacattcattctggcaggcattgtgcaaagttttcaatgaatatgaatatctttatgaaatatgagaagctttgttcatttacatacaagttccttagtctcctacattaattattttttctcattttttcatgtggaaccttttccagtaagttctcataagacaacaaatgacccagtggagtacctatttaaaacattataaacaaagaaagcttctttcttcagccctgttctttaatatgtaatgaaaatgcttcatctttcattacagaaatgttttatgttctaacctcttaacctcattattatagtttggttagatttttaaatagaactcgagtttttctcagtgtttcagacaggaagaaaggtggagtacctgacaacctgttccaggaaagaatgttcaataatcaagcatctatctcctcttcctgagttaatccagttagcttatgaggcaagcatgggggagttgcaaagtaaatcaaggtgctgaattctactctcatcctgatcctaaatggattgagttttgttctttcttatgtactatccccatattcacagttacagactttgcaggtcacttgctgtctttgtcatattgggatgctctaacataccatagactgggtggcttataaacaactgaaatttgtatctcccaggtctggagaccagaagcctgagcccaggctggcaacaaggtcaggctctggtgagggcactcgtctcggtagcagtctgccaacttctccttatatcctcccaagtgggaagaaccagagagctcgttagggcccctttttataagggcattaatcccactcatgagggctccatcctaaagacctaataatccccaaaggccccccttctcatgccattacattggtgattagggttttagcataggaatttgtgggggacacagacattcagttcatagcagtggaagataaggggtgctgtgcagacatcatgggctctatgtgtcacataatgtagcatctcatacagggtaaacaatcgccactgttatctcttcccaaagccctgctgtggggtctgctcaccggccctgcatccagtcaaggaaggggaggtggagaagggcacttgaatgctgagtggcaccaagaggaatgtgcagatgtcataaactggaaaattggggctaaaggtgaaacagcatcatacaaatgtcttccctccaaaagctcaatcttattttagaaatatatgatccatgaggactttatcataaattggcccaaaacagccagtcagctactgagggtcctcattttccaatgagtgcatgttttgctgcttcagtggtccagcacgatttggaagtattattgctttgttactgaagagacctttgttttgattcagttgccaatattctctaagatggtttaatgtgagccatggtacttaggtgtaatcctgtaaggtttcttttcctgggattcacagtccctgctttcaatagagtctcacgagggtctatgacccttccagacagcactgatttcaagtctgtatcactttataaaatcctacacatagtcgtgatcttagaaaaaaaatggacacaatatagaacacaaaaagatgaacccattactaacaaatctccatatatccattgtatctaagtcatactctatgagcccaaaggctaataaaaaaacaggatcagacccaggtacaggggcaacagtgccaacttctgaaagcagggatattggtgtagcgaaatagagaatatgaaagaaaaaacaatactctgtgagaaatagcctagtagcctatactttatgccaataagctttataggaagttctttttttttttttttttttttgaaacagagtcttgctctgttgccctggatggagtacagtggtacaatctctgctcactgcaacctctgcctcccaggttcaagtgattctcctgcctcagcctcctgagtagttgggattacaagcatgcgccaccacgcctggctatttttgtatttttagtggagacaggatttcaccatgttggccaggctggtctcaaactcctgacctcaagtgatctgcctgcctcggccttccaaagtgctgggattacaggcataagccaccgtgcccggccataatagtaacttttatatcccagacaaaaaaaaaaaaaaaactgagttaggcttacagacttgactctgaggggctcatgataataattttcttttttttttctttagttcgtttgttttagcatgtgctcagaggaaaaagaaaaagaatttatggaagaaatctctaaatcatattccgttctttcatgaaagtgggcaattcaaataatttcactcaattttcaagtgagatattcacagtaatttgtatcttcaggttgaggctaagcttcattgcacttcatgggaatatatagaacattctagcaaatctttcttagactattacatctttgacttacatgtttatgaagaatcatctgtgcctctgattggccttatataaatacaagggtcatttcagagagcagttcttaactgacttggaaaagcctaagagccaaacaattcagcagctcttccacattgatggcaccagccacatgcagtacatgtgctttacgcatttcattattgcatctctttgtcttatgagtttattgatggaaaattgtgccttgtcttttatcaagtaaacatatttcagaagacatctacatgctatcaacaaaacagagcaaattcagaaaatgtaggacttcgttgtacttgggggattacttcaattgccttaatagtctaccagagtagaaatattacattctttaaagttcagataaataatttgtgctgcttatgtaggaagtaagctattctccactgtaagcagtcttttatgttgacaatatagaaataatctgtcttataagctacactgcatctaaagccctgacactacagatttatgcatacttctggctgaaaataatattgaaatgtgaaaatgaaatctttcaccaaatctctgggaacataggtttgaggctggctttggaatcactaaaaattcattgattcccaaacgtagactaagtaccataagaactgactagggtacttgattgagcttgtgctgtatggtttattacactggtggtaggaatgtgtcaatagtgattatactgctctaagtattttgttttagggtatgattctagcttcccttgtatcattactcaaaactccaaatgaagtgtgtaagagtatttttcaaccctggatttacttgcattccatactcattaaatatatgacacaataaaatgtctaggtcttatgcaaggaacttcaactcttctatggctcctggcctaaaaaggtatctgtgagaggcagaataatgtccgccaccaaagatgtccacatcctaatcttcagaacctgtgaatatgcgaccttacatggcaaaggggatttagcacttatgactaaattaaggatctataaatgcggagattttcctgcaattcgctgggtaggtagaatctaatcacatggatccttaaaaatagtaggaggaggccgggcacagtggctcatgcctgtagtctcagcactttgggaggccgaggtgggtagatcacgaggtcaggagttcaagaccagcctggccaaaatgatgaaaccctatgtctactaaaaatacaaaaaaaaaaaaaaattagctgggcatggtggcggttgcctgtaatcccagctactcgggaagctgaggcaggagaattgcttgaacctgggaggcagaggttgcagtgagtggagatcacgccactacactccagcctgggtgacagagcaagactccatctcaaacaaacaaacaaacaagcaaaaaacatttgaagcattgagattaaagtgttttctttgattaaaaatctgtcaagagtaattagaacctgcttcctttcctcttctcattgtacagcttacaatatggatcaagaaattgtttctattgacatacttctttccatgtttagatcggcttccaagatcttatcctttccactttcaatgtcatgaaaaatcattgagagttcctttaatgcgaaatgttatgccagtgtcacttcctgtgagacagcttcatcctttttggggtcacaaccaccttccttatttgtgtagttcaattcatttaacctgagttcctctggctacaaatctggagtctctgaaacaatgacacattcagctattgcttctataactccatttacattcatttcacatttcactttcagcatcatcactctctgtttcttgatgcacttttatcttagttagccaattctcccttctcgtgtccagttttgtaaagtgttatatgggcttatcactgggaaacaaggaggcaacataaccacatgctttgctgtgtgtggaaagaataacattatgtggagtaacaaacccttaatagattttgaaagaagtgacatggttggtcactgatcatgatgcacatctgttatttctgtatagatacttctgaatgcacaatgaggttatgtcccaataaatccatagaaaacacatagttgaaaatatatcaaaagttgaaaattcgtttaatacacctaacctaccaaacatgatagcttaacctagcctaccttaaacatgctaagaacacttacagtagcctagagttggaccaaatcacctaacacaaagcctattttgtaataaaatattgaatatctcatgtgatttatagaatactgcactgaaagtgaaaaacaaaatggttgtacaggtactcaaagtacagcgtctactgaatgcatatggcttttgcaccttcctaaagtacaacaattttaaggcaaactgtcataagtcagggttcatctgtagtgtttttggacaggagagctagtaacaaaacttgaacactatacatatgcataattaaatttgtatattatgcaattactcaaacttagtatagcacagtaactaaaatttgaaccatgttgggagactggtatatttacctatactatagtaactgaaatttatgcatattaaagtgtgtgcaaagcaaggactgcctctttgtgtgtgtatgtgtatgtgtgtgctctgtatgttttgcatattttcaaactttaaataaatgccatcatataatatttatccttttatgaacttgctatttacattcaaacaatgtttctgattattcttattaatgtatgcagtcaccgtttatttctttttctgttttatgatattccattcacatgactatactacacttcaagttatttatgtattctttattgaaaatatatattgctttcagttttttatttttgcaaatatgactcctctgagaattaatttattgcttccatgtagtcatgtgcaagaatttctctaaggtaactatatctaggtgtggagttattcagttttaaaccttattagatatttccaaattgttttcccaatttacactttcaagtaagttttaattttattttgactcaacttgctccataacagttagtattggcaaattccattttaccaatctgatcacataaatgaatgaggctaaactaatttaatttgggttttcttgattaagggtgagactgagcatattttcaagtttcctcaaatatgagttatctgtatcttttgataattatattaatatatattatttacataaaccaaatattaatgtttataatttgtatatactgcagctgtcatctcctaatctttgtcttgtctttttatttgaattatgatatattttgatgtgcagaagttttaatttgaatatagtagaattcatccattttcctttttggtttatgttttgtgtcttatgtcataaaaatattatcttttgtgcttcatgccttttttcttttatgatgtcttttttcttttaaaagttttaaccgttttctatgtttgggtcattaaaatacatggaactcaatttttttaatggtataatctaagggttcagtttcttatttttgacacatatacaaccaaattttccatcatcaaacatgggaaaaattctttctccactgaactgtaaagccacctctgtcatacatcaaggtttttttttttttattagactttattttttagagtcaatttaggttcacagcaaaactgaatagaaagtacagagatttcacattcaccctctgcccccacatatgcacagtctcccctactgtcaacatccatcaagtttttatacatgcaagggtctcttttgggctctatatttttttcctttgttcacattgtcaatgctgcacaaatttcatactgtgctagtgatacatcttcataatagaacttggtttctgatagagtttagtctacagtgttgatttttaataaagttcttaaaatttctaactaaaattcatgcaaattttgctactgcaaatagtatcttttaataaattactttttctaatgattgctgatagatagaaatgtaattttttgataatgtgagacagaattcacattacatataattcatccatttacaatgtaaaagtcaatagcttctgttttttgaaattatatgtatatatataatcatatagtgtgaattctttgtgtctgacctctttcagtcaacgttatgtttctgatattcaagtttttgtgtgtagttatgtccatttatttttatcactgtagagtatcccatcatataaatatatcagtatttgtgtatcctgttttcagtttgggctattgctgattatacatcattattctagaatttccttttggtacattttaaacctgcccactctctagagagtattttattattttctcacggttttcatttcttttggtctgtcttacaagtgtcttaagtatatttgttttgtatcttttttataattattacattaccttgagggtttagagggtttttctggcactttttcacagtggcttatttcctcatctgttttggtatttttgttatctttctgcttatcccttgcaccttgcaatgtgtgagactcattttgtcttaggttgatgttgctctgtctcaacaggatttggatttgcttatacacgtgctttgatacataatctaggttgggtttatgttcatttattggcttggcttttcttggactctcaagtagtgtatactcaaactgtagacctctgtgagggcaggcctgtggttatgaactctcaggagaatagctcttccttattcagtattctggccaagacagatgacagacatttcctatggccagtagtcagctgtgtttcctagaacatcctatcattgaagatgtagccttcaggggcctcagccctgtgcatcctctagattcccaccacaggggagcccagggcactttcctgtccctggaatgctgtgcaattcaatcctctcgctttccaagataaaggaatgtccccagttaagggccagctcaccactctgatgttcttccccatttttttggtttttgcctttttgtttatttctttgtttaagaggggatgttgctttgttgcccaggctggcctcaaactcctggcctcaagtgatcttcccccctcagtctcccaaagtgtcgggattacactggcatgagccatcatacccaacccttccccttctttttctaccattgggatttatcttgctctttcgagtccccagctataccttaaaaaagacacttgttaatttttatgcagcatttgtgggaattattttagagattttcagaacccctagtctgtcataataccaggatagaaagtagaatggtgctggccagggcctggggagatggagaaatggaacattgctgtccaaccactgtgaaatttcagttatgcaacaggcataagttctagggatctgctgatccaccttgtgcctgtaggtaacaatactgtatggtgctcttcaaaatttgttaagagggtagatctcatgttaagtgtttttaccacaataaaaaaattgttttttaagagttgaagactattttctgaataaaaacaaaatgaaacctcataagtaaattcagagttgcctagtaaaatgtgtcacacgcataataaaagtgtaaaacattcacactcctcactctcatttaattatcaagaattaattaagcttttatttttcttccataaattccaagttcccgatagctaacttccaaagctaaaagtaatgttacttttgactcttttgctacaacaaataatactacactaataccctggcatgtattgtgtggctatgtagagtatatctgtaggaaatgttggtggaggtggagctgctggttaagggtgagagaaattttaattttctagctttcaaattataccattcagcctcccttttgtaaactgttagtttaaatttgcttttctgtaattgtacgtgagtgacaattattaaccccagttaaatgaacaaggagttgatcatctgggggtgttcacagtgctgaaattatgaggaaaagatgtggttcaggagaagcttattaaatgtactttcctttttctccacccccacaccaacatgctgacaatagaaactcattctcaaactgaccttattcaaggtaagaaggtattgttccagtgtgttggtttcaaggactttcttccatgcagaataaatagtagaactaaaatatcactaaacctctaagtaagcagattatgtgctgtcaacggtgaatgcccaatatatccacagcgcaagaacttaagtagacagaggtattaactgtcattttatttgaaggaagccaaaaaatcttgtgctcacatcatattccttaaaacctcattcttccagaatggctaccacagtcccaggcatcacctggagacagagacataatacccagcagaagaaaagagtttattattttatgatctctctgtttgaagaagaaaaaatacaacactttcttaaaaatttctaagtggacttcctcttgtgtattattggccaaaattgaattactgaatcatatgccaaccccaggaaaatcaattattggtgtgaggaatagaattcccctgatcaccttagcctaatcaatttgtatccatgacttacacaccctgcaacaaaggaaaatgtaggacttgctattgattacgtacacaagtgtgcctgatgtggacagcaaataagtttgatggtattgtttgtcataaagttaagtaacagcatgagtaatatggccctctgtggaatttcttggtggcagttgagcaaaatttaaattgctctgaaatggaggactgtgatcacggaaacaaggtagagttagctgatataatttggtacaaggaaattaaccatggttgggtttttgagccatagatatgataatactcagaaatatatgtaataatgcagcattcccaaatgattccaatgttgagttctccacacaaatcatttcattttctttcagttggtgttaaagatattggagtcctcatttggaagtcactcactatagcatttatgggaaaccgagctctgaattacaaacatcgagttgacaaacgaaaatctggaacagaacccactcaccagctggcgaccacccagtattatttgactttaaacttgatacttgaacatgattttttaaaagaaacttaagcaagtaaacataaaaaaaaaaaaaaaaaccacctctctttgacttggtcttgcaatgggctttttaccgctttgaaatggaatacagttttatttccaataaacagcagccgtaacaaaacttcacacagacacctggagaaggggcatttgatgaatgcaatactatcattgtttattatagaattatttactagaatctggcagagatcctaaacaccatttaccataactttggccaattttcctaaatccatacttcaaactctactgatataatgggctgctttagccaagaatgatagctctgttactccccaaatattaccaaaacaaaggcgtggtcacttcccacaaatccacctggagtatgagtcaccagctgccccttgttgatataaagagctcgaagaatgaacagttttgaaatccattagtgaatcactgagaatccactcagtacagcttggagatctcaacagaagccaataataattaaagaaagaaaagctctgggttaaaggaaagcaagcaatccagcggaaccaactagaaaacatcagccaactgcagcgccttgctggaattagggcagaccacagtctagtgcctgctagagcaattgaaggaagcccagctgagagagaaggcttcagtaaagaaaattagggaaggttttatttttatgtgaagttcttgtgagaaggatgttaagagaaagcattatctgttattatttatgattgttgagccccacaagcaagcctttgagtttttataagcccacatagcatgtttttttgtttttgtttttcctgagggtaaacacttttatttgtaacagcattgtccatggctgtcaatgtatctgatggaaaatacctgtccataagcatgaaggaaatccatgatcttcccctttaatttgcagaacattacatagtatttttttaaaaaagatgcaaatagcagcctacttctttgctgctaaagagctttaatggaatttttagtgaatcagatgtgtaagggctgatgtcctccaagctgagctggatctccccagttcttcctaaggttccttttgtgtcacattcaactcaacagacaggaagcaactctcctgcagtgaaggccgcacagtgggctctgctcctaaatccaaggacacagaggagcgcctgtgtccccaaatcaggaaggcgggcatcggcgagacccagtgtcacagagaacgagcatttttgctgctactgttctgtgcaagtgatcacagcccagatgtacagtatgatttggaacctccacactatttagcatcccttaatttgtatccagtgtgctaactgacctggaaacattagaaccccatttccaagtttctcttaaaaatccccaggtcccaacacacaccaaccactttcatcctcaacagggcatgttacgccagagacagatccttctgcatgcattttgccttaatgccagtaagaaaattgattttttgtttcaggatttttcaatccagaagacaaagagattagtcagcagcttttaaaatgaaagtttccaggtgagagatttcaacactattttgtagatctggtgaattaagatacatattttcagtattttaggaattcaaattctaatcctttccaattcaccaactccctttatccaaatccatggaatcagagtctaatgaaaggggtacttagcatttgattccaagctttcccttacaactacatttacaagaaagtattttgaagctgagaaaactgacaggtcctgtggttgatctgcacagttctatttcctttgggctccaaatgttaaagcacatgccctggcaattcgggcaccagttttgaatgaagacacccagcatcttgcacctgcctgccaatctccacgtcctttgtagaggaccggggtggacatgcccatcccctcctggggaagtctgtttacactgcaaactcctgacttctgcatggcggtagagctgattgtgatacctctgtccacctatgccagcccaggtgcctgacttgtgttgggttaactattctgatagctttgatatggccttcccacatgtgccttctcctactgtggccgctgtcactctgtctccactcccatgacacttggatgctccagtgacaccagctcctgcacagtaccactcttcagcagcgttcatatcaaactgtgcatgtctagcttatctgggggaagacactgaagagaggcagaggtggagacgtgaaagaagacagcaaaatcacagagcttcgcaagagaaactgcttgcttaaagataatttcttcttctgattacaaaagttacacatgctcattgtcaaaatgctggaaaatacagagaagtttaaagaaggaagaagttaccataatcatactacccagctaacatttcggtgtattggtagtagggaaatttctggttgtcaaggaggaaggtatatatccctaatcacagaggttttttcatgctcttaggtcctaagttatagcattttaatgggagatttctaagacggaaggtatttctggaatagcattccttccctttcttctgcagatctgtcaaattgttcagctttcttgactaatagatgctatggatagagcatccctctctctctaaaaatctcaaaaaaagcaagtcttatttattcaggatttgaagagaaatattcaggaaggatatttcatcaaacctgattcatatattatgcactgtaatgatgctagacacaaaacacaagatttcttgatagatggtcagaataaattacaccaactgcattagctcagcagcagtcctgcccggatctcagcacctgagcttctcatctgcgtatggttgctcagcttggtcactgagacatgcaaaagggaaatgggcattttccctgaacacctaaatcctttccaaaatctgtcaaaatgtttactaaaatgtagcttctttgtttatcagacgaactgtggtaacagcagttatgaaacttatcacagttcatctgataaactacattttagtaaacatttcaaagtgaagcagatatgagagagaacaaaattatttgtgtttacatgagacttggaattgttaaaatttttatatctagcatacaaaaaggctgcttatgttaaaaattgatagtaactaaatatataagaccaaaagaatactaataatgtgaattaaaatgaaatcttagcttggtttataaactatgaaatttgactaaaatctattctgtatatatgttctagttttagaatataaactagaactagaatctaagtagtagccaattggtaagtagtgtctgactgggatctaaaccagttcagattaaaccattgcaacactactcagaaaagcgtatggtcaagatcttccgctatggagattaacaagaaatgcccatctatgtaacagtaatttaaaaactgatagtggtatattacattccagtgaatgacgtaaataatagcctttttaaccctcttgcgaatatacatggtatttgagaaaaacgttgcttcagaacaggtgaaagaatatgcctggccaaaataagttcggctacccaaaatggtaatggcttaagccttttggtttttatctttgttaaaggcagcgagtgacattttaatcttcttgtgcaggtttttctaaaacacaaaacgctttctgttaaaactcgccacaaaggcagaaagggaaaagcattcacagatgcacacagattccaagaactctctcacactatctcaggaactcttactgctccctagaaactgtttttcatcagaatggggaaaataacacgactggtacctgcaatttctgacaccaatttcacatctaacctctgtaggtatttaacggactcagggcctaactgaaactgctgctaactattgatttgttgaggtgttcatcccaggtggtttatggggactctgtaaatatgggctgataatagtaatggtcaagctcccataatttcttaatttcagtttatttatttataatatttatggttgtaagatcgaatctggtgattatctgtgctgggggcagaaatttcatttctaaaggatggcggtaaatataagcatgttgttggttgaatgttcaaaaacatatttcaaaaaccaagtactaacagctaaggggaaaaactcacacaatgaaccagaagtgtatgaaacaaggaataaaatggaaaaggagaaggcatgaatgttggagggatttaagttatggatgaaactacagtgaacattcagggtatgttgggagatgaaaactgaagcatccttttactcggtagcaaaagtgaccgggatcaagggtcactcccggatacaggtatcccggagcacctccacaatggcttccagcccagacctttgtcgtgggaaggagtcccatgctctcatttttggcacaaacagagtttgactctcaccacaaaacagcatcaaacaatgtcacaggctgtgcttctcacaaggttttttgtttgttaagttcattttcctgaactcaaacattgtgggaagaagtaggtcataatatccatttccctctaaattgatccagagcttccagaaatctgaagaccagtgaagccaaggtttcttccaaacatagagttgtgtgaaatcactatgtaaaactgtcagcattattttggtggcaagttctgtccccatcttggctctcctccctgcctctcccacagcctggtacagtcagctatagagttcagccctgaatacctgctggatttacacctagcaatgcatctgttgatctcactgatgtgaaaatcattttacaaagaattcccactgcattttctttagcatggcattcacattcccccatagtgtggtcccaaatcactcctggtcttcatcttctaggttcctcagaggggacctcctagcatcagtctgggaattctctgtctcctatgggatccaggacctggaccacccagtgtccttccaacaggcctgaaaccttcctatgtgcaggtgtggaatgctgctttcgcttcttgcctcccaatatcttattgattcttcagttccttgttgtaatctccctcattcagagttgttttgtgtttgtgttttgttttgttttgttttttgagacagagtctagctctgtcacccaggctgtagtgcagttgtgatatcttggctcaatgcaaccaccccccaggtccaagagattcttgtgcctcgggctcctgagtagctggacttacaggtgcatgccaccatacctggctattttttatatttttagtagagacagtgtttcactatgttgcccatgctggtctcgaactcctggcctcaagtgatccgcctgccttgccctcccaaagtgctggggttacaggtgtgagccatcgtgcccattctcagggtattctttttttggggggaggggtgtgaggggagggtgaggagaatggagtttcactcttgtcactcaggctggagtgtaatggcgtgatctcagctcactgcaacctccacctcctggatgaacgattctcctccctcagcctcccaagtagctgggattacaggtgcctgccaccacgcccagctaatttctgtatttttagtagagacagggtttcaccatgttggtcagtctgtttttgaactcctgacctcaggagtggtccatcagccttggccttccaaagtgctgggattacagacatgagccaccacacctggccagagtattatttaattctctgagtaaccagaagccaaaggatattgcttcacctttagttgccatgtaattgaggcatacctcatcatcagcagtacacttggttttctatactggattacacaccttttggaggcaggggctacttttattcttctttaaatcttcacctgcactagcatgctaaaacaaggaaaagaaagttttatcttctatactggaaacaaagaaaaacaagggtaattcatcttacttttatcactagtctccgattaactacatgttcaagtttactgtatagtatatctatgtgatctaggcaggcatatttcccctcaaatatataatatggcaaaataaagtgcaagttgtgattggtgaagataaatgactgaacttttactatcatattctcactctgctgataaatcatctttgagaattcgtattaattttggtcaagaaatacacaagttaaatccattttattcttttttttaacattgggaggactaagtgaataaagaaggagtgaattatatgattgtctaccccacagtttcagtaaaacgatattttttcctgcaatatatttatgatctgccttaaaaccatagaatctggcttaagccaaagcaactgtatcttcctttattttttaacaataaacacctttaattatcttccttccgactactttgttgtaacacacaatgtgtttgtctcctgaggtgagcataaaaaaggagcccagcatgacttgaatgctaccgtaattaaagaaaagctaaaaaggtcaaaaacaagaatgtggtaaatcttaagcaactccccagaacaggcgccacctgccactttgtgctgacaccgtcaatcattgaatcggttactgaatactttcttgcatttcttcttctccaccttgtgcccacgttaagcaggaagacatcatattttcattagcacctgttttgttttttcaccttctgtagactgttgagtgaatttctaataataaagccaaaaggaaaaataatggcaatatgattggacaagcagtttcagaatcaaggtaggatgcctttttgttggtggaggttttttgtttttgttttgtttttggacttattctccctcatatcaaataaatttattaaacacacctgaacacttgttatgtgccactgtcggccacgtattagggacacggaagaacaataagacatactccctaccaaaagaggcttatggtttagaaggaagacacagtcttgtaaacaggtaagtaaaataaaatgtgagctgcactatgctggaagtcagcccagggtggcccaagtagaccatagccagtctacataaatagggagacacgggggacagctttctagatgtccctaacgctgaatcctaaaagatgagaagcatttctagggtgccagagtggagaaaacacctgacttgtgggagaacggaaggcctcgtgttcattcaatggatcaactatcattgggcatctccacctgcgagagacggcgctagcccctggggatccagtccccggtgagctggaaagctactctgtgctctcagaggacttggaacagagaatgcagacagggtggcaggaatgcaggaatgtgctcacagtgcaggaacccggtggctcgcagagaagggcaccaaacttagacctgggagatcaggaccctctcccccaaaacctggaggattgctccaaagctgtaccgagtcagtggcggaggccgggtgagcgtggggaagggcatcagacacggtatacctgctccacctttcccttttgttttgttgtcacaagaggcactacttcgctgcctccgtctcctctgtgggtggaaaggatggacccaaaggaacagaaggctgtggccactcgacgatggttttgatagggacttatcttgctctctctccctggacactctctttctaggcctgcagcctctctcctcccttcccatttccaaagcctctgccccaacctgatccaagtattatatgtaaacctgtcattagggttctttaaatcaaggctttttgatgacaaaaagagggtttaaaaaaaaaaatgtggctcacgcctgtaatcctagcactatgggaggctaggcaggcagattgcctgagctcaggagttcgagaccagcccgggaaacgcggtgaaactccgtctctactaaaaacacgaaaaattagccgagcgtggcggcaggcacctgtagtcccagctactcaggaggctgaggcaggagaattgcttgaacccgggaggcggaagttgcagtgagccgagatcgtgccactgccctccagcctgggtagcagagggagactccgtctcaaaaaaaaaaaaaaaagaaaagaaaagaaaaagaatctgtaagaatatccagtgtggcttctgcctctggaataagtaatagtcttagtgaccatggctatgggagtacccgggttccatcagtgtgccctgtgtggttttggtctgggctgcattggcgtggcctgtttttttgtttttgtttttgtttttcccttattactgttcgtggagtgttttagtttgcttttttgtttgtttggttggtttttttttggactctgcgaatggatgtctaatgctctcgtctccctggcaggacctccttcctgtgtctgcagtttctcttgtagccacaccgtctgcccgatcatcagtgctaggaaaataacgatgagaacagacctttcgaagcccgattatcagaaagagtgtcttcatgcttgaaatctgaatataaaacagacgcccctgaagtgcatccctgtgacactgcctgtacagcaccgttaaatatctcatcggcagtaatagcttaagactactgtgctcagtcacttctttgggtgtcactcatagcaatccccatccctgccatcatcattatcacacagcactgccataatgacaattataaagatgttagaaagctgagacaagtcattctgaattaaaccgcagctcccataggtcctctgaaattacccgtttccaatatctccattgtttccctacccaaaagcaaaaaggggagacaaatgtctcttgagcgatgcacaaaatacattataagcctgggaataatcaaagctaactgtgttcagtagagagagatgcactgtgactaagtttcactgaattttaatggcataatttttagcccagaaagcaagctcatgtgtgccggagtgattaatgatacagtttatgcagctcattggtcatacttaaattagtttaaatattcatctgttgttttgttataatgaatctccatgtttctttttatttctgttcccctgagtgtttcctcttgtctggttggaggatgtttgcctgaattgggaaagaaatgccaatagccctgtaggtgacaatgcacccaggctgctgaagatcaggggagatgaggcaataaacgcttcatttcacactgtgaaatgcacacacagctgcaccagcttcttgagtgagatgtcttggtggattctgtgaggtgccaggtcagagattaaacttactgatttgtggcacatgaagccattggatgaagttggatgctgtttgctgtccctgggacttcctttaaagtccacacatcaatttttataccaactccctgaaagtcctccttttatgagcattcataatttacattttgagttggaaagtcctgtaactctaccttctgggattttatgaattttcctcccaaatacaaaactctctagatgctgaaattgcatttgtggtgaagaagggaaaggccataagagtaacttaataagacttcatgttacagaactgaaagatctttcaaattcacataaaaggaggcctgcacttgacactgtcctgactatataacaacatctagaagtagacagtgttgcctttttatgctatatccttgggagtacaatttacaaatagtctactacacacttcttgcacttgtgaatcacccatatagatcaacctttaaagtgtaaaaaaaaaaaaaaaaaaaaaactttataacatcctgagaattaatccttggagagctggctagatacagaatgaaaaattccagacaccacaagtagttagagctcagcttcctggataaatcagttaatttggaaattgtggcctccatacccgctaggcatgtttgttcatccattgttctcctccctatctcctagccacagtgaaagaaaacgaagtgtggtgtacacacacttctagctatgaaagcagctgcatgatactggaaacacagtgtctccaaatgtttcagccttgggggcttccctcattattactatctgaataaagtgcttcagtccgctatgatactttactctaggaaacccagctttgttcctcacattatcaatgacttccaggagtgttcaggaaggacccaacttttacactcactattcaacatgttattaccatgctgctaatgtttagctttcttctacattatttgacccccaaaacagacactataacccaactaatataattctgttatagcatgttacaagtttttagcaaaggtgagaatcatcaaattgcatacgggatgttattattcttcatatccatcaaagtacaggaagtccttcacaggcagccatctttttctctgggccacaccagagaagccccctgccttctcctttctttgagtttcaaggactgaacttcatgtctcacaagcagtcagaggtggaagcaaatgaaattgcctttgcaaaaattctaacagtgagaggaatctcacctgactccatcttgcttctaacctcacaagctagctgactttgttagctttaaaacaaaaatgatacatcccttcctgaaactaacccctccttgcttagggactgaaaccatgtttgtaagtctaatgaaaggacataagattaggattatgggaggggcctgaattctgctaagatatatgcatagttaaacaataaccagctattgttccagaggtacaagatttgtaacttctccaactgctcctttagataatatccatatggtcaaaacctaagattgggctttgaggtattttccagacttttgcatttggtttgaccagctgatgccacctgaacccaagactcataccagggaactggctcaaccagtcctgtgaccttcatccagatactgactcagtgcacaaagaccattttggacattcctatgatttaatccccagtcaatctgcagcacccattccccatccccctacccaccaaattaccttgaaaaacactagcctccaagttttactatctctcatccttctcttggctggccctgcaataattaagttctttctttgctgcaatacctgctatactcaatgcattgacttttctgagcagcaggcaagattaacccatcaggctgctatacaaatacttcctgttaccttagtactcaaaacaatctatggtccctcttctcaacctttctttcttgattatttaatctctgttaccattcttacacttacttacttgcaataacataatacttactctttctgtaataacttgcaggttataattggatcatgagtgacctctccccaaattcatttatctcatcttaagcctaatgaatgaaaaaattatccataatgagagaaaacagcaggatccttttcataaagagatgtttgaaaacaagtatttttggaaataatatattaagatgcatatgtggctatatgaccgattctaatgtgtttaggccttgctaatatatcggtatgggacaatctccttcttaaaattgtcacactgtattgtttgcttcagtccaggatagcaggactttttgacctgaaaggaaaaggtaaggcaagggcagaggttggacccttgtcccttaggacaaagcaggcagatttacatcactgccttccaggaaatgacagcttacccccaaaagtaaagaaaaagtgtactttaaaaaatactagccaggtgtggcggctcacacctgtaatcccagcactttgggaggccgaggcaggcagattgcttgagctcaggtgttcaagaccagcctgagtaatatagtgaggcctcgtctctacaaaaaaaaaattttttttaaattagtgtgatggtgcaggcctatagtcacagctactcaggaggctgaggtggaagggtcacttgagtccagggggtcaaggctgcggtgagccatgattgtgccactgcctttcagcctgggtgacagaacaagaccccgtctcaaaaatatatatatgttttatacttctcactatagaaaagccatttaaagcattctgtgtagggggaataaagtgagacacaacctgagtattataatgagcactgaatttgtagtaaaaagagtaagtcagattcttgatttgcctcctgcaggctttgcactttgaaaaaattatttacattctctgggctttggatctcttgtttttaaaattcagagtttgaaccagatacccgcccacctcatacagcttgaaaactctacaagactcaagtttaaaacttctgcattccaataaaagttagaaccctaatcctcttgctacaggctagcaagatttctcgtatgaaaataatgacactgcaaatcagtacctgaggtctaccaaaacctcatgttgtcaaaaccaaattgtcatctaactatttgaaacccgccacaaccctttctcgtaccattaatgtcaaagcacaccctctgagcagaggcagcagtcactgttttttgttgttgttgttgtttttttctgagctttctcacatactaacagaggctttgatgcaaaatatagagcagtttccgacctaagggactttggaccaacagatatcatgctagccctaattttttctgtgggttttcacacgactgtgtgtgagaaaagcaagagatttcagatctaaacaagacccactatacgaactaatgaaaatattgggtgtgtggtctacaaaacagcctaaataagtacttctctctgaaagatccctttctccataggcctattcagattaatatctagttttcttcacattaaagtgtatatgacagttgtcatgataacttagtgaaaagtttagccaatagaatctatgtagcacttttaggcttctcctgctgtctgaattttttcttaattttctttctctcaaattcagcccacctaaagtttttgacagtctgtttaccaatcaggaaaagatttaattcttatttgtcttaaggcagacatccaggatggacagtgattatgggttcatggaatgttacaactggaagagtttataggattcatctggtccctcattttcctacttgtcaaatgaaaacaatcaccagggaatgtgttgaaaatatagatttttagtctccactccaacctgttgggtcagaatctcaacagacacaagagaatctgtacttttaacaatcataccatcaagcaaatttgagaaacgctgatataatcctatgattttattttgtaaagaggtttattttgattatacatggtcatatatgaaaaaaagaaaggatttcatagcctttcgtgaaagagttgactgcttcatatcagttataaaacataaattgaaaattattcctgaggttgaaacactcaacttgggcctctcaatttctgaaactcttgactttgatgatcgtaaaatgacaatgattattttatgttaattacagaagtcaccttccattctctcccaacctcaataacacctatagatgatatcaaatcgaggcatgtagagccacacactattttaaaaatgtagcattccttcatactcataaacattctcttaaccttaacatatgaaataatctccaaattctcacaaaaatgagtgcccacctgaactaaagtttttttacacctttaaaaatgtaattgtacagacgaaatcggtgtcataaggttactttcactaaaatagtatatccctctaaaaacaactttcacccatttgcaatcactggaaagtcatagaaggtgactagagtaactgatttctctcaagagcaaattcatgctctccaaaggagatcagggtctgtttagaaaactgaggtctaataatcaaggttgccacctggtagatctcatgttccacacatttggatgacttggctgatttcaggaatatgggaaaaatcagtttaacccaggctctctgaaccaatgtctcagatcaaactgatgacccccggacagcaaaaatgtgaccaaggtggaaggatcacttgagtccgggaggtcaaggctgcagtgagccatgattgtgtcgctgcctttcagcctgggtaacagaacaagaccccgtctcaaaatatatacatatgttgtatacttctcagtgtagaaaagccatttaaagcattctgtgtagggagaataaagtgagacacaacctgagtattataatgaacactgaatttgtactaaaaagaatcaggcttagccttcacttcacaacccaggttcacatgggtccttcctgtgcatcccaaggtcaggtttaaccacatcaacctcaaagccttccaaacagaaagcatttggaaacaacaccatctccccagatcattctacagtatgaagccgtgaaactgatggctctcggttcccctattcctggaacacaagtcttcagtttcagatttgggggaagagaaatcatcatagtatgacaattgggagaaaattacgtttttgttttcatatgtctccaaataaaatcccaatcatattttgtacaaaatttccatttttcattattaaaatttcattattttcaggcagccattgaaaaagattgtgccctaccagaatctggatatccttttgggcaacacacttttaacctctcttaggagatgttaatttgagtgagttttcaccattctatctactgcattcgtaaatttccctttttgattattctagtcatgtaacagtgagctcagcaaaacaaacacacgcacaactccaaagttctatgcttaatgtcagtgataaatttcaccaagtagctagaaaagcagctataataaagaatattctaattagtcttagaggcattatgtggcagaaaatatggaattttttttcttatgccgagtttgctaattgcccccaacaataggtgtgaatctcttttgttatacttgcagaaaatatataggtttgacttccatctgggacactctagagaaatgaaggagttgcataaaacttttaatgctgtgaacagctagacacaagttacatagctgctgaaatgaaactatacaacaatttctctatataaacacattctgaaaacacgttgggtaaatggagatattgttgccaccctagaattgatggtttccataaatatcagcatagcatccatactatcttttaattacaattttaaacctgcgaatataataccttgactcgatggtagtctcagagaatgtatgactatattttattccaccacatataaatttgtagaatagggtcttagtgcttagctctgtgagaactatctaactgtctgatgataaaagttgaggagttgtttctgtgaccaaatatgaacataagaccaattatctgcaaatactcctgtaaggtatatttccagtactgttttatgtttggcaggattgtggtggagaagaacagggagatgttctaagtgtttaaaattatttttacatcctagaatcaatgtcttcttaatatcatactctctggttggaaatcttcagaggacagacactcagtgaataacctttaactaatttccaacccatttgagtatgccaggaaaatagcatcttccaagttctagtctagttgttgtatctgtctgtgttgctttccggctgctatagcccagttaaattaccaagtgctgctgatcctttggagcttttcttaatcctcttttgacctctctaatttgaattattctgtgtcatcaacaaagatgtaacagttaggtctctgtgaaatcacaaactagaattgcaattagagtttcttaatcgttgtgcatattgtattgttgcatggggaaagaaagttttggaatttaattaaaagaaaggggaattgtcaatgtacttaatatgccattatattttttcttttaaaatatggagttaaagaaaagtttgattgtctttaatagttgcagttatctaccaatggggactactgaatacatatgctggggaaattcaatgtcaaggaataatgtatgcttgaggaaagtgtcattaaaaaagaatcagaggattagggattctctaagtttttaaaaatatatatattcttagttcttccggttctgggcccattcctttgtttgtagagttacaaaaaacatgattgtttggtagtaattttctttatccagctctttttttttttttttttggcaggtggtaaagtttattcttgtaatttcttgagaagcgtacagcatattttcatttagatgaagttcaaaaacaaaaataaactattaagtgagttagggctacaaaatgtggtcaactataaagaatatcaagggaaccataaacctgaaatctgggagagcagtttcatctgagtcaggaggaaataagtggatggaatcaggcggaagcacgtagcgtaaaagaaaaattgcaccagacactcattaaaaatggcagagagactttctttgaaacgattgtaatatggattaagactattgcagtaggggagagattgaactagactccattggcacaaaagactggaaagttttcaagcatgaagtgagccagagaacaggtactggaagatggtgggacgatgtgattaggccatctgcatttcctaattggcacttccagaatttaggctccttacccttccacagagactgagagactggggccctcccttcttgataacaacatttcaaagggatagctcccgggtccttaagaaaaacactcctgggctgtaaaaggtttacctctcaaagggcagagtaagaatttacaattgcaagttttctaatgtaagtgctctaagaaaagagaagtcaaaggcctagagtcaggaagaaagctgtctgaagtttagtcaagctgaaaggaacttaaagcctccttggtcaacagtaagcttcagtgataatgctgaagtcttgttttctaaaattaggtgggaagtccgctggtcattgtatcatgacaccttacaccttacacatactttaaacattttctttagtatttggtagaaacagaaatactacttaagtgctacttaatagaaagtaaatcaatagtattcaacagaagcagaaatgtatttaatagcactaaatagaagtattaatagcatccagtagatacagaaatgttcggcccagggtcagtggtgttgcccaggggaatagccttcctgggtaacatacgctgagattgctgagtggacaaggtatttccatgtgccgaatttacacagtgcacctctttcctttttcctggctgcactcggtctctctgaagtgaatggcagtatttttaccctcgatttactgaggaggagactcagtcagagaggacattaattgtttcttcctaatatcacaataaattctcattccctaaggctatgtcactccctagaactaagttatctacttagggaagatcattcgtcactgccaggtctccagggtaacatcaaggctttattgttgcaagtcgacaaatcgcctcccatctgtctgccctgactctgtgactgcagccgcgcggtgccctagatgtttccccagtggtctgaaagaattaatgtgcctccctaaacatctaacttaatgctagggaggggcttaggcaatgggggaaatccgcctggaagagatgttctggatgtcagtaggttgtgctaatctggctgtggtcatggctctattggggagacattgacagtccatctatgtctcactgaaagatctttgtgatatctacaggggcactggggaactaacatttcaagaaaataatagcgccagcaggtacagatggtgtctcagacaaagtttctgggctctccctgaagcttgacatcacatcagtgtgtgtgcaactctgcatgtggttggtgagtacaagggcaagagacagagagggtaggagtcagaccgaaggagctaccgtgctggagcccagtgaaaggtgccaggagaactcatggcctctctgctcagatctcaaaatcagaggaaatgacaaagaaccagaagaacaaaggagaagtgacatatgggaggagacacccaagggaaacgttcaaggtcccaacatgacaccttatttgcagaacatcccccaaaacaaagaaatcctctgcacttgttcagaggatttctgatcaacagcagccaacccacagaagcagcagcccttgggcgctaagcagaagagagaaccaatgaggagccattcacctcacctgctgacgcgaaggctgcttgccagttttaggggttttctatgttgatgagcactttggattgttctgagaaattccccctcaacacaaaacacactctttaatgaagagatcccatattcctggctcaaaaatttgacccttgaatcatttatatcatatcattttgttgtagtccatgaattcatgaaaggcacagagtgacccagggctggatatcagccaggttccacgcagacagagtgactgggatgactggatcccaacactcggtgactctcccattcaccaagctccctagtggtctagaataatacccagccacacacctagcgagggctcatagatcttaaaaagttaaagaactactgccactgagcagatttttcatgtctgtatctgcttgcctgccagatttccttcctcttccatctcattgctgaatttaaaaatacttctaagtctatatacattataattgggtaaaataagaaattcttcgtaatttagaagatgtatctctttcctgaagacttcctcctactccacccccaatctccagagacacatttttacccttaagatccttttttttcctttatttcttctaaaaaaaaaaaatgggatacatgttcagaacgtgcaggtttgttacataggttacatgtgccatggtggtttgctgcacctattgacccatcctctaagttcccttcctctacccgccactccacaaaggcccttgtgtgtgttattcgcctcactgtgtccctgtgttctcaatattcaactcttacttatgagtgagaacatgcttaatcctgagattctgagcaagacaacctcctttagagatgtctattgcttggaatgttttaatctgttagatttttgactgcacatattagctttaagaaattagaattgagcattaacatgttcagtttgttttcactattaatttctccataaattatgttagattgcattttttatagtatgtgcaagtgtatgtgcatatacgtatacacacagagagaggctttgagctaaggatggtggattgcccacatctgtttaaatctccctaccaggaaactagcagcaagcatattacttcttcttaccccctcctatattcctgccaaggagggaatttaaaaactctttcaaggagaaacaggtagccagtgatcatcaaacattagagaaagcattcaccgtgacagaggcaggaaaaagaaaattctaaaagaaaaactctagaataaacaaagacatagtaggaatcataaaaaaactgttaagtgagcaatgctgacatgcctgctcctggtaccattattagcagaaaagtagatacaaaatgctttgatataaatgagacatctatatctatcaggttaacatagagataaagtgaacagatgaatttcaagtgatagaatttcctgtgtgtagcacccacattagaggttataagaggataaaatttaaagtaaatttggaatcacccagtcttacgtcctcattatcagggctatggtttaattgttccccccaaagtgcatgtgttggaaggttgacccccaatgcagggatattgggaggttaagcctaatgggaggtgtttgggtcataagggcaccactctcatgaagggattgatgctgttatcttggaagtggattcatggtcttgggagtgtatttcttataaaagcatgagtttgaccccctcttgccttctgccatgttatgacacagcaagaaggtccttacgagatgccagcaccttgatcttgaacttctgtgctttataaattacccagtctcaggtattctgttacagcagcacaaaacagacgaagacagaaaatgggtaccagagagagcagtgttgctatagtaaatacctgaaaatgtagaagtagctttggaactgtataatgggtagaagcctggaaaatttggaggagtaggctgggaaaagcatgcattgctatgaacagaacatttagggtaattctgttgagggctcagaagagaagaaatataggggaagtagagattactaagttgttgtgatcagaatgttggtagaaatatggacaataaagggcattctgatgaagtctcagacagaaatgaggaatagcttattagaaactggagtaaaggccattcttgttataaattggcaaagaacttggctgaattgttcatgccctagggctttatggaaggcagaatttaagagtaatggactcggatatctggtggaagaaatttctaagcaaaatattgaaggagttgcatggttacttttaactgcatatagtaagattagagagaagagaaatgatttaaagacagaacttataattaaaaaagaagtagagcagaaagatttgggaaatctgtggcctggccatgtaatgaacagccatgtaaaggtgctgccaagcaaccctttaataaagggattagtacagctagaaagaagccaggtgctatttatcaagacagtgggagaattacccgaaggtgttttggagatctctgaggctctccctccatcacaagcccagagctctaggagggcagaatggtttcagaggagagtctcagagtgccctccttggtttctctgcccagggcggcctagggactctactccctgcattccagtgtagcagtcctcgaccactccagctgtggctcaagtgggcccaggtgcagctggtgctggtgctccagaaagtataagggtaatctttggtggtacctatatggtgcttattttgtaggcacacaaagtacattagctgtggggccatggtagcctctacctagatttcaaaggatgtgttggacagcctcagggcccaggcagagacatggtacagacagaagtcatagcagatttcccactatggcgatgcctggtggagccgtgggggtagggcaaaccccacaaccctgaccccagacctatagagctactagcatgtagccccagcctgggagagatgcaggtatgaaactccaacccatgagagctcctatgtgggctgaacccagcaaagctatacgggtgaggctgcctgagactttgagggcccaacctcaactccagtgtgttcagcacaagaagtcaaactttattctggagtcttaagatttagtgttcaccctgttggctttttggacttacctgagaccagctacccctttttccctgcttattcgtccttttcaaaatgggcatgtctatactatgcctgttttagttctaggattatattttggaagcacataacttgtttaacttcacaggctcatagctagagggaaatttgcctcaagtgaatcatgctgttagtctcaaccatttctaatttagataacattctggactttggactttgagttggggctgggatgagtgaagagtttagagtctattgagatagattgaatatattttgcatgtgagaaagacatgaatttggtggaccagggatgaaatgctataatttgaaactgttccccaaagttcatgtgttagaaacttgatccctaattcagcagtgttgggaggtggggcccagtgggaggtgtttggatcatggtggcactgccctcatgaaaatattagtgccattatcttagaagtgggctcatggtttctggggcgaattgcttataaaaggatgaatttggcctctcttgctctctcttgtgatgctttccatgtgatgcttttccaccatgttatgacacagcaagaaggccctcacaagacacggatgccttgatcttggatgtcccaggctccaaagggacgttttcattccaatggaatgaaaaacaattccattctttatacgttactgagtctcaggtattctgttataacagcacaaagtggactaagacgagcagttatgttatttacccataatcatataatatattagctgcagaatcaagtctagaattctgattcctaatttctagtcccatgtgatttctattacctaactccataaaatggatggaaatgtctgattctataaggaatctcaaagttccacagagtcaacatatagaacacataaagccaactttatgtgtttttttaaatgtaaatgtgactgatatctaatagctaaaaattcttatcaaatagctaattgttacataattagcacaagtggtaataattctaattactttctttcagattttagaagagctatgttgagaagatttgctaggcctctttaaaattttatcctaggaagttttaaatgggggctttacttttctcttgttaaattttccttaagctcagaatccagtattgcccactgatcaatattttcaaagatagatggcatagcactcaaacatttgaagacattactaaggccttgtcttgtgagttttcagaaagcagaagtcacttatatcttgctcccctcccccatcatctcaaactatgtcgaaatccttccaaaatggcaatcttcatgtaaagaattatttaaaaggagcagccattggcttctgacttaatataatggaaggaaattataaggcagatagtatgtgtatcagactgtctctgggccatgtccaatccgcagctgtgtgcccacttgttgcttctcttggtttgtaataaattttaatgggttacatctaggtcaataataaaaaataagcacaatgatcattcaattcactgaactctaagtctagctactagtgttccaactcgtataaaatctgtgttgaactataaatacagtagtccccccttgtccgtggttttgctttctgcaatttcagttacctgtggccaaccatggcttgaaaatatacagtattttgaaagagagagagaagaaccacataacataacttttattacaatatattgttattatttttctattttattattctcataatctcttactgtgcctcatttataaattaaagcttatcatagacatgtatgaataggaaaaaaacatagtatacacagatgattcttgatttacaatgttttgacttaaaaattttctcagctttacaatggtgggacagcgatccatgttctttgacttacagtagatttattgggatatgaccccattgtaagtggaggagtatcttttaggatttggtactacctgtggtttcaggcatctactgggagtcttggaacatatttcccatggataagggggaaactactgtacaattgtaggacttcagtatgtaattaggaaaagaaaaattaatttgttttcataaacaaatagatcattatagtttacatctgtaaacaatcatggtattcttctgtcaaaacctttccatatcttcttattagttacaaaatacaatctaaactatagagcatggtcttcaaggcaattcagtctgatgcctcaacctgtccatcaaccccatcaactgtattgtttcacttcaaccccagatgctaatcactccatatcatccagactgccttgaacgctgtatgcatttcatgaatctgtacctttcccaagctgcttccgcagttaaaattctctgatcctttgagactcagttcaagtatctatgatcctaggaaatctcttcaacaccccctctttgtcccctctcgtctcagcagaatccattgtttcttcttcattaaagttcccatagcatctaattctatttttatgaaagcatttctcagtcacaccttttttgccatttctgtttctgtttccctccccaaatggtgaatcactagaggaagtcaaggatcatcttatagtatccttgtgtctcaagagtttagtctacccctccacatgtttggtacccattaaatgtttctttaattggatttatgtaagagcttaagagtatttcccatgatttcatttgatgcccatagaaactccattaagcaggatggtaactgactccattaaagcaagtaatccaactgttttaggcttctccaaagagagagagagaagcaataggatggatggatagatggatggatggatggatggatggatggatggatggatggatggatagatagataaggaatttattaggggaattggctcatacaattatgaaagctaagtcccacaacaggccctctttttgttaaatcctttttgtattagttaagggcctccagagagacagaaccaatagaagatatacatctgtatctgtacatatgagaagagatttattaggagaattggctcatgcaattgggaggttgagaaatcctacgctaggctctctgcaagctggagaaccagggaagctggtagcatggctcagtctaatctgaaggcctcagaaccgggaaaattattggtgtaactcttagtctgaggctgaaggcctgagaacccaggtggccattatgcaagttcaagtccaaaggccagacagcctggagttctgatggccaaggacaggagaaggagagtgtcagcgctctgggagagacaaaaaaagaatttgtcttctgccttttgttatctctgggacctcagcaaattggatcatgcctgcccacatgagggaggatcttcctcactcagtccaccaattcacaccccaatctcctctggaaagacccttgcagacacacccagaaataatttttaccaactctccaggtatttcttaatccagtcaagctgactccttaatttaaccatcacagcaactgggcaccaaaaacagattagtgatttacctccaggtcatgtggtcagtcaatggcaggaccagtaccaacccctaggttttccaatcctccatcgcatactttgcaccatcgttgctcagcacctactgagaagtggggacatggtaaagagctaaggatgcttgcaacccaatattcatgtcacttcttgaggtttcagcagctttttcatgcatgcattggctccatggtcacatacaagaaccctctgctttctcatctaagagtttcagagatgccaaagtaacaggattgaggctgaacaatcaccttcatttctaatgtttttcctcacaaaccaattcagaaattcagaaaacatcttactatagtagttgtttcctgaattactaaatggaagctttattaggaagtattctctgttctttctaccaaggcagctttgttccttgggcataaacaaaactatcccttctctctctaaattgaccacagagccaaccttatataaattagaacttgttagttttggcttcagatgccggctctttctcttgaggttttcacctacttaaaattcacttgttgccctttaaattcacatctagcttaaggcaaatgtttgaatttctaaaataaaaccatgtgcccaaaataagcttagggaaaaaataactgaaataaatggaaaattctccaaaataagcaaaagcattaaaatgataatgctttaactttctgaactaaactgaaaataatgtatgctcaagataagcttacaaccacggagagatctctcttctacaaagccttaaagaaaaagcaggaaattacctcagatgaaacttcattacatggcatttccattcccaggatccatcctcagacacgttgacttaattgctctggaaaagagccccagcatcaatatttttcaactttctaggtggttctaatgtcggtcacaatcaagaaatgacatgaacaatattctgaatcatttcagtagatgttgactgcatgactgtgctttctaccagtcctatcccacaccccgcctttttcctaaaataggtatgcatgcagtgtgtgctctgcacacatgcacatacacaaacacacacacagtttcattcatttgtatattcattcaatcaataagttgaattttgccttcgtgcaaggaaccatgactatcagcacaaacaagaaactattcctgaccccaagagattcccagtctaggtgtggagaatatgaagcacagaaatgggaacaactctaggtaggaaatggaaagagagcaaatttttttttttaagaggcagctgggcacagtggctcacacctgtaatcccagcactttgggatgctgaggcaggaggatcattggaggcaaaatcaagtgtacctaacagttttagaaaattgtacatcgtatacttccactttccatcgtgacttctgttcatagtttatagatgtacaacataaagacataattcctaaataaacaaagcttctgtgaaagcataatgtgactctgcaggcctgctggcctgtcttattattgatctgaaaacaagattgacactactgtgattattctttagtgggaagggacattcatacttatttagccattgctatgctttcaggcaaatcaacccctcagtaactccaggcaaatgaatataggcctttcataaaaagtgtcttggagagaaagcccacaactgcaattaacaggaaatagctgatgcagtgtgacagcaagtccccaaacccttaatggaaggattgactgtcatgtgcatggagatgtggttagagaggaaataagttactgggttttgtaaggcaccaacttgaaaaacatgaaaagctgtggcaggccacaaacatggagcccatttggagtagaggcaggcaagtagaacggagaaccgtggcatttcaaccctagattaatctgagtgtcgcttttgctgccactacttaacaagagtagctgtagagagtgaaacatttttcctaaaatgtcatattttctctggtagctcctgttttcttctttgtatcacattatagctccacaaagttcatgcaaatgcataactaaattttgattatgagaggtctcagaatgcaacttgtttatgggaagaatatcattagtatagtttcaggcaattccttgcaaactatccccagtttaaaacagtcacaccttagtcaacaagcatctattgagcaacccactttcgacctggcattatggtaggtgcaaaggctaaaaaaaggtagaatgagatagaacctccacggaatatatacaataacaaattatttttttaaaaaactggatataacttgagaaactcttctgtacaggcattctggagtgagctgcaatccatcattattcagaaatgcattcatgcattacacctttgtcaagccaagttccaggttctgtgcttggtgctgggaagattgaaaggtcagctgaagttacagaaggccacgatgccagcacagctgctgcctactctttcgcctgatttatttctgttatttcttttacaattgtgattaaaaaaacacataacaccaaattgacgatcttaaccatttttaagcacaagcagagtcacgttcagtgactccacttcagtcaagttcagtagcattaagtagagtcacgtttacgtgcatctggtctccacaactctttcatcttgcaaacccaaactctataccatgaagtatccaaagtactcatatgtatcaaaacagagagtaggtggttgccaggttgccagggcatggtggagggggaagggaggagttgttgcctgatttctttttaaagctcagtcttccctttggcttctggttctaagcgtgttagcatcacggccccttttcattatcctaaaggacagacccagccctggttctgcaggtgctgaattctacttgactccaaagaggctcagcctctacctgcacccaggttctgctaacttggtctaccctctgttgtttttcctctctgttttgttcccatttgtaagatctctgccaaacttacttatttgctgcttttcacagacactagaccataccacctcctgggtattcacgatccatgcctggcccagctgactgttctcttattccaggctgttcgctgtttacctcgtccctcttcagcatcctcaatatgcctgcataatgcatatccatttttctccccaaattaaaagctatggccactgtatgttgaaaaatgcttaaaaccccacctaaacattccaggaagcaggaagccatgaatgactttaaaccaagaacagtctcaaaaatgttgtggtttccagtatgtgagtctcggacttcagcatattgctgttcatatgccacacaaatgttctgtaaagtcccattgagaattatgtgcaaatttaaatgctctccagacaatttcaaatatcagctttgatgcaagacttcacctgctaaaagcatctctttatggtttgacactacatctctgacattttgacgtgatacatattccatcagcctgatacattgccacctcccagtgagtcacagtgtcactaactcagaattaaatatgttgctaaaccactttacagcccttgcaaagcacataaaggctgtttgacaattacccccaggaaggcaaataatcagtacacctctgattctcttattattaaccattataaaatcatgtgctgtgatcaaggtgtgtaacaaagacattgatttttataagactacccaggaagcaaatacatattcttgatatacgaaacacacaggaggcctcttcattttcctttgtgtctttaatttgctcagagctgctcctcatacagcactggctttcacctgtcaagctaaggctttaattactgagttatggaaaaatcattgccaattgccttaactacaataataaagaatatcttacaaaggataagaaatcttttttcttcggctctgtagttaaaagactagttctagttttaatctgaacttttctatttctctccctatatttccctttcttcctattttaattgctggttagataattaagtaggtacctgacctgcaccaaatgtgcttgggaaagtctctcgtattttcgttttgctttgttttgtttctgcatgccattgaaacccctgtgttaattattctttccttacttgaagtatcttatacaacctttcttcaccagtatccttttcactaggccaaatacttattttggagtctcaaggatgattttctaaatcttttcataaccgcttttagcccttactcagttttattgtgcctgcccctcattgcacaaagggatatatttgactattccatggcatatttgactttgtaattcgtaaattatttttcatgtcttacatggttaaagatacgtttcacttgagcttgtaacagacataaaaatgacccatggtaaacctgtcgtattagaaaatcaaacaaaaagcataaggagataacacggtaaaaatgaaaagagtacaagctttagacccgtgtggatccgagttcatatctaacttggccaactaatagcttgttaattatgttaccttaggttgtattttttttttttttttttctaatttagtctcggggtctccgtgttctagctccgacccaagggggttcccgggacgtggttgtggatgttcagtgtgcctttaactggatacttctttatcctggcagacggcctgatgcccaggtgtgacttgtggccaggtgtcccacaaacaggaaaacctgtttacactggcagatggccttgtggcgtgctatagtctgaatgtctctatcctcctaaaatccgtaaattgaaacctcattcctaacgtgatggtgttaataagtggggcctttgggagatgattaggtaatgagggcagagccttcatgaacaggattagtgcccagacaaaagaggcccaaggaagcttgtccacctttgtgccatgtgaggacactgctggaaggcaccatctatgaagcagagagtcggccctcatcagacaccaaatctactgctacctctgtctcgggcttcccagcctccagaactgtaagcaatctgctgttgttgttgtttacaaattacccagtctaagatattttttatggcagcccaaacagactgagacatggcttttgtctgctctgtgtctagtgtatgttttgttttggttcggttttaagtttgtttggtttttggtttttggtttcgctttgtttttgtagacaacatcttactatgttgcccagactggtcttaaactcctagactcaagcaatccttcgcctcagcctctcaaagtgctgagatgacaggcgggagccaccacgcccagccaccctgtgtctagcttattcctaccaagagaatcactctctgtgaaagctctgagcagaaggagagttaggttcgcgtgtgttgctcaggtgagacaaagaggagatcatacagcaaaacacatgaaataacagaagcagcgtttgactcacagatccagagcagagagggcagcctgcctctcagggccaacaggaaaggggagctgtcctggacacgcaggctccaccagtgtggggagcaaaagagatcacaagagacctcagggcctaagactttgttggggtctcaggagttacccaagcaggtttcctgctgagagttctaatgggggtgggtggtggggggcgttacagcaacaattaccagtttcatggagccacactgtgcctgagcggtagtaactgtggcatctccatgcagtccatgcagcgggaggggtcttgggcgtgagtcaggtaggttgtattgagctgtcccctggggaggtgggcactagcagatacctggattgaccgccttgaggagctaggaggaagcagagaactagaaatcatgtcaagattcactaagccctgcatctgctatgagaaagtccaacttacaatcaaaatggatgcccaggcaacataaaattgtaagatttcgctacgccttaggcaatgaaacttggctgccttccagtgaatatttactgagcgtctagcttatttgagaaaccataatagacactacagggactgcgaagaatgggaaataaaccaattacacaatcacccacatagcagcgatacaaggccagccatatcaaacaacccaacagataaacagttcatatgttatatggtgtcagaagtaagacacatcaaaaaatggtaaaatacgtttgatactactgtccttataaaatcaccaaccataggaaaaatgatttttattaatgacagggatataatgaaaatagtttatgtgtgaaaacacataagtaattacataatacattatgatcaaaattagatacagcattgctgggcaagacctttttctcctctaatgctgtccttcaatattattaccaaaatatagcaccagtttttgtttttgtttgaggcagggtctcactctgttgcccaggctggaatgcagtaatatgatcatggctcactgcagcctcaacctcctgggctcaagtagtcctcccatttcagccttccaaagtgctgggattacactcgtgagccattgtgcccagccagtacctggttcttaattaactatatgaaaggcaaaatctgttttgctgctgagcaattatagtactatgcattatgtgtgtgtgtgtatgagtgtgtgtataacatgtagtttatatccatatataaactacatatagtttatatttaattgagtgtagacaatttataggttataatatctttagttataacattcacatgggtgtaattttttatactattctaatttatcattcctttctgttttaccttcaactctggttgaagtaatgtagttactatctgttttccgagttagacttccacttttcctctctggctacctgacaccccaagctagtgtaggtggctatatcattgcctggaattgaagtttttaagcctctgataattcagtctgtagaagctacccagctcaagaacaaaggggaaattacatatttcataacatgcttcaacatgaatgcatttaattagtatttataaatttgaatcaaaatgcaggaaatattctaaaaatataatttctctagaagagttatataatctctattaatgtaggccaactgcttctgtttcaaacacagaagaatgttcttcaatttttcatttgtgaaactgaatagtctcttctgaaagagtatatagtatttttccttttgggaatacaaaagcttttacaaaatgattatactaatcatcagatataagagtagtaccaattctctacctagaatagctgttaaccatggcacttggtgaattgggaatagacttaaatgatgcttctccttgggcccccacctccccaactcctacctttctcgaaaccaggctatttctctccaaatctcctttccttttgattcttcagttcgtgctacatgataactacttgccattggtcattaattatggtcgacgctcattattcacaggagtatgacccataaaatcactgcaaacactgaataagttaatactgaaccattgcccctagagggaattcagggttaagttcctgcaagcctctggtcacagtatattcatcaacctatcaatacataacgttattttatgcatgtttctgctttaagacatcttacttaacatatgtttttgattcattaacactgaactcatggccaacagctctataactaatgtctgaaaaaagcttatctaataggcatgttttccccataaggcacatcacagccttcttgtgcttaggaacactggacgacactcaacactgcgcttgggggccatttgaaacagtaatatcaccaataaaaaaaaagcacaaaaatgtcagggggaaatgtggcagtaaataggctgtgaaaaagacatttgtttgcagtatgagctaaaagaaggcagggcatcaccttgttctacatcagtagggatcatgagtgttatgccactcaatttttttgccagcctgtgtgtacacgtgtcctcaaatgaccatgaaagcactgcaagtatagatttggggattacaaataaatttcaacaagtagatgagtttgcaaacatggaatccgcaaataattactgttgactacaccatccttttgaacaaaaataaaagccacaattcaacttgagattggttatagatggcaactggcatttagtgagcacctgctatgagctgggtgccttacttttttttttgttttgagacagagtctcgctttgtcgcccagtctggagtgcagtggcaccatctcagctcactgcaagctccacctcccaggttcacgccattctcctgcctcagcctccccagtagctgggactacaggtgcctgccaccatgcccagctaatttttttttttttttagtagagacggggtttcaccctgtgagccaggatggtctcaatctcctgacctcgtgatccgcccgcctcggcctcccaaagtgctgggattacaggcgtgagccaccacacccagccactgggtgccttacttttagtaacacattgacctgggatgtgatcaactcgagaaccacatcactgtcatgtagctgcatggagctgtatcactcaacttctgggggcttatgtttcataacaattatcttttataaatgttcaatttaaaaatgaaaaacttccccaccccaatcaccacctcctttccccctctcccttccctttaatgaaccatctaagggaaggacatgtgtgcttctttgacatttcttcacagaatccagtccaatggcagggaggctgggtgagggtcagtgtcagcctagccagtagggaatccatggagctggggcatgtcaggggagtgtctcttactgagaactctgggtcctcttggatcaaagaatgtgcaaattgagctaagagatagaggggaattcgagaagatcacctaaaatgggcaaacaggaggaagctagatccaggtagcctgggagtcaagaacagtgagccctgtgtgagctaaaaaaccagaagcaaaccttggccaatggctggagctggtgtttttgctcaagcctggctttcatgggctccccttgatgtgagtctcagagtagggctggttaagtggccaggacctgagaaataaaatctcccttatatactcttgagagaacaagtctaacatatcagtaaggtaatagctataaaaatgtggctaggccgggcgtggtggctcgtgcctgtaatcccagcactttgggaggccgaggctggtggatcacctgaggtctggagtttgagaccagactggccaacatggtgaaaccccatctctactaaaaatacaaaaaaaattagccaggtgtagtggtaggtgcctgtaatcccagctactcgggatcctgaggcagaagaatcacttgaacccaagaggcagaggttgcagagagctaagatcatgccattgcactgcagcctgggcgacaagagcaaaactccgtctcaaaaaatagaaaaaataagtggctaagtcagtagtgaaactacgaagctaacttattacatttttcaccttttgaactttcaaacttgagtcatttatggacatctttgaagggaacagttattataaactctcactgttgacctaattaacattataatgtcaattatatatgtatagaaagaattctagatatacactcctgctaatatatttctaagattttttaatgttttatgatatacaaatttggatataagaaaaattataaaaccaacaaaattaaaactagtaaagtgaatgtaacgagataggctgtatagttcacaccacacaatgtcgtttagtcgacagtggaccgcacagataacagcagttccataagattatagaggagctgaacatttcctatgcctagtaacatcacagctgttgttaaggtcctatcacaacacattactcctatgtttgtgatgacactggtgtaaacaaacctactgcactgccaggcatatagaagtgtagcttatacaattatgtacagtaatacttgataatgataatatttgactatgttactggtttatgtatttgctatattatattatacattttatcattcaagtgtattccttctacttattttaaaaaatttgctgtgaaacaggcagggtacagtggctcatgcctgtaatcccagcactttgggaggccgaggcaggtggatcacctgaggtcaggaggttgagaccagcctggttaacatgcagaagcctcatctccatgaaaaatacaaaaattagccaggcatagtggttcaccctatgatcccagctactcggaaggctgaggcagaagaatcacttgagcccgggaggcagtttgcagtaagccaagatcgcgccactgcactccagcctgggtgacagaacaagactctatctcaaacaaaccgaaacattaagtgtgaaacaacctcagcaggtccttcaggagggattccagaagaaggcattgttaccataggagctggcagctctgtgtgtgtcactgcccctgaagacctcgcagtaggacaaggtgtggaggtggaagacagtgatattgatattcctgaccctgttaggcctaggctaatgtgtgtgtttgtgtcttagtttttacaacaaatatttaaagtacaaaaatgaaaaaattcaaagtagaagaaaaggctgatagaataggatataaagaaaaaatatttttgtatggctgtacaatgtgcttgtgttttaagctgtgttatcacaaaagagtaaaaaagttaaaagaaattaaaagtttagaaagtaaaaaaagttacagtaaactaatgtgtattaaagaaaagtatttttttacaaatttagtgaagcctaagtatacagtattttttaagtcaacattagtgtacagtaatgttctaggccttcacgttcactctccactcactcactgactcacccacagcaacttccagtcctgcaagctccattcatgataagtgccctatacaggtgtgccattctttttatcttttactctgtatttttactgtactttttctatgtttagatatatttagatacacaaataccattgtgttacaactgtctacagtatttagtacaataacatgctgtacagatttgtagcctgggagcaacgggccatagcatatagcctaggtatgtagtaggctatacagtggcagtttgtgaagtgcattctgtgatgtttgcatgacaacaaaattgcctagagacacactcctcagaatacatctccatcgttcaggctcagcaatgcatgactgtattagtaaactaaatttccactttcaatgagaattttttcagtgtagcttgttttgagttcattttgcctatacactataagtttgtgataattcaattttgctactacttttttctaatcaaactactatcaaatctccacccacagagcatacttttatgtaatttgctttcacttgggccaaatatcatttttgtattaagttggcctatgttcttttctcaataggtaaccaaaattaaagcagtagcatttggcagcaattacaaacagaaatgagagcatttatgtcctggcgggagttggttgttaagtggccatccggaagttatgcaatatgttttctttctcttttcttttctgtttttttttttaagattgctattgaaatgaaaacagaaactgcaccaactgatgttaaagataaatacaaagccatcgtaattaaaagagtatgtcacaaatgcaagaataggcagaaggatcactggaactgattagaatgtcagaatactgtttacataagaagtagtgcatactgaaactggcaatttaaatgaacggggatcctgcagtgtaaaactctgaaataaacaaacaaataaataaacagggatgaagacaaattttgctaagaaaattatgtgactatactttaaaaaatagtttctattttacgttagatgctaaaatgaattccaaagaattacagacttcaatgtgcaaagaggaagaatgcatagaaaagtgatactaaaagcaattcagtatttttctgttctctaaattttaaaaagcccttgtggctgggcacagtggctcacgcctgtaatcccagcagtttgggaggccgaggcgggtggatcacgaggtcaggagatggagaccatcctggctaacacggtgaaaccctgtctctactaaaaatacaaaaaattagccgggcgtggtggcaggtgcctgtagtcccagctgctcgggaggctgaggcaggagaatggggtgaacccaggaggcggagcttgcagtgagctgagatcgcaccactgcactccagcctgggcgacagacagagccagactccgtctccaaaaaaaaaaaaaaaagcccttgtaagcataaatacaaaggaaacttggtagatatggcaacataacaattaaaagttcatgtaagtacaaaaatcaacaaattaaaaactgagaaactggaaaaatatttgcaatacattgatataaaaatcataatatgtttttaaaaacttttaaaaactagcaacaaaaagtaaaagatgaacaaccaggtgatggaaaaaaaaaaaaaagatccagaattgttcagtaaaggtgtaaaaagtgtttccaatcaaagaaatacaaactgaaacaagaatataatattttattttggttttggttttgtttaataagcagaaaatggtgaggcatttttgacaagcaattttgcaagacagatcaataatctttaaaacgtatgtagttcttgagcaaggattttcacctctaaaattatatttcaaagaaataattgtagaccacatgcaagattttttttacagattatttgtcataaagttatatataattgtgaaaaatgcaaatcaatgatatctgtcacccagaaaggaaggaaatggttaaatacatttaagtttagccgtataacagtattccttaaaaataagtctcctaggccaggcacagtggctcacgcctataacccagcactttgagaggccaaggtgagcggattacttgaggtcgggagtttgagaccaggctggccaatatggtgaaacctcatatctagtaaaaatacaaaaattagctgggcatagtggcgcacgcctgtagtcccagctactcgggaggctgagccaggagaatcgcttgaaaccaggaggcagaaatttcagtgagcctaaatcacgccactgcactctaggctgggtgacagagctagactccgtctcaaaaaaacaagaaacatcacctaaaaaaaagtctttgaagactattaacatggaagcatgataatggtataattttaataagaaattatgatagaacactgatagaatattatcccagttttacaattccacatgtatttacatgtacctgggaaaattataatgaaaatgttaacacatttttttcttgtcagtaagtgcaggggaaccttacattttctttatggttttctgattattccaaatattgtaaaatacacattattcatatacttttaaaatgtggatcttaactgttttcctttaatctgctatcttacctttttaaatctaggaaatgtatgtatctcaaaatggtaaaactgaatatttaatattctagaaattaatgttttataaatcttaattttcttctcagtaatattgtataattttaaatattggcagattgtcagctatggctgtgcctatttaaagccaaaactcctgccaattttgtgaaaacttacgctcattatctagatttttgtttgtagtacgataaatattttcaccgtactttacctgctttggcaaaagatagatggcagaagaaggagctgattaaataaccaataaatacaagagaaaatctgggacattttttgcttttattattactttttataccattatgctggtaaattatttataatattatgattatgctaggattatagaacgaaaggtaataagttttatggattgtcagtaataataattactgtaaattgtcttttaaaataatgaaggctaaaatacttaggtattgagagtgttttcttcttgctactctgtgatgtatcgttgcagcaggctgagataatggaaaaggctgagagctacaagccaaaaagactgggtgttgagtctctaattccacttcttttttttttttttttttcaagacagagtctagctctgtcgcccaggctggagtgcagtggtgtggtctcagctcactgcaaactctgcctcccgggttcacgccattctcctgcctcagcctccagagtagctgggactacaggtacccgccaccacacccggctaattttttgtatttttagtagagacagggtttcaccgtgttagccaggatgttcttgatctcctgacctcgtgatccacccgcctcggcctcccatagtgctgggattacaggcgtgagccactgcgcccggctaattccacttcttattagctctgggattgtggacaatttctctaggcagagcttcctcgtctgtaaaatatgaatgagtctaatatgtatgcatctagtaatctgatttaatcacaaaatgggactagactatacagtccttaaagaatctatcactatgacttctctcagtggcctttttttttttttttttttttttttacagagctggataataaagagcttagaattttattcctgaaaggcaactagagtgctaggcattctgggtttctgatagaagacatgcacataagctttagcaaacactcagaactctatgctccctaactacaacttcgccagagtgcagaggccaactcttttcctttaaaaaactaactccaggatgtgttcacatggtcaataagatctatagttctttgctgatcatcccctgggaaacttttaaaatgaagtctgacacattacaaaccatgcacagaaacaaacaatatcagtaaaactctcaagtaatgcgtggttttgagccatgtagagtccaggtaagccttccaagcttggttaggtgcaaaacatactttctccagtatgtaaattaataggaatctttttttttttttttttctgagatggagtctcactctgtcagccaggctggagtgtagtaccacaatctctgctcactgcaacctcttcctccctggttcaagcgattctcctgcctcagcctcccaagtagctgggattacaagtggacaccaccacgcctggctaatttttttgtatttttagtagagacgggttttaccatgttggccaggttggtctcaaactcctgacctcaggtgatctgcctgcctcggcctcccaaagtgctgggattataggtgtgagccaccatgcccagcctataaataggcatctttgatggccttttaaaacaaccagactttgtaggctatctgcaaaagataatagtttgaaattttaatatttatttaaatagtcctcctgatggtaactgatcactaacttttgaagtgcgttgggttggactcagtaaaaatctcagcaatagcttataggaaattattcttctgttttctaaggcaggaggctatgcacccgtgtcatctaaaagagtggcccatggtgctatggagcaagccaaatcttcattgcagtccagttctgtcatttaccaaatctgtgacctccagagagctgttttattaatctacccctcagcttcttcatctgtaaaatgggacaatgatagcccttctcttccagattaggcacctaatgcagaacctagtgagatctaaatatatattagctacatctattattatgtttataaagacaaaggataaatggtagtcctgttttgtcccactcaaagctgttctctgagccacaaaaagactgtttcagctgcatgccaagttaacacattgcagttaagaaggaaaagcattgcagttaagaaggaaaagcattgcagtagagactagtccgtgaacatctttgtcctcaccattcctatcgccttcttttaaatgaaggaggcagtgggtttcttatattttggtccccatgattttgcaatttatagccttgataacctggccacagctaattaagccaaggttcggggctcattccttaggccgtgatgtgcaacttggcctgtaccctctaacatggcttctcatgagaactctacctaacagaaagttctgtgttgaatagcgatgaacggattcactccaaccttctctcagtgactttgaataaaagatatgcagactgtatagcagcctaaagagtgggctctgttccctcgcaaattttagcatactcattgagaagggagggagctttggggagacagtgagagaagagaatttaaacattgtgggcaatttcttctgcccttccatttgctgtggaattttccagccattttatgttctgtggatttttcatgcttgatatggttggtttctgggatgtgtttcagtcaacattgacccaaaaaccatgcagtcagttttctgtctaaaagccaaagctgtaacctcactgatattgcagaaatgtttctatcactttctgacccctaaaagtgcatgtctcttagatcatagctttgctggtatcaagattacatttttaacagtataaaccttttacatatgcagtagcaattagaatgctctccccaagaggaggacattctctgaaatcccaagtaggagtgaacccagagtagcatagcatatctgctaacttgattccatctgtctttgttgcaacatgctcactgagcatatgcccctaaatgaatatgagatgaagacaggatctgtggtccctcccgcaacattgatggggtaagtttttttgctaggctgagtgtggttcaaatatttttgtacaatatatatcctaaacacaaacaactacttcgtctgttgcccacccaaaaatatgctgatctgttttgtgctgaagtatgatcgttcgtgttggcgtccttgagaagtaatgggataaggtacttgaagggcgatttaagagctttccagagcagcccttggcttttcttaattttccagttttgcaacaacttttagagcccaatcctcatgtaagctttggatccactggaattaaaagctcagactttatagacaaacagacctgggtttgaatcctatttccatcacttgcctttaggaaagttgctcaacttttctgagtcttcattttctcatctgtgcccaccctcttattgcagtgaggcttgagtggtattcacagccctcggtgcagtcacttccatacataagagccactgttgttgttaacatagtttagaagttaagagagtcacaggcgtcgtaaaccctcagatagtaccagtcatgaggaagcagaattcactaagcggtgggtaggagggtgcacaagtagccaggtatacaagtagccgggagctgctgagtgtcccaggtctccatgaggatcaatcgctcaatagcttggatagtctgcgtgtggataacacatcagcaaggaatagagacaacgccttaaaacagactttcagcatttctggtgtcgaaaggtcctaacatgaggtctcactaaattcgagatttcatcagcctgagaagaactcagggtaaaataagagtagtaatacacaccccttttaacctgggttagaatgcgtttatgagtgtgaggtgatcttcaagtataaagccctatgtggatgtaacatgatagcagattataaatattaatagcattttaagtcaaagataactatttagaattgtgaataatagagaagaaagactgtgggcatcactgtacctcctaccctcagttaaaacttactgaaggaactgaaggttaaacattcttgataaccattgtatttctgcagtgtctcagaagtattactagaagacaagcatgggatttagagttaaactaaccttgggttcaaatcataatgctgccactccttgactgtgtgatggtggagaagttatttcacttctctaagcttcaaattctctatcagaaatgttttttctgtagctatctgcttaggaacaaagagaaaggcagcttcctgcatgactcagcttccagcttattattattattattattattattattattattattgttattatttgcttttgacaaagtgaactgaggtcccaagtttttatttccctttcacagagtcaagtttattggtataatcctgctaagaagtacttaaaacaaaaactagctattcacaaacaagtcaaatatataccctctagagtgtgttgataacgtgacttagtacatgaagagagagcatggtgttcaattgtgcaggtcaggtgaagctagtctttcatgcctcatcacaagtagcagatttccattaagaattggcaagctctcaaagctcagactctcccagagcagagcaaacaggcagatgcgaatacatgcctatcccagcagcatctgtttatgccagtggggagaaaccatcccctccacacacggttaaacaagtcagtgtgcagcctacctccagggcccttctcgttttgcctgggaatgtcctgggtggcttgtaggagatgaggatgcagcttggggcagccaaacctggggcatttcagaggcagagtataattcatgtggcaatacctggctctttatggcccgtagttttacacctaccatcctctgcacacagaaaactttaggcagaaatggagcatgcacaaccaggtctgcatatccgagagtggtcatttccttgcaaggcgtgtcgcttgactgaggggactagggggctgcagaggggctggcagatgtttggcttttggtgcagatatgagccaaataaattgaaaataggaagaaggagtacatgacctcacccaaattttaattcccatagaatagttttttgtttgtttgtttttagcgttgtatgcctaatagggtaaatgttattcaaaaaatagcccaggtgttagaaagacaaaatagttgttacctttagggaaatggttgtgaacaaaaggggcacacagggggtgtctgggccactaataatgttctgtttcttgatgtggattcgagttacatgggtgtgtcactttatgaaaattcatcaagggccatcaagggctcggtggctcatgcctgtaatcccagcattttgggaggccaaggtaggcggatcacttgaggtcaggaattcgagaccaacctggccaatgtgatgaaacccaatctctaccaaaaaaataaaaaataaaaattagctgggcgtggtggtacactgctgtagtcccagctgcttgggaggctgaggtgggagaatcacttgaacccaagacgtggaggttgcagtaagtggagatcatgccactgaactccagcatgggtgacagagtgagaccccatctcaaaaagaaaacaaaaacaaaaggtctggcacggtggctcacacctataatcccagcacttttggaggctgagcagactaggatcacctgaggtcaggagttcgagaccagcctgaccaacatggtgaaaccccttctctactaaaaatacaaaattatccgggtgtggtggtgcatgcctgtaatcccagctactctggctgaggcaggaaaatcgcttgaacccgggagagggaggttgcagtgagctgagacggtgccccattgcactccagcctgggcagcaagagcaaaactctgtctcaaaaaaaaaaaaaaaaagaaagaaagaaagaaaattcatcatgctgtatacttataatctgagtatttttcttcatgtaggttattaaaaaacagcagaaatattcttctctcaaaagaaatttctatattttaaaatatgcatatttatactatacatatatttatatttaaattatatatatatatttagtaaggaggggaatacatataacttgatacaaagtctgcactaagttagaatatatctaatgcaaattaatacttgagtgcatattaagatatatcaaaatttaaaaattggtcaaggtttttaagtgctttgacagttacagtaaggtaaggttctacataaaataacatgagtattgtcagcttccaccttacatttccaggaatagtcatttttcatgcattcattatattcttttcagcatcatttgcagagtttttgaacttctaagctgtaccacacagaaatgccataacactcattttgactatttcaacaaagtattataactaagccattaattgatccactagctttgctgttgggaaaatttacttattttgtaaatacagccacattgacttttaaagtcatctaaataagcttgttattaaataaaaatgttttgaaccttaaaactgctttaaatgattttaaataaatggtttatatttttttctcagtagtaataatttttctgaagtatttgcttattgtttttaagtgatttctttatacatatatatgtatatttacatactatgtgtatatattaggcaatattaaatgacctgaagcttttgatcaattctaatagaacagacaattgcaattctaaattagctctcataaaatggaacattttgcaagtagctaataaatatttgttgatcaatagttataccttgaatcctttatctattagaattttccagacaacaaactcatattgtttctcctttaggttcatttggatgtatcaacatagtaactcttgttacaaaaatattttaagtttaaaatcaattatttggttaaattctgtatgcatattttaatagttaatagacaaggtaaaatcagctcacttccatgtgttcaatatttattgcttgaaaattaaggcttataaattagagtatgctaactatgcctttttgttatagatcctcagcgctgttggttgtattatggaatagttaagtataggctctgctctccagacaccaaaggtttaactcagctctgtctttcaccaggcttgagcaccaaaggggaagtcagagaaaaagtaacagcaagtgaaataaaaatagaattctcaaaagcaatagttgaaagacaagaccacagaatggtatgatcaaagtgttgagagaaagagaaacagaaattgagagtttgagaccaaaaggtttttcattaaagcaatctctaaaggatttacttaatttttttaaataaaagaaacccagaagaaatgtctgaggtgtaagaagtattgatcaaagacattaatgaagatataggttaaaggtttttaaaactgtgtaataaaatattaacatcaaaattaatgtgttttaaaaaggagtaaatgaaacaattaaaaatgaagtctgttagaaagagaataatcaaaattacagttttttaagatccttgtattttaagaggatttaaaagagtgattaactttagactttcttaagtatgtaagatagaattccaaagtgcccactttttaaattttttattatttattttttgagacagactgtcattctgtcacccatgctgtagtgcagtggcatgatcttggctcagtgcaacctccacctcccaggttcaagtgagtctcctgcctcagtttcccaagtagctgggactacaggtgcacgccatcacgcctggctaattttttgtatttttagtagagacgaggtttcaccatgtcggccaggcctatctcaaagtcctgatctcaagtgatccacctgcctcgccctcccaaaatactgtgattacaggtgtgagccaccacacccagccttcaaagtgcccacttaatattaaataatatataacttcaaaaccagaatgggggaggaaatggattaagaaaacaaatataaatcatctattcagaaagactaaacaatataagacaataggaacaagtctgtctttcttgcttttacatgtgtgcatgtgtgtgtgtagtctagatacctagatagttagataaatagatatagatagatagataaacagatatagatagatagatagatagatagatagatagataaacagatatagatagatagatagatagatagataaacagatatagatagatagatagatagatagatagatagatagatagatagatagatagatgatagagagagagagagagagtgtgtgtgtgtgtgtgtgtgtgtgtgtgtgtgtgtgtgtgtgtgtgtttagtccatggcagtggactaaatatactagctaaaagatcttgtcaaattagtttaaaaagaagctaagtggtttttttaagacacatctgaaataagaggactcagaaagcctgaatggaaaataatgaaaagagacataatatgcaaataataattaaaggaaaaaccgggtaactataatagcaggtaacaaagacttcaaaaacctttttagaaggtagaaaggatactgaattatggcaagcgattcattttgccagaagaacttagcaattttaaacttgaattcgcaaaatactctcaaaatatataaagcaaaaattgacagaagtgcagggagaaattgataactcaaatatcatagaagaaaatgtggcatattaatttcagaactgatcatttaggcacacgacaataagtaaaaatagaggtttccaccaatataatttaaaaacttgattgacataaagtctaaacaaaataaagaacacacattcttctaagatataaatgaaatgtttaaaacatttatgactttctaggggaaggtatcttaaaaatacttagaactgaaggacaataaataatcctataaataaatattcatgagatgcaagacaaagatagttgtagttattttacactttaaatgcttaagtaaaaaatgagttaaggctagaaactcatagctaaattcaaataaagtaaaagtatgtgatgatgtaagagcagagcttaatgaaataaaacttgaagttatagtagggaggatcaacatagtcacaagttagtttcttgaaaacagaaaatcctccagcaaaattggttaagaaaaaaggagaacaccacaaataatcaatacaagaaatgaaaatggagataattataggtagcagacactttaaatgacaataagagaataccatgaacaaagctggccaaagcatttgaaaatttaggcaaaatggatgaattccatctatagtatatatgtatcagaatattatttttattgaaagatattgtcactgggtatcgagttctaggttgacagttcattatttttttctttcttattttaaaggtgtggtcctactgtcttctggattgcattatttcctgtgagaaatctgtcattgatatgtttgctcctttatgggcaattgtgtcctttttctctggctgcttttaagaatggccttatgatatacctcagtgtagtttcttccattcatgttttaatttaaagccattatctcttcaaatattttcatcactctcccaacccccacttttggaaattcccattatacatattgtaccacttgactttgccccacagctcattggtgctctttccttttttcttttttcttttctagtagcttttttttcctctgttttttattttggatagtttctatcactgtcttcaagttatctaatcttttcttctgtagtgtctaatctgctgttagccctttccagatattttttctttttttaatttttttttttatttcagtaggtttttggggaacaggtagtgtttagttacatggaaaacttctgtagtgggtgacaacccactctttgggttgtctgtttactctgctgattacttcttttgaggtacagaagctttttagtttaattaggtctcatctatttatctttgtttttgttgcatttgcttttgggttcttggtcatgaagtctttgcctaagccaatgtctagaagggtttttctgatgttatcctctagaatttttaggatttcaggtcttagatttcagtcttcgatccatcttgagttaatttttatataaggtgagagatgaggattcagtttcattcctttgcatgttgcttgccaatcatcccagcaccatttgttgaaaagggtgtccttttcccactttatgtttttgtttgctttgtcgaagatcagttggctgtaagtatttgactttttttctgggttctctattctgttccattggtctgtatacctatttttataccagtaccatgccatttggttgactgtagccttatagtatagcttgaagtcacgtaatgtaatgcctccagatttgttatttttgcttagtcttgctttggccatgtgggctcttttttagttctgtatgaatttaggattttttttctagttctgtgaataatgatggtggtattttgatgggaattgcattgaatttatagattgcttttggcagtatggtcattttgacaatatttattctacctatccacaaggatgagatgtgtttccatttgtttgtgctatctatgatttctttcagtcctagccagagcaatcagataagagaaagaaataaagggcatcaaaatcagtaaagaggaagtcaaactgttgccgttcactaaggatatgattgtatacctagaaaaccctaaagactcatccaaaaaacctcctaaatctgataaatgaattcagcaaagtttcaggatacaaaattaacatacacaaatcagtagttctgctatacaccaactgcaagcaagctaagaatcagatcaagaactcagcctcttttataatagctgttaaaaaaaaaaaaaaaaaaaactcaagaatatacctaaccaaagaagtgaaagatctctacaaggaaaactacaaaacactactatcttttgtatttttgtttcagtttcattgagttttactccgatctttgttatttcttttcttctgctgggtttgggtttgctttgtacttgtttctctagttccttgaggttttaccttacattgtctgtttgggctctttcagactttttgatgtaagcatttaatgctatgaactttcctcttagcaccaactttgctgtatcccagaggttttgataggttgtgtcattattatcattcggttcgaagaattttttaatttccatcttgatttcattgttgaccaaatggtcattcaggaacaggttatttaatttccatgtatttgcatggttttgaggattccttttcaagttgatttccaattttattccactgtagtctgagaaagtacttgatataatttcaattttcttaaacttactgagacttgttttgtggcctatcatatggtctatcttggagaacgttccatgtgctgatgagtagaatgtctattctgtggttgttgggtggaatgttctgtaaatatctgttaagtccatttgttctaggatatagtttaagtccattgcttctttgttgactttctgtcttgatatccagtgctgtcagtggaatattgaagccccccaatattgttgtgttgttgtctatctcatttcttaggtctagtagtaattattgtccaaatttgggatccccagtgttaggtgcatatatatttaatattgtgatattttcctgttggactagtccttttatcattacataatgtacctcttcgtcttttttaactgatgttgctttaacatctgttttgtctgatatatgaatagctactcctgctcacttttggtgtccatttgcatggaatatctttttccactcctttaccttacatttatgtgagtccttatgttaggtgagtctcttgaagactgcagatacttggttgaattcttatccattctgcaattctgtgtcttttaagtggagcatttaagtcatttacattcaacattagtattgagacatgaggtactcttctatttatcatgctagttgttgcctgaataccttgttttttgtcaccgtgttattgtattgtatgccctgtgagatttatgctttaaggaggttctattttggtgtatttcaaggttttgtttcaagatttagagctccttgtagcaattcttgtagtgctggctttgtagtggtgaattatctcagcatttgtttgtctgtaaaagaccatctttctttcatttgtgaagcttagtttcactggatacaaaattcttggcttttaattattttgtttaaggaggctaaagatagggccccaatcctatctggcttgtagggtttctgccgagaaatctgctgttaatctgataggttttcctttacaggttacctgatgtttttgcctcacagctcgtaagattctttcctttgtcttgactttagataacctaatgactatgtgctaggtgatgatctttttgtgatgaatttcccaggtgttctttgagcttcttgtatttggatgtctagatctctaacaaggccagggaagttttcctcaattattttctcaagtaagttttccaaacatttagatttctcttcttccttgggaacaccagttattcttaggtttggtcatttaacataagctcaaacttctttgaggctttgttcattttttaaattcttttttctttttttctttttttttagtttgagatggagtctcactctttcgcccaggccggagtgcagtggtgctatctcggctcactgcaagctccacctcctggattcacgccattctcctgcctcagcctcccgagtagctgggactacaggcgcccaccaccacacccagctaatttttttgtatttttagtagagatggggtttcaccgtgttagccaggatggtctcgatctcctgacctcatgatccgcctgcctcaacctcccaaagtgctaggattacaggcgtgagccaccgcgcccagccttaaattcttttttctttgtctttgttggattgggttaattcaaaagcctcgtctttgatctctgaagttctttcttctacttgttccattgtactgaaactttccagcgtatttttcatttctctaagtgtgtctttcatttccagaagttttgattgtcttttatttatgttatgtatttctctagagatttttttgtccatatcctgtattattttttaaatttctttaagttggttttcacctttctctggtgcctccttgagtatcttaataatcaacctaccgaattatttttctggcaatttgaagatttcttattggtttgaacccattgctggcgagctagtgtgatcttttggggtgttaaagaaacttgctttgtcatattaccagaattgtttttctggttccttctcatttgggtagaccatttcagaggaaagagctggggtttaagtcctgctgttcattctttggtgccatggggtgatgccttgatgtggtgctctccccctttccctagggatggggctcactgagagctggactgcagtgattgttattgcttttctaggtctagccacccagtggagctactggactctgacctggtactggggagtatctgcaaagagtcctgtgacatgatctgtcttcaggtctctcagccatggatcccagcacttgctctggtcgaggtagtagggaagtgaggtagactgtgtgagggtctttagttgtagttttgtttagtgcatgggttttcttgaatgttggttgtgctagcagttagttggcctccagccaagaggtggcacttttaagagagcatcagctgaaacaagcttgtcctaagtttgcctgaataggtatttgggcttctcaggtgatgggttggaccatagcgctcccaagagattgtattttctgtcttcagctgccagggcaggtagggaaagaccactgggtggagccaggattaggcgtgtctgagctcagcctccccttgggcagggcttgctgcagccactttgaggatggcggtgtggttctcaggccaatggagttatgttcccagggggattatggctgctctgcagtgtcatataggtttccagggaagtgggggaaagtcgtcagtgactggcctcactcacttcccacacagccagcaaggccagtctcactcccactgcaccccaccgatagcactgagtttatatccaggtgccggtgagcagagctgaggtcttgtcccagactacaagcctcccagctgagaaagcaagcaggactttcaggccccacctctccccacctgctgtagcttctttgctcatatctacactttctgttcaccccctaccccacccctgccccagattgtgcccagaaaaattcatatttggtcaaaattattacaaagttcagctagaagtttccttttccctgttgtctttccccagttccactggcagccctccccaagaacctctatgaggtaaagtcagaaacggcttccctgggcaccaggaatgcctacagggctctttctgctgcttcttctagttttatatttcactgggctctctaaattcatttcagctctaggtaaggttaaattcttctcctgtgatctgaatttacatgttccccagtgagggtatgtgttcagaagtggactttccctcctcacgctttgggcactcacagtgtgaatttcactttgttgagtgtagatatttttatatcctatattatgcttaagctttgttctgggatgaaattaacttattgaaaacagttgatcctttggagacttgcttttagacttcatgaggtgagaccagcacagcccttttctagggctgattttttcccaataatgttataatttccttttgagtactgtacctaataccctgagttacaaggttttgcactcagactggtgggaacatgaattattcttaatctgtgtgagtaggttgttccctcagctcctttcaggtgagttttctctgacccaggttgttttattacacacatgaatttattggtaccttgctgaagacttaagggacacttctgcagatcacttaagttttctctctgtacagctctctcctgtctggtattctgttctgaagaccctagactaccaactctgtctcctcaagtaaggagctcaccaggttcctaagtttcccttccctgcactgagacccagaaaattttatcaggcagtaggctgaagcaattgtggggttcacattgtttgtgtctgtctctcagacataactgccctgccctgcctgatctctatgactgttttatatattttgtccagtcttttagttgtttcagacaagagtaagtcaaatcctgctactccttctcggctggaagtagaagtttctagtcttatgatttttaactgttgtcagctaattaaaatgtaaagttttataaggacttcataagtgtatgcaaatgctcctaaggctttcctggatgtcagtttaggcccccaggcttcaggattaatctttaattaatactctgagtggagacagggaaaagaagggtgaatgaagtttctgtggtctaagaaatcccaatagacaacttctggagaaatgacaagagagggacataagcaatcaaaaagaagggcgaggccgggcacggtggctcacacctgtaattccagcactttgggaggccgaggcaggcggatcacgaggtcaggagattgagaccatcttggctaacacggtgaaaccccgtctctactaaaaacacaaaattagccgggcatggtggcgggcgcctgtagtcccagctactcgggaggctgagacaggagaatggcgtgaacctgggaggcagagcttgcagtgagccaagattgcgccactgcactccagcctgggtgacagacaaagactccgtctcaaaaaaaaaaaaaaaaagaaagaaagaaagaatggggaggggacatatgcatctccatctcaactctctaaaactaagactcagacagagattttggtgaaaaatgtgtgcctaataaaatacttgctctaaaaattagattctagatattatctgaatatgtgccagtcactattctaagcattttacatatgtggatgtatttaattctctgacaactgcataagtaagctattatcatctccagtttatggataaagaagcaggctaagcaaattccccaagatcccatagttaaaaaatggcatggctcagatttcaatccaggctctgtaactaatatattatctgctaagaatatcagtcttatcatgtttagttctctggcttaaagtccacaacataataaaagtgaattgtagatgctgagatgaagatattaaatgtaaatacaacaaatacaaggaaaaataaaaactgacaatttgtttaaaagggcaaggacatagaatcctctgaaatagacattgcactgagaagtctatcactagcatattaaggaatgaagactcagataatgaacttgctgttaaaaaagcaaacctctgttaataacttttaattaaacctttgattatatttttaaatgttttttatttcttaaaaaacagttttgggctgggcaccgtggctcatgcctgtaatcccagcactcgggaggccgaggcaggtggatcacctgaggtcaggagtttgagaccagcctggccaatatggcaaaaccctgtttctactaaaaatacaaaaattagccaggcatggtggtgcacacctggtagtcccagctacttgggaggctgaggcagaagaattgcttgaacccaggaggcaaaggttgcagtgagccgagatcacaccactgcactccagcctgggtgacagagcgagactccttctaaaataaataaattaattaattaaattaaataagaaacagttttgcatttgaataattctgacaccaaaataatttttatcctggaatacactattcaatagtggtaaactttgttatatggaaaacatttcttatttctgagcaatatcaggtaaatgaatcaggaattatttgaattagaaggtattgttactaaccccctcatacctccaatgtactaaaactaatacatcttaaaattccttttaatcatttaatttttcttttttccaaaattttccccacataaataaagtagaatttagcctcttctacttcaaaaataaagtattttctaacaatgtttatcattataagtttctcagggctcaaatgtagaacatctttttgatagcttttcactctttccccaaacatatcccagttttatgagaccaagtacaaatatcttcctgtcacacatcatcaggagaatcttgccaggtgcagtggctcacgcctgtaatcccagcactttcagaggccgagacgggcggattgcctgaggtcaggagttcgagaccagtctggccaacatggtgagaccccgtctctactaaaaatacaaaaaaaaattgctgggcatagcagcaggtgcatgtaatcccagctactctggaggctgaggcaggggaattgcttgaaccaggaggtggaggttgcagtgagccaagattgtgccactgcactccagcctgggtgacagagcgagactccatctcacacacacacacacatacacacacaaaatatggataaaatatctagtgtgagaggaacagcagaaggagaaagtaatgtcttgaggaaggtgcgaatcatctgtaaatactttttagagtaatggaattcctagacagacagcttcgcaggcagtattgccattcagtatcattggcaaccttcctaaaaggaaaagagtaatgttaatgccatttctgaaggtatgaattgaggattttgattctttttccataaatacttaccttgtgaaaactcctctgcaatctctactgtcagtaagttttataaatgctgtatacaagtcttcaattcaccattgcctgcttgaggcttatttattttttgagaaagaagctggagaagtcatttgaaaattcatgggtagttcactcttcaaggttgtggtgtgctcttcaaatagctataaaaatttccaagagacaggaccactgaccctgcgcttcgtagcaaatagctttacttactcattatctgactagcgtattagttaatcatgtaaacaattatctttcttttcaggtggcaataattcatggcatctcctcccccttccaccccacacatatacttatttattgtcacagcctgatttataattgttttttaggatttcttcatatcctccctcctacctttacccctgagttcagaaaataataaacactctaaatctccaagcaatggaactcttctaagagttaagctaaagtctatcctaccaccttgctatattaatgtcagctcatttgatgtgtctgtagagcaggatttgtttggcaagctttttctgtaaaggaccagatagtatttcaggctttttgagccatgtggtgtcggtcacaacttttcaactctgccatcatattgtgagagcagaagtagacaaggtatgtttaaaaaaaaatgggtatggttgtgctccaataaaatcttttttatagacactaaaaacttgaatttcatgcaaattttatgtgtaaggaaataattttttaaaaatctcttctttaaccttttaaaaagacaaaagccattcttagcctgtgggtcgcacaaaaacaggcagcaggccatgggccatagtttgccaacccattatctaaacggttaacagaatgcttactacaggttttctgaccctcagcactagtaatactttgggacagataattctttgttgtggactgtcttttgtttttgttttgagacagcatctcactctgtagcccagactggagtgcagtagtgcgatcttggctcgctgcaacctccacctcccaggttcaagcgattctcctgcctcagcctccccagtagctgggattacaggtacccaccaccatacctggctaatttttgtatttttagtagagatggggttttgccatattggccaggcttgtctcagactcctgacctcaggtgatctgcccgcctcggccccccaaagtactgggattacaggtgtgagccaccgtgcctggcctgtcttttgtattttaagatgtgtcatatcatctctggcctctgcctactaaatgccattaacaccctacatcccccaattgcaacaactagaaaatctacagacattgacaaatgacctttggggacaaaattgcccccagttgaaaatcactggtctaatacactgaaaacttagaatacaccgcataaaatatgagctggtaggctgcgtagtataagatagcgtcatgtgtcacctgagagatagccattggattctcatgcttctaatgtagaaaccataataccgtggtcttccccttacctacagtttcattttctgtggtttcagttaccagagatcaaccaaagtctaaaaatattaaatggaaaatttgaaaaataattcatcagttttaaattgtgtgctcttccaagtagtatgatgaaatcttacaccatcccaccagagacttgaaccagccatttgtccagcatatccacgcggtagctgctacctgttcctgagtcacttagtagacttctggattattggctcaacagtagaggtattgcagtgcttccattcaaaaattccttactttacttttattatggtatattattgtaattgttctatcttattagttactgctgttaatattctattgtgcctcatttataaattaaactttacatagatgtgtatgtattggaaaaaaatatggtacagctgacccttgaacaacacagatttgatctgtgtagtcttcttttatgtgttttttttttcaataaatacagcaggccctccatatcaatgggttctgaacctgcaaccaaggcaagacacaaatatagtattcacaagatttgaaacccatgtatatagagagctgactgacttttcatctgggagggttctggatggctcacttccatacttgaatgtgctcggattttggtatagaagggggtcctggaaccaatcccccatagatagcgagagatgacggtatacatagggtccagtattatctgaagtttcagacattcactggggctctgggaatgtataacctgcacataaaagagaatttccgtactacctccaagttaataaccactgaagaaatcctaggcttaagagagcccgttattggaacttagatggtggcgttagagtgcttatgctttggacttaggagtcagtatcccttccccccagctttgtctctttctatattcctttcccatttttcctctttccacctccttacactcaaaccatacagtgtgcacctgacagtggactacaaagattaatattcgatgaaaggactttgtccatttgaccagaccacttgaatgatgaggtgggagccacagaatacatagttgatattaaattaagaatctaggccagacccggtggctcacacctgtaatcccagcactttgggaggccgaggcgggttgatcacttgaggtcaggagttcaagaccagcctggccaacatggtgaaacccgtctctactaaaaatacaaaaattgctgggcgtggtggcaggtgcctgtaatcccagctacttgggagtctgatgcaggcgaatcgcttgaactcggaggtggaggttgcagtgagccgagattgcgccactgcactccagccggggcaaaagagcaagactgtctcaaaaaaaaaaaaaattgagaatctaaattaatttatagaaatcctttttccataaatttatcttttctccaagttttcttctgatatgcaaagtgtgagacacctactcttagcttttagatagtttacaggccaatgacacacagtagatgatgttctgccatgatgtctcaaaggcagagaaacattcttatttttatcaacactttctcatccccatctttaaattattggtataaacaaacttctgcttctcactttagattataattttatcattttttacaattcatcaaagaaagtttttctaaattgcacggaaagttctatagaatgctgagttatgtattctaaagaatatttctccttcccattttttcatagctaaactgtcaatatttttaccttaacttcctacaaagtcctatagctatttgattacttgatgtttcagtataaaaaaaaattaggtcaggtgtggtggctcatgcctgtcatcccagcactttgggaggccaaggcaggtggatcacctgacgttaggagttcaagatcagcctggccaacatggtgaaaccccgtctctactaaaattacaaaaattagccaagcctggtggcaggcactggtaatcccagctcctcagatggctgaggcaagagaatcgcttgaacccgggagacagagattgcagtgagctgagatcgtgccactgcactccagcctgggtgacacagcaaaacttaatctcaaaaaaaaaaaaaattaataatgctgcttctgcctgaaatacatgatttccagtgagtgaaggaccacttgctctactgaagtaaagctactttactcaagtctctgaaggagtaagagagtcctgcagggcacatttgaacagctcactttcagatacaagtgataaaaaatggagcctcagcaacaacaacaaaaattataacttttaaagagatagaacaacatggtttgaaaaggaatctggatttttgcctctggttgctgtcattgacagggaaagtcttatattttctgaacttgtttttaaatccccccaaatagagggattagactgtgtaattccacaaatccgttgattttatgacctggctatagcttgggaaagcaaccacatagtaccgttgttacactccagagctattcaaatattgttatcaaagtggtgccaaaaatttctaatcaaatatttggaagagtttggtgatgagtcgaaagtagcctgtatgtctctgaattctgtgatgtttctcatttttcctccccgtacagtcttcataggtatttagacaagtaaacacctgtaaaggaagaatgtgggcaataagaatgaatataaatgataaatcacataatctgatgtaatgaaagacttaagttattacagaaaacctagaattaaatgaaatatttaaaaagtgatgtcttcaggaagtctacagttcagattcaagggtggcaaatactgtccatggagaccagtagttctcaggagggtgactttttttctccaggagacatttggcaatgactggagatatttttacttgggcatgttgttgatatctagagagtagaggccacggatgctgctgaacacctccaatgtgtaggacaatgccccgcaacaaagaatgatctcgcccaaaatgtcaagaatgccaaaatggagacaccctggtgtagacctatgatagctctgacttctttttttttttttttttttttttttttttttgagacagagtctcactctttcacccaggctggagtgcagtggcccgatctcggctcactgcaggctcgatctcccaggttcatgccattctcctgcctcagcctcccgagcagctgggactacaggagcccgccaccatgcccggctaattttttgtatttttagtacagacggggtttcaccgtgttagccaggatggtctcgatctcctgacctcgtgatccacccatctctgcctcccaaagtgctggagtgctgggattacaggtgtgagccaccgtgcccggccgatagctctgacttctaagtcaactgtgttcatcagtttcatatctcccctcttactttccaccatcacaaaagcctctgcctcctaccaaatgttagtaaatgcagtgaatgttagcaatctatttgaaacaaggtttcttggcattcatctagctgtatggataaagttttaccagcacaaactctgtatgcatggggtagactggatcagacagagcaatctgaaccacaatgttggatttccttcaagcttgagaaatattaatactaccatatatacaggcggggcatggtgggtcacgtctgtaatcccagcactttgggaggccaaggcgggtggctcacctgaggtcgggagttcgatactagcctgaccaacatggagaaaccccttctctactaaaaatacaaaattagccaggtgtgggggtacatgcctgtaatcccagctactcaggaggctgaggcaggagaatcgcttgaacctgggaggtggattttgtggtgagccgagatcacgccattgcactccagcctgggcaacacagcaagacttcatctcaaaaaaaaaaaaaattaccacacatactaacaatatgaaagttctaattcatatttaaggaaacatctgcttctacatgtgtttctatctgtggttctgaaaagcaaatcctaatttttatgaatgataatttctgggcctctttttgtctttccccagatgttccctgctttgttgcttaagagctgcatggcacagaccataaaggttgtgagctcttcccatttcaagaaaccctggggagattcaaataaacaaattcaaaatgccccttagagtctttaacagaccagaattagtacgttgtttgtttgaaaatctttctttttttcggatataaaactatacactcaagactaaatggaggcagtacaattacacattttgactgaattgtctcatcagtaaaagtatcacctggctaattgtaactctttagaattggcctaaactagaaaataaacaaggaccttattcaagtatttcctattatgttacatacatacaagttaccaattagaagttgatatacactattttgtttaaaaataaaattcagcaagcttctgatgatttattctgttcttgtttttcttaccagttttactgccaaaataaactccttctcatacaaagtctgggattataccacagagttactataattggattcaactttaatagaatattacaatattaattttaatagagtatggtttcagatattaaaaagattaatgtacccaaaaacataatcattgttttgttttttttttagacagaatcttgctctgtcacccaggctggagtgcagtggtgtgatctcagctcactgcaacctccacctcctgggttcaagcgattctcatgcctcagcctctcaagtagctgggattacaggtgcatgccagcatgccaggctcatttttgtatttttagtagagatggcattttgccatgttggccaggcttgtctcaaacttctggcatcaagtgatctgcctgccttgaccttccaaagttctgcgattacaggcgttgagcaaggcattgagccaccccacctggccacttcttttaaattgcataattttcctgttctctatttcatccaatctaaaataataatgagttttaaatacttatttttaacattttttttacacctatgatttgagaatatatatatattaggccgagtttcatttttgttgcccaggctggagtgcaatggtgccatctcggctcactgcaacttccacctcccaggttcaaacgattctcctgcctcagcctcctgagtagttgggattacaggtgcccaccaccatgcccagctaatctttgtatttttagtagagacagggtttcaccatgttgtccaggctggtctctaacccctgacctcagatgatccaccagcctcggcctcctgaagtgctgggattataggcataagccatcatgcccagcctgagaatagatttttgacatttttaacttgattttccgagaagaaaaaattacatatttttaaaaataataaatacattgaaatctagattttaaaacatgtttactttctctcaaatttgttagaaatgtcacaacaaatagctttttcaacctatgaacagtatttgtagaagggaaaaatgaggaagaaatgggcacatttttctagtgattgaatggtggtgtctacatcttgaataattctcactgcatatcgttgcttgaattgtagatctgtatggcatgtgacttgcctgggtctatgatgttgtcaacagaaagagtcaaattctgtaaaatatttgaagagatttcttctgagccaaatatgagtgaccaatggtcccgggaaatcctgaaaacatgtgcccaaggtggtcgggctacagcttggttttatacattttagggggacataagacatcactcgatacatgtaagatatactttggttttgtctggaaaagcaggacaactggaagccaagggtagaagggggccttccaggtcataggcagattctcatgatgttgcccagatgtcctattgtaatttcaattggttgagtttatctaaagatctggaatccatagaagggagtgtctggattaagataagtggttgtagagaccaaggctcttattatacaaagcctacaggtagccggctttggagagaatagattgtaaatgtttcttatcagacttaaaaaggtgccagactcagtgaattctctcctggattagggaaaagacctggaaatggaaagggattctctacagaagttagatttttccccacaagagacagctttgcagggccatttcaaaaattgccaaagaaatatattttaagacaaaatacttggatttctttcaggacctgctatctgtcatgtaatgctatactagagtcaggctggatttgggtgtcttattgctacagaaagtcttaagatctctattaatgttaatgctggtcagctgtgcctggattccaaagggaggagggtataatgaggcatgtgcaacccccactccccatcatgacctgaactagtttttcaggttaactttggaatgcccttggctgagaggagaggccaattcagatggctgtggggcttaaaatgttatttttggcttatgatgtggaggcagaagtaacctgtatcactgttgtgccaaagtctctaagagctaatgtgcagttcaccaagttgtctccctatgagagtcagccatcactgcaaacagcaacactccaggttgattgtggttctgtcagcttcatcctgcaccccagagtaaagatgacatagtggggagcctgtcttacaatgagcatatagcagatgcaagaaataaacatttgccttgttaagccactaagatgtcagggttgtttgtcctgcagcaaagcccagctcatcctgactgataaacttatccattcaagtgatcagcttttggtgtaaatgcccctaagaaaactgataaagcggccgggcacggtggctcaagcctgtaatcccagcactttgggaggctgaggcaggcggatcacgaggtcaggagatcgagaccgtcctggctaacacggtgaagccccatctctactaaaaatacaacaaaattagcctggcgtggtggcggcgcctgtagtcccagctactcaggagactgaggcaggagaatggcataaacctgggagacagagcttgcagcgagccgagattgcaccactgcactccagcctgggcaacagagcaagactccatctcaaaaaaaaaaaaaaaaaaagaaaagaaaagaaaactgataaagcctgatgcactacctacctatgccttgccaaagaatggtaataatccaaaaactgtttaatttagaccttcactatgcaatgcatattttatctaggaacacttttactggtatcagtgatcaaaattatagagcagggggggaaatgtgaggaaacaaatctcaaatgtcaacatacgtggggatcttgtttgcagatgaggaagtgcattctcaaagctgtgtgaattgtcctcatcatacagctattttcattgtattctttcacaaaaatatgtatgtggatggattcttaggtgttagagacggggaggaaagaataaaggagactcaaggcataggtggaaaccgtgcatacagatggtatatctttatgtgttgagcatttatatcatgcatctgctaagtactgcaatggaaacaaggataagacgcacagacttccctaaagaaatgtaaaatctcaatgacaaagaaacatgtgaagaagttagtatcttaagcaaaatgatgcaattcatagtaggccactgtgtactggaaaagtaagggctattctattccaaagtgtgatttttttattgggtgagggggacctgagaaagcttcatggagggtgtgatagttaatactgagtgtcaacgtgattggattgaaggatgcaaagtattgatcttgggtgtgtatgtgagagtgttgccaaaggagattaacatttgagtccgtgggctgcaaaaggccgacccacccttaatctgggtgggcaccatctaatcggctgccagcacggctagaatataaagcaggcagaaaaaccttgaaaagactagactggcctagcctcccagcctacctctttctcccatgcttgatgcttcctgccctcaaacattggacccctggttcttcagttttgggattggactggctctctttgctcttcagcttgcggatggcctattgtaatcatgtgagttaatatttaataaatttccatatatatatctattttattagttctgtccctctagagaaccctgactaacagagaggagaggatatctgaactaagcctcagaggaggatgaatggcaaggagaagaaacatgtctccaggaaactgaggcctgagggggtagtaatttttcccgagcatatgataaatgacagtgatttgggaagacttcatggcatgaatgtatgtgagaaagtgggcttgcgagagcaagattggaggagttggttatggaaaggcgagtaaccagatataggctgatagatggagtaagcatagagaagggcattgttttgtttgcttgttttttttaattttttaaatgttttatagatatgggagtcttactacattgctcaggccggtcttgaacttctgggctcaagggattctcctgccttggcctcccaaagcactgggattacaggtgggagtcatcaggccggcttttaaagaagggcattgcagtaggaatagaatgaaaggaagagatgaatgaatggaagagatatatgagccatttcaaaataagaatcacaacagtggaactgagtggctgtggataaaagctaaaagggttaagtcagggttgggaccaacagaactagaacaatacttgtattttggcccagatgacaagggctgaagggcatccagtgaacacccagaaactgaggacgctagactgaagcccaggggaaaatccaagctagtgaggtttttctcttatgagttatgggaggagcaacttggagggaacacttattgattgcatctcttgtaatatccacagcaaaggcatatgaggcgaggctagggaaggagatagaggaggagtgtggtcagagacgcaaaaggcatcaaataaagctgatgtggaagagaaccaggacgctcattgtggtatgaaagtcaagagagagagcttcagggaggtgggggattcgcaggtttaaggagaaagcaaagagaatgaggaccaaggaaaggccattggatttgaagtttgagattttctttctttttttttgttttgtgacagagtctcactctgtcaccagcgtggagtgcaatggcaccatctcagcttattgcaacctccacctcctgcgttcaagcaattctcctgcctcagcctcccaaatagctgggactacaggtgtgtgccaccacgcccagctaatttttgtatttttagtagagatgaggtttcaccatgttggccaggctggtgtcgatctcttgacctcgtgatccacctgcctctgcctcccaaagtgctgagattacaggcgtgacccactgcacccggcctgaactttgggattctcttggtggttgtagagaatgcacttcattagctttagattctgggacagtcacattataaaagacaaggggaaataaagagggtatacaggacactggtgtatactgtccactccagatcagtggatgaagaggatctgcaccctaaggggacagcagatttatcccattgctttgttgtgttgctttgtcgagatgggagatacctgaaagcagaaggaaagcaacataggaagacgctcaaaaataatgattttcttaaatgcacatgataatttatggctgacactgacattttctcagttacctttcataataacattagagaaatgacataaggttgcagagtggggggcagtgggtttcttctgactccacttcggttcccttcatagcatgaacacatttgtaagggagaaaacgaggcaggaatgatgcacattccgagggtgggagtgaagaattaggagtcacaggtaggttagcatgtggaagagaaggtgactgaaaccagaggcagagaggagaaagtggactgagatttacatgttttactccctgaagagactagcagtccctatttccaccaagggcagaaacattcaaacattctgcatacctttccttttatgcatgaaataaaatactggcatttgaaggaagaggttgataatgtttatttcttagaacattcaagcttggcagttatgtgacttatctctagagcctctcagaagtctctggggacgcaggagtctttggagactcacactttctgcaaaagtgcagaaagaaatacaattacttaatgaatacctactgtgtactcagcaaatcctttatctgtcacttgtgttaatttctagaaattacataactaagagtctccatgaattgcacttgttttcttaagagggaaagagaaaaaaataccttctttccttaccatttaagccagtgctttttaaaccaggatctgacactccgtaggtgaccatagatgtagtatcacagatccgtctgtttccaaaatgttacattctgattttaagatcccctgaaagttgaaatttctcttttgctgcaacaactcacacttgagaaaaattttcacaggagactttattttcttaaagcagagtttgttaatatgaattctcacaggactgtggcaattcatttttcttttaatgcgttcattactctagaccaagacatcaatttttgtgcaaaccttgtttcctgctgccacctggtggaagccacataagagttttacagaggctttggtggtgctaggagaggggccagggctcttcctcagtcacagaatcccacacagtgatcaaagagcagatctttctattaaactccctggcagcaaaacagtagaggcttggctctctgccccgggactgtgcagaatgtcacaggtcggaagcccagagcatttttctcttcttttatctttagactcttgtggctctcagaccttgaatataattctttgctgaaaattctttaaaatcattatcttttctttcttccttttttctttctttcttttttctttcctcttttttgctatgctagacaggaagaaagaagggaatggcattttaatgtaaagaagattgcactgaaattatattacttgcttaattgtattaattcactgcaataacaatttaataatatgacaggtcatttacatgctaatcatttgggtctcttgtccagagaaatcatgaggaagggctgggaagtgctcttattatgatcaaaataatccacactctcctagaggagtgcataggtatagaactgacattgtttgtttaataaagtttcattcaaggcaatttggctggttcttttatcaagtgtaatgggaaaacaagccagtcctgatgttaaacactccaatgatccctcaagctttttattctgtaataagttttacagcattatgtgttacccacgacagtcatttagtcggtcaatttcaggctagtgataaaagtttgagtaatgggaaagctgtgttgatgttccatattctttgtgagatgtctatgaattaatgctcccaggtacacactcaatttatatttaacagccattactaaatgtaatatctaagtaaaacccagttatgacctatatatatggaaaactaattaaagctgttggaaacaacctatttccctttggattatttatgtaaatacatcgaggtctaaaaattcagtacaagtcagatgtgttcctgcctagggctattatataaagctcagaaaattttatgagaaaaatgatgattcttaaggattgagcttcaaatgtgaatttttctattttataaggatatagcttgggttgttaagcatcaacatagcttttcaaaatagttttttattctcacaagtttaaaggccttgtaaaatctcttctattaaatatacatatatacatacatattacatatacaccaattgactaacccctctaagtgctgtatctgaactaattttaaaagaatacccgtgtttttcagctcccaaattgaaaagattattagttagtaccgtgatttctgaacttttaatcaaattttcattcattttataattttgaaattttgacaatctgagaatcttctatgattaaatatattctttcttcctttcttttttctctttcccttccttccttccttccttccttccttccctccttccttcctgtcagtctgtcttgctctgttgcccaggctggagtgcagtggcatgaacatggcacacttcagcctcgaactcctgggtgatcctcccaccttggcctcccaagtgttgggatagcaggtgtgagccaccaagcctggccttataaccaattaaatgaaggaaatgatactatgacacagacaaccatttttcaatcaagttattctgccatattaaattttcagtcacctttctattgcatttattgaatttctactttttaccagttctaagcctagatctgtctctcttaaattattaaatgtcttattttcttatgaaacaaccttcagatgtaatacacagaagaaaaaggagtctcaggaagtttagtttgcccaactagaaattgagcacaattacttggtgtgttgagggggatttgaaactatgtccttatgataattgatagttatgataattgatgacaaaggggttttagaaagacctcttttgcttttagaaacacttctctttgcactttctttaatgcccattttttagttttatgaattaaataatatacatttatttaaacaaaagtatcaacatttctcaagtatctataggttacttatctactcaatgcaactaacaatcaaaaactagtgctccaacaaattaaattttccaaacactgaaatattgatcacaatgtctctaagcatttcattgaaataaaaattttgatgtatctaattttcctaaatattttaaatgcatttcaatatgcaaaactctcacaaaattgttgtaaatacaaaggtaatcagtatttttagattaaaatcagttataaatgtgctaatatagtgaatgtgacccttgtccggactcacatttttcttcttagtcttttcctgggttatattcttaacatatcagctatttttctatttttatagcttcttagggttcaaaaatattaccatatccaaatgaaaactaactacctgagagcagccaactgcaggatctgtgtcaggatccagctgattcttggtgaggacacagatccaggtgtctaaggagattcagacactagccagtcatcatcagattaagctgcacttaaatccacatatatcaaattgtttttttttatttttacaatggtgcgttactaccatgatgtcttcacaactgatttgagcagtgttgcaaatcccatttcattatcccatcgttgtgatatatagacttggcctgttggaataccttcttggaaatttaaaaaaatagtttattaagattattagggccattgaagaatttcctcctaggagataatgcattgagtctacctttcagtcctcctcctcagaacacgtgcccgaactatcatttttgagatcaccattgatttctttctacagcgtggtcactggtaccaataaaatgctagtcttcattcctatccagttattatgtggggccccatgttgttagtctttctgatttcattatgatactaagttttaagggaaacttgacttcctatttttgtgtctattgtactacccactatagcgactatatagtaaggaatataaatttgttttcataggaaataaaatacccacatatattaaatccccattaaacataccctatttcatttacccttctttaaattataactatctttttatatggcttatattaacttttctctctcaagcatcattttaagctaatgacctttcagactagacccaacttctttcagtcaaccataattcatgctcactttctccctctctctcatcaaatcatcgaaatttgatcagcaggaatctctttaacttgactccattgattttttagtgttttagtacagtctccaacattcttaaaaacatatttgttttctagcaataacaagatgtcccagactcattccaatttgttttgttttactgccccaaaacatggaatcagcttccctaccataagtagtaaagagtagtagagaatactattaaagtccaaaatctgggaactagggataaacaggagagttgatggtaagtaaaaccagtgctgctgcttaactatatttactaatgtcagagatggaaaatacaagttattttaatgtcataagctcacagtaattttttccaaataagattatatattgctatgctctacttttctcaaattatgtgattttattgaaaatgaaaacttttattttggaattgaaatatttgaccctcttctttctgcttaggggaattatttggaaagatttcttatgcctagttctgtagggttccaaaccatgtatactttcacaaaatgcatgtgtgcaatagcacacatgctatttccagcagcaagttgaatccttgtatctagcactgatggtcaatatgttttgcattttgctttcccacctccaatgaattagtataaactatgaccttcattgatatttctttagtttttatatttgtatgaatcagctacttcaaacccttaataaaatctacaacctctccaataaacccaaagttactagatggaaggaaacaaagattagagcagcaatcaatgaaatagaaacttaaaaacagaaaagatcaacaaaactacaagttggttttctggaaaaaaataaacaaaatcaataaaattttggctagactaagaaaaaaaaagagaagactcaaataaatgaaaccagaaatgaaagaggagacatcataacctataccacagaaatccaaaggatcacaagaaactgttatgaacaattacacagcacacattgaataagctaaaaaaagaataaattcttagtctcatagaacccaccaaaactgaatcatgatgaaacagaaaatctaaacaaaccattaatgagtgaggaaattaaatcaataaaaagcctcctatcaaagaaaatcccaagacctgatagctttactgctgaattctaccaaacatttaaaggataaaataccaattttttgcaaacttttaccaaaaaatgaagatgaagaaacattctcaaactcattttaccaggccagcattaccctgataacaaagccagaaaaagcaccacaagaaaaaaaattacatgcccatattcctaatgaatatagatgcaaaaaccctcaacaaaatactagcaaactgaattcaacagcatactaaaagaatcattcatcatggtcaggtgggatttatcccagagatgcaaggatggttcaatatacaataattaatatgatgcaccacattagcagaatgaaggacaaaacccatatgatcatctcaatagatgcagaaaagtcatttgacaaaatttaactttctttcatgaaacaaacactcagcaaattaggtacagaataaatgtatctcaacacaataaagagcacatacaacaagcccatagctgacatcatattcaattgagaaaagttgaaagctcttcctctaagattaggaagaagacaaggatgcccactcttgccatgtttattcaacatagtactagaagtactagccagaacagttaggcaagagaaagaaataaaggcatccaaattggaaaggaaaaagttaaattgtctctgtttgcagatgacatgatcttatatgtagtaaatcataaagactccatgaaaaaactgttagaactaaaaatgaattcactaaagttgtaggatacaaaatcaacatacaaaaatcaacagcatttctatatattaacatgaattatccaaaaaggaaataaagaaaacaatttcatttacaatactaaaaaagaaatacttaagaaaaatttaaccaaggaggtaaaagtttataatgaaatttataaaacattgaggaaagaaattgaagaacacaagtaagtggaaagatatcccattttcatgaatttgaagaatattgttaagaattcagtactacccaaagtgatctacagatttaacataatgcctataaaaattccaataacattttttacagcaataggaaaagtaatcctaaaattcgtatggaaccacaaaagaccctaaatagctaaagcaattttaagcaacagagagatatcacatgacctgattttaaaacctaccacaaagctatagtaataaaaacagcatagactagcataaatacagacacatataccaatggaacagaataaagaccccagaaataaattaatgcatttatggtaaataggtttttgacaaaggtgccaaaattatggggaaaggacagtctcttcaagaatgtatatccatacatagaagtgtgaaactaggctctcattttacaccatatacaaaaatcaattccaaatgaattaaagacttaaatgtgacacctgaaactgtaaagctactagaacaaaacatagggaaaatgctctatgatactggtctgggaaaagattttttggctatgaccccaaaagcacaagcagcaaaagccaaaatagacaaatggaatgacatcaaactaaaaagcttctgcacaacaaaggaaacaatccaacagactgaagagacaacctatggaatgagaggatgtattcacaaaccatacctctgataagggattagtgtccaaaaggtataaggaattcaaataattcagtagtaagaaaacaaataacttgatttaaaaatggacaaaggacctgagtagatgtttctcaaaagaaggcatacatgtgccaacaaatatatttaaaaggtttaatatcactaatcagggaaatgcaaattaaaaccataagataccacctcaaacctcttagaatggccattatcaaaatgataaaagacaacaagtgttggtgagaatgtgaagagggaaccattacacattgttggtagaaatgtaaattagtacaaccattagggtaaacagtatggaggttcctcaaaaaattaaaaatagagctaccatatgatccagcaatcccactattggctacatatccaaaggaaatgaaattagtatgtagaagagataagtgcactcctatgtttaccgcagcattattcacaatcgctaagatctggactcaagtgcccatcaacagatgaacaggtaaagaaaatatggtatatatacatgatggaagcttcaaaaagaaggaaatccagccatatggatgtacctggagaccattatgttacataaaataaactaggcacaaatcaagtatcctatgatcccacttacatgtggagggtaaaaaagttgaagtaattggaacaaagagtaaaatagtggttaccacagagactgggaggtggtgggattaggtagatcttagccaaaggacacaacatttcaattagacaaaaggagtaatttcaagagatctattgtacatcatagtgactacagctaatgacaacatattgtgtatatgaaaattgctatgagagtggattttatgtttccattacaaaaaaagataaatttttcagataacgcatgtgttaaatacctttatttagccattctacaatgtgtactgtgtatgtacatgtgtatatgtatataatctcaaaacatcatgttgtacaccatacatatatacaatttttacttgtcaatcaaatagtttttaatttttaaaaatttacaccttccttttggaataaatatcccagctctcaaagctgataagtaatgaagtaaggatgaagctacctgatttggctgatgtatggtccagagaaggcgatgcatatgggacaaaatcatgaattaaaaaggcaatttttctttagattaaaaaatgtcaacaaatagcaatgtttgttattctaaggaaaaattatttatgatacatgaaaacataaagaacatccaaagctgagaagtattctttcttcattctttttatagtcttcatcttaagtgacttcaatacataccatttatcagcatgtctgttacatcttatattgaactgtttccatggaacatctccatgggtcagactgtagcctcaaagatactacaagcaaaagagaatccagcagtgtagtgggagaaggaggaaaaccttccctgactgcttggaaattgatgtatttatgacatgaagaagttaaaagactaggccaagaggcacaggatccagataaaacaacttccctcgggttccagagacatgaaaataaagaatttatagttatcaggaaggaggtaatttgctgaaattcccatcacagatccaaaaacgaggaaggaggcagacatgtgttaatagctccgaagtggcctggaagtcttattttgccagtgatttaactgaagatcaaatacactcatgtaaggaaagcagagaaagcttgcataagtctctggcctggacctggaaacccagtctgctttatttccttgggggagcaggtttcctaattcttccacgacatttgttggttaaatgttgaccaacaaaagcagaatgttacattgtgtttgatgggaggggaaagtccttgttttctatctagtctggggaatcatacatcaatccacacaggaatatgcatcaagtgtttccatcttaatgagtggcatgattccagaagggcaacaggccaggagagctctaaagcttccctgaaaaaatggagaggctggttgtgttttgttcttgccttggatggatgaagaaatggaagcaggtgccccattgggaccatggatcaaatgcacttaggaacttaaaggaaagtctaggggctctgagtgaaccagcacctcctgccctgctgggggttagaggcttcactggctagtccgaagcctagtggttttgagtaagaaaagaacttcaaaacattttactgtgatttaaaaatcctccatggtgagcatgcccagcttttgttctctcgatgtacctccaatctctcaagaagacataatttagtaacgctggggttgctgctactataaatgctttgattaacattagaggaagaggacgacagaaagcagcttctgtcccagccaattaaagagcttgtttaaagtatgaaaatgatttattagacatgcaaagagggttgcaaagaagaaagacacacagtctcaatttaaaaaaaaaaaaaaaaaaaacaaccacaaagctttggtccaggtgcctgccttctgacaacacagataaacagtttagttgataatcccccacatcttcttcttcagcacagcaatttgttccagttatcatactttctaaatagaataaaagaaaatgatgctcctttataatatatatagggtttagataaaaataaatagcacagtccacatgctttaaaccaaagattgagtctgtgtgaacagaaataccagatagctgtttgatacagcatttcccaaatagatatatctgagagctctgctaaaaaaaaaaaaaattaaatttttttaaaaaggaaagctagaaaaaataataataaatagagccttgtgatcatatatgtgcatcaacaccggctatatactcctttcggaaaatcacaatgtacgtgactcttgcagtaaagaaatgtgtttaacatttttacatttttaatacagcatttctcatacatatttgactgtagaaaccttctctgatatgacgactattgtcattccctagaattagtattctgttcaacatacttggaaaatacttaactagccaatctatttacaatgggaagagctataaagtccctcagtcattaacagctaatacacttgaaagattgttagcagaaaaaggaaaacatgacgtcaggaagctggggccatggattttgtcccttacacataccttcgttttacagacatcacaatgacaaattcaccctgacccaactgaggtcacatcagcaactgaatgtaggtggattgtctgaaacccattaccgttgtccacccaccatcatagaaaattattttaaatgtatgtattatagtaagagtactcttgatagtattattttttctttctttcttttgagagagagtctcactctgtcacccaggctggggtgcagtggtacaatcacagctcactgcagcctcaacctcgcaggctcaacctcccaagatgctgtaactacaggccagtgccaccgtacctggctgattttttgtattttttgtagagacaggatttcgcaatgttgcccaggctggtctcaaactcctgagctcaagcgatctgcctgccttggcctcccaaagtgctgggattgcaggtgtaagccaccacacccagtggctaatattacttaaaccatataaaactaggcagtggagaaagggagtaagagtacaggctccagattcagacggactttctctgaagtccctcctactgcccatggggacttgaacaagttacttaatttctctataagcctcaatggcttcatctgcaaaggagaataatgacagcatctattttttaatgttttgtgaaacatatggaataatgcatagtaagtgcatagcacagtaaatgacacatattaaacatagacaaatattagctgtaatattttatcatcattttctttacaaataatagtgtttttggtaactaagactaagaagaaaagaaggaagacagaagttgaatgtccttgcagatggggggcaaatctgctggcaagatttgtgatgtgtgttgctaattatctgtgattaactggttaatagattagttaaatcatcctgttggctctgcggaggatgatctggaaggggtggtactagagtcagggagacaaaagcagtgggaaaagataacagaggatgactggagagactttggagctggaattgacagaatttggcacctgattttgcatgggcatgagatttctggcttagaagagaccctgaagtttcataatatggacggtgatattactaagatgaagaccacaagagaagccactcttggctgagcgcaatgagtttggttttagacttgctcttgcaagcttctggtaggaaatcttaatagttaagcacgttctgatagaattttggcacttggctctaggaaggaccctgattagacatagatggagctatcaatgggaagatagttgagatcacatagataaatgatacacagagagaagagcacagtggcatagtggagctcagaggaatgtaaatatttaagagataataagaggcagtggaaccaatgaaatgatgaaccgagagtaaagtagaaagatgatgagagagaataacgtcctgaaagttaaatgagcttgagtcaacaagcacagaaatcagggctacaggctacatgccaagcctctgaacttcctccgtcctggaccatggaccaagctcagtcctgttttccccagagacccacagaaacgccagtttgcctcctagtgtaaccctgcaaagaaagcaatgtcgttctgcatcaatgctgatgagcctgcgctgttcagtatctgtggggcttgccaagctactcctgctcatggaaacctcagtcaggagcgaggattccttggcagatcgtccctgtgttctctgcatgaggtctctgatctggctgcaccaataacaagaactaatgtcatgtttacccttcacaaagttcaaaataacggtacttcgaaattagccaggcttctaataagcagtctgagaagtacacagactccaaaacagtgtttgcagagcttctgtagaaaagatcatctgcatcagaggcagctgagatcctaatgaaaaagaactgcaagactgagtgattggaaatagctagggttatggctcagcaagctgccttttcagcaagccttgcagatgattctgatgctcaccaaagtttgtgagccactgatgactacagaaatagaatatcaggctgaaacacacaaaaagagcaccatcggggaaaaataatatgaagaaaatactacatttttagtcctggtccctaatccttcaaagagttgttatgctttgtggaaactaatcaggtctagtctcccacctttcaaattatttctgttaaaatgttctcccctcctgcccagaattttctaatacacagtggaatgctttattgctctctttaagcatgtcaactagagcaggagaaaagtttcccatgtattttcttcaaagaaaaagatgtttaaagtttaatattaaaagaaagagtcatgaagtagtttaacatttttttcacagggcgcagagagttgcttctgcatggttatttttactaagtactttccaatttatactttatttttctcaagtataaaaatggatcttcctacttaaaaacaccaatgtccaacttcatggtcaaatgtaaactttggaaattattacttgatttctgttagtggaggaattagaagagtttttgttccactatgttattccaacctcatctcctcgtttgtcaagattcttaagctgaacgtttttctgcgtgcatgcatgcatgtgtgtgtgtgtgtgtgtgtgtgtgtgtgtgtgtggtcacagtgaaacatagattaaggctgagaagtaacaaccagctaattattataagtatagatataggccatggatattaaagtacccccattttgtgttgatacatgaaatcatagaaatttcatgtatcatagagattaatcacatagagattaatttagaccataaaaacatttcaattttcaggaatcccttattaaaataatttttgaaaaaacaggggtgaatattcatgaagccaccacgtcataaaggtttggttgatgaatagtgagagtaggggtgaatagaggtaaagcaggagacacattggcaaggtcagggctgcaagagacaggagagcatcgaaaccaaaccccaccttcccacactcctaaagactgtccagtgagtaattttcccatttatacaagagcctggtctatgaaggcaaataaaatggaaggatttaccctcactgggcattgaagcacaaaccttgcccaaggccctgtcccgagcaaaagagcttccctactgggaaagatcaagatcttaatatcccttaatataactcaaataatcattagccaacctgagagaagaggacaggctctgagtctgaggagaagggttggaagggtctggttagtgcctgaccttcctataatataaagctacttggagatattagagctagtgaatgccttctcccagccaaatccatgctccaggaatgggcacagagttgcaaactaaagatcaattgttcatcgtggtacatgtctttgtgaggtattatgggacaaacttcagttcatatgggaaaaccgaacccttcccacgtggtccgtgaaaacccagttgcacattttcagacaacttctttatgagtacagggcattaggaagttgaaccagcccggccaatttagaacaactggtctctttaacatgagcattccccgtcagtgctaccaaactcctttccatgtgtcccatgcaaccagaaaatgtgttgtttaaattcagctcgtgtcatttgtaaaaaaaaaaaaaaaaaaaaaaccataaaaaataaaaataaaaataaaaaaattaaatagtttgacaagataaatcagggactttggaataaagagttagtaatatgttgagtagtttgtcacatgatatcatttttaagctactcttttttgggggggcggggcacggagtcttgctctgtcgcccaggctggagtgcagtggcgcgatcttggctcactgcaagctctgcctcccgggttcacaccaatctcctgcctcagcctcctgagtagctggaagctactctttctaaataacttcaacaaatattactgatgtgataacaaggcttgatttcatcaagcagtaactctgtctccatgtggatagcggtcttttgaagccctcctcggctgttagagtgcataacccacagctctcaaactggtggagacaaggtggtatgtttgactaattcagtgacgttcggtaagcacctactatgtgcccagcaaggtgtcaaaaacagagcaaagaacaaaataggcaaagtgattgtatatatcactttttatcctaggtcaggataagcaagcagtacataaatttttaaaacaggtattttaggtagtgatacatgctataaaaattacatggatagagaatgaccaaagatgactagattgaatttaccacttctttgagtaggtggcagtggttcaagttggtgactgagttctaaacgatgggaaaaagacagccctgcagtggtatgtgggaagtgttctgggcagaaaacatgttctgaagctggaacaagcttggtactttaaagaaaagaggctgggcgcagtggctcacgcctgtagtcccagcactttgggaggctgaggagggcagatcatgaggtcaggagatcgagaccatcctggcaaacatggtgaaaccccacctctactaaaaatacaaaaattagctgagtgtggtggcacacgcctgtagtcccagctactcgggaggctgaggcaggagaatcgcttgaatccaggaggcagaggttgctttgagccaagatcacgccactgcactccagcttggtgacagagcgagactctgtctcagaaaaaaaaaaaaaaaaaaaaaaaaagcatgcttgtgtgactggagcctaataagcaagtgagagaatagaattggatgatttcagaggcagagacaaaatataaggaggtcctagctgggcacagtggtgtgcatcatagttccagcaactcaggaggctgagcaaggaggatcacttgagcccaggagtttgagtccagcctaggtaagatagaccccatctctttaaaaaaattttttaaattttcattaaaataaatataaggtctttacgtgctatgtattccatgaagtccagagctatgaatgccatagagtaggttctcagtaaacatatgagacaaaatatggctgagggtgaccttagatcaggctttctgaatcttacagaaaaatcttcttttgaatctcttttagctgaactttgaagagaaggataaagtagcatctgtttcaggtgccagggaagcccagaataaaaggctcaggatgacacagccgcatcaacatccagtgtttattggccatctgtcccctaggaatgtcttaagagctcatgctctatttacgagaacagccggggacagtgagaggaaggaagaaattgctttataaaaaagagtagctgcattcttttgtgtgtggaaagagcactattgtggaagcgacgaaacccaggtgtgtaaaaatagaaccgagtgttcacattaaactttccgtgcctcagtttccccacatgaaaagtggacataataacagcacttgagtgagaattaattgagataaaacctgtgttgaaatactgcttagaacatgggaagggtctgagctactatttattaataatgccattatcatagattttagctacatttattaataactccatgaatttagaatgttaatggaataaggattggagaagaaaaatttgctatggccagtgagaattccttgcaagaaaaaagcattgcaattgtgtgtgtgtgtgtgtgtgtgtgtgtgtgtgtgtgtgttggatatgggcagttgtagtgtggaacacctcagcagcacccaggcctcacttgtggatggtacaacctcaggaaacttactcttcctcagtataaatgagaaggtccccttttcccccaatggctgcagtgttggtctaggatgaggtcttctctaccctcatctgcgtagttccaggatggactttctcctcaaaatcacagtccaataaacaaaagtaatgaaaagggtctaacttccgtttgtatctcatgaggagcatcaaaaaccagttagttcctagcatagcacacagcactcttgaattctttcagccattcccagggccctcgcttctctaccctgcccctcccatccctgtcaggtcctgagctcctccttgctcctccctccttttttttttttggttttttttttttttttttttttgagacggagtctcactctgtcacccagacttgagtgcaatgtcacagtcttgggtcactgcaacctctgcctcctgggtttaagcaattctctgcctcagccttctgaatagctgggattacagacatatgccaccatgcctggctaatttttgtatttttagtagagacggggtttcaccatcttggccaggctggtcttgaactccttccctcatgatccactcgcctcagcctcccaaagtgctgggattacaggtgtgagacaccgcgcccggccacgctcctccctcttttgaagacttgttggactcttgtctttccttctccttcctctttccttttccttttgttctgtctaaactcctacagaacaaataaatcaatgaacgaaacacctaggtccttcccagtgtgaatcctttccattaccatccacaaaggtgaccaccattaaagctgtgtgtgaaggcttctagacattagtcctttattctgagtttaagcaaatacacacacatacagatgcatgtatgcatatgcgtgtatgtgcatattatatatgtggggtatatacacatatctttgtatcaggcacataaacaatgcacacatacttaataggtttgtgcaaaaaaactgcaattacttttgcaccaacctaatattactataataaaatggagctgtgatatacattttattctgaaaatagcttgtcccttaacaacatacaatggacaatttacatagatcgattttatggtttatgccacattatgtcacattttttgtccaaatgaatgcatgtttcttcaaatacatacagtaataaatgtatacattgtggttacttccattttttgctatttgaaactctttataaacatttatatacccaaaggattataaatcatgctgctataaagacacatgcacacgtatgtttatagcggcactattcacaacagcaaagacttggaaccaacctaaatgtccaacaatgatagactggattaagaaaatgtggcacatatacaccatggaatactatgcagtcataaaaaatgaagagttcatgtcctttgtagggacatggatgaaactggaaaccatcattctcagcaaactattgcaaggactaaaaaccaaacaccaccgcatgttctcactcataggtgggaattgaacaatgagaacacatggacacaggaaagggaacatcacacaccggggactgttgtggggtggggggaggggggagggatagcattaggagtaatacctaatgctaaatgacgagttcatgggtgcagcacaccagcatggcacatgtatacatatgtaactaacctgaacattgtacacatgtactctaaaacttgaagtattataataataaaattaaaaaacaaacaaacaaatcactcacaccatggaagcacaaaactaaaaagttcagtgtgtgtgtgtgtgtgtgtgtgtgtgtgtgtgtgtgtgtgtggtgttctacttgaggtagaaggtaaaagattaaggagaaaaccaagtggattgaaatctgcaataaagcgaccattctccagtactaaatgcacttgaaatttattcccctgcatctgtaggtaaatgtccttctgttcttgaaacaataaatccccataaacttcccataaagttctgcagaagtgaaatgtgagattggttcccttggaatccattcagtgctttgtttgtgcatcttccaatcttaattttagagcccttgttcttcgtccagagcccctagactgggaaaaggtcagaatgcaacatgtttcaaagctgctgtgctctgggtggctgtcagactgttggagagaattgctttcaaaacccagagtatgccaccatctactcagtttcagattagcgtaacccacagcaccatgctatggcaggggaagctataatctttgctttttgttatcatttaaattcacttttaaaaatattaagattctcaaacagccagattctgaacatgcagtcttccccattgctatcaattatgtctaaggcaaaaaaagaggaccaaaacttctattttttctaacttttattttaggttcaggggtacaggtgcaggtttgttatatagttaaactcgtgtgacggggggttgttgtacagattattttgtcacccaggtactaagcctaatacccaatagttattttttctgctcctctcccttcttccagcctccaccctcaagtaggcccctgggtctgttgtttccttctttgtgtccctgtgttctcatcatttaactcccacttataagtgagaacatgtggtatttgattttctgtgtcagtttgctggggatgatggccttcagccccatgcatgttccctcaaaagacatgatctcattcttttttatggctgcatagtattccatggtgtatatgtaccacattttctttatccagtctgctactgatggacatttaggttgattccatgtcattgctgttgtgaatagtcctgtgatgcacatttgtgtgcaggtgtctttataatacaaagatttctacgcctttggatatatacccagtaatgggattgctgggttgaatgcaaaacctcaattttacaacttgaaatattgaagcgggaaatgtaagtgaaatcccaaattggcatgccatactaaatgttattgtaataacttatttaatatttgattatccaagcacgtacttttgtaccacattctgctcaataaatgtagaaggaagtgccgccattttggattgcagcagtacctcttcgtgcagtgaaaatcttttatgttgtggcccagccagaccctcagtgcagtttgcatatagctttggggcctgtagtgctgtggtaaccattgttgaaccccaaatatccaagacaggtctcagtcaatttaggaagtttattttgccaaagttaaggttgcgggcccatgacacagcctcaggaggtcctgatgacatgtgcccaaggtggtcagggcatagcttggttttatacattttagggagacatgagacatcaatcaacatatgtaagatatacattggttctgtccagaaaggcaggacaactcgaaatggggagggggcttccaggtcataggtaggtaagagacaaatgcttgcattcttttgagtttctgattagcctttccaaaggaggcaaacaggtatgcgtttatctcagtgagcagaggagtgattttgagttgtgtctgtcctttgtccacaaggatattccttgtgagggaggtatgtagctttttttttttttttatcttagtagctatcgtttttaggaatacagtggaggcaggtttgccctaagcagtacccagcttgacttttccctttggcttagtaattttgggggtctcctttcacatcatccacgcagcagcaacttctggtgaacacactgttcattattccaggcaccacttatgcagtctgtctttccctgatacaaattctcagatttctttgaaattaaaactgttctaaatctgcatactggatattacttcattcacattatatttattttaattatgtaacacaaagttgtaaaacttctgttagtcttaatatagactcatatatgtcctgtgtcatcaatgtgaattccattttcaatcctcacctcaggatgattacgagcaaagcacagtgtgtctaagctccaatgcttcacactaaaaacagcaacaaaggccaccagttgcaaaacagaatcgttctcgctctcagatgtgttctttttatccttaaaatcagagcattcatttccgtttggatgcactatttatttttatatcagaaattattttcacttagcagttgaatggaatttgtttgcaggctttctttcaatagtatttccttcttcttgaggatatatgaattctaaggaaactgcagcacattttgtaaaaatccaaaccaattatctcacccctgcctacaaagaagtctttgttatttttctattattattaaaatatatcagcaagattttttggcctttatagttctttggtatttcaaaatgcttctgtatgatgttattgctttaaatcatcacaaaccctgtgaagaaagaattatttttctaatttacaaataaagaaactgaggtcttagaagactgaattcatttcctcgtctctctttctttgcactatgggttatcttgatgctttactgatcctgctctcccctgagacatgtggactctgttactgttttcagcaggaaaatcatggttctattaataggacatgtgaatctttttatttcctgtaatgaaaagagcacaaaaaggaaactttgatttgtgtaacgtaatcgtatggatcatatcaacccattaccctgggtatagagcagtttcccagtttcacatccgtcattctgctgaaatgggtggcttttttccacattttactcacctgatggatttgatataaaacctgtttttctatggatgtgaggctctggaggttttgtagtctatcaacacataaaggctgcctggcattacagcactcctgctctgcacagtggtggagtgtagctaaatgcagctcagtctttttacagctcagctatgaccatccttcattacaacagggcagatgataaaatggaaacttaatgctattagatcatgaattccaattatatgaagagagatggaggtaagagaaattagatgccaaaaggagatacaataaagacagaagtgacgttcacagggctggcagttctcagaaccattgtcacccatcattgtcagtaccacctgaggacccggtgaagatgactagcatatcagatatctgagaagggaaatgctgagtgtgtccaaacatccaaacaaataatgccaaacctagaaaagcttctgtccatatgggttaaatagctcttcaattctgaaactgtcaaaagtaggctttgcagatggtcatgtcaagcaatgataataactggtagtggaattcccatggttcaaatttattaaaaaaaacacactattttcatttattcaagaaacacatattgaatacctgtgtgtcaagctagatattacagttagaaatatatagaaagcacaatctctgctctctgaaatttgcagcctagcagaggagaggaacacatgaaagtaattataataacaagttagatgcaatgatagatacaagatatcctaggaggacagggaaatagtaccatgcccagtccggggatacgtcagaaagactgtctggaggaggtggcatctgaactgagtcttaaagaatgagtagaaatcaagtccaatgtggtatatgaactgagagagagaaggggaggatgttgtagaaaaagacaatccaaaaagaggaaacagtgcaaataaagctggaatccacacacaccattgtcatggtgggaacaatggtagctgcatgttgctgaaatatacattctgaggctaggagtagaaagagataaggctggcaaagcaggcctatgcttactatgccatgtcaccgagcttgcaatactatatattctgcaagctatttggaaccgttgggatttgatgcatgagagtgaaatggtcggttttgcattttattttattttttattttttttttttatttttttgtgatggagtcttgctctgttgcccaggctggagcgcaatggcacactcttggctcaccacaacctccacctcccaggttcaagtgattctcctgcctcatctcccaagtagctgggactacaggcacctgccaccacactcagctaatttttgtatttttagtagagacagggtttcaccatgttggccaggctcgtcttgaactcctgacctcaggtgatccacccacctcggcctcccaaagtgctgggattacaggcatgtgccaccatgcccggccttgttttgcattttagatggatttctctgttggctttatcaaggatgaatttgagatgagcagcagcaggaacagaaccaagttaggaggctgctgccacatccaggcaagagacaatgcagagccaaggcagcagaaggaatggagaggaggagacacagcacagactatttagaaggtgtggctatcaggccttggggattgactggatgctaaggaagggctcccaggttcctgccttgaatggcagagtgggaaaagctctaccttctgagatggagaatactgtggatatagttaatttggaagaaaaatgcttgctttcagatatttagagttagatctctactatgagtttaaggctaaaataggcatttcttactggacagctttaccttgatgatttatactgaagatctaacttatgcacaaatttgggaatcgttaacatatgattagtacttgaaatcatgaaatgggtgaaaattactcaggaaaagaaaaaaagcataaatattcatccctgggacacaggaacattttgaagttgtcattccccagagtcacccccacccccatggcacttcagtgtactgcacactttgagatatatatatatatatatatatatatacatatttttttttcctaataaatagagacgaggtctcactatgtcgcccaggctggtctcaaactcctgggctcaagcaatccaccggcttcagcctcccaaagtgctgggattatagacctgagccactatggccagcctgatagtctactccttaacctacaggaagcagacatcaatttgttttacaacctctacatgcaaaaaatactacatagtcttatttttactaaatcaaaactttgtttcttgctaaatcttcttcccctctttgccagggtgtaaaagattcagtcttgttattccccgctttctggaatcaatcacatagcaacctttagggcttacccaggacagaaattggagtgaggacaggaaggccacaagttcccatgacacacctagctattcacgtctccgcttctagttattaactttgagccccggtagacctaggattactcaggcataaataatagccccccaaatgaaaagtgggaaattgtagagccctaatgtggagagcctgaagagcttcataaaaaaatcttagacttgttcccaccctccaaacatgtgaaacacacaactgtttcaaacattttaaatgtaccgaaattacctcataagtaccctttatatttaaatgcactaataatgggattgacatgtaagaatttccatgactaggaacaagcccgttttaccacaagccccagaacctggctataggtcagctcacagcagtgcaggaagcacctcaactgctttcaccagcatattctttttctctgtgggaccccatccccattctagcccaaaggacccgaatcacagagacacacagggtgaaatatttatgttgttgactcctcccgcaaacttgtcctctgatcattttgtgttgcagccgtgaaacaggcttgctggacgggaagaaatgctgcagagagagtggctgactcaaacccatggacagcattttattaataacttgcagcccttcattctaagtgaagcttgcccaataaaatgaggcctagagctgaacaaagctcctcttacctaacctgaatgtacaaaaaaggtttaattaaggaagtaatttttttctcccgtaaggaaatcttgacaaatagactcaaatttgcatgcaaatgaagccatctggttgattgttgtccacagtccccagctcacaggaaacaatagaaggccctttgcataactcagagaatctgcaaatctctaacatttgggtcactaataattttcagagtaattagtctcttcagagctgctatttacattggaaggtgtttgccatttacagcagaagctatagatattcttctaggtgcagccccagtgtgagccatttggtgacctgaggaaatcactcaatctgggaggggaatgacaagaccattggccactggagccagcctggcagcgacactcctcaccaaactgcagcccagagtgccttcacgcagtcttctccatgcgagccaaacgcagactcttctagccaccatctcttcccccttcctaattccccatctcccctctggggagggaggagacagggcaggggcaggcacaccaggcagggcctctacttctcatcacctgtctctgctactctgcagttatctcccgtaaacatttgttcaaatgcaatcatgtccattgcttgggtaactctaccttcttagtcgtcaggtccctcctcctttcatcagatttttacttaatggctactctacaaagcgtaacacagggctggtgctcaaggatgatagctctgattcatgtgtcctgaatggaattaccaaaaaattaaaaaaaaaaaaatcagtggagatgaagagatagggagtacagagttttggaagctagtgagggagcagaggaaggaaagagatgacgaggacaaaagggcagacatgggtgaggttgagaggagtaaaccagctgaggaagtgaccgctgcaggcttagctgtcaatcctggggtttgctgctccccgtggttggaactggaggacataatgctctgtgaaataagccaggcaccgaaaacaaatactgcaagctctcatgcatgagtggaatctaaaacaacagactcagagaagcagagaggaagatggtgggtacagaggctggaaggtgcagggaatggggagatggtcaaagagtgcagttaggaggaacatgcttggttggttaagttgtattgcacagcttggtgaatgtagttagtaatagaatatgtatatttcacaattgctaaggatgaatttcaaatgttcttatcccccaaaatgttaagtatttgaggtgatggatatgttaagtaccttgatttaattatttcacttcatattcataaatcataacatcactttgtaccccatgaatttatacaattatacattgtcaatttatgatttctaaaaaagcattagtacctgtggtaaatcaggctcaggggaaaagcctcagggtttgtcgtcttactgttcacacattgaaggaaaagaggctcctcttccatctttccccattccttggccaagcccttgcacaggctgactgtaagtgaaattaaagaatatcagtgtagtagtaagtaatcacatttgttgatcttttgttttgtgcctagcactctgctaaatgtatttcatgggttatctcctgagattcttaccataccctataaaagaggttccactgttattctgttcctggaccaaatagggtcgagctgcttattctcaccacccaataagagatgcagatgaactgggaaagaagagaggtgttttgttttgttttgttttgttttgttttgttttgttttgttttgtttgagatggagtttcgctcttgttgcccaggctggagtacaatggtgcgatctcggctcaccgcaacctccgcttcccaggttcaagtgattctcctgcctcagcctcccaagtagctgggattacaggcatgcaccatcatgcctggctaactttgtatttttagtagagacagggtttctccatgttggtcaggctggtttcaaactcccgacctcaggtgatctgcccgccttggcctcccaaagtgctgggattacaggcgttgagattctatttctgtaactgggtacagggagaacacctggaaattatcgccagatcaactcaaacttacaaagttttccagagcttacataccttgtaagctatatgtctatgagtaagtgtgcatttatctaaagacataagtgactcacttcttttaatttataactaagatctgagtcctgaagaccttcctctggagcctcagtaaatttacttaatctaaatgggttcagatgctggactaatgacccttgtctcctgctaaatcatggaggtttggggagttccttcagacccccattaaacttgtttgtggaggcctggggagtttcttcagacccccaatgaaacttgtttaatcctaaacaggtcctgttaagaattccttcattatcttgccatgtttcaaggtccagaaaaggcctaggcaaactctcggtgggcttttgttacatcctaacctttgtataagggcactgcttctttcagcttttaatatttaacttaaccattcagtcagtgctgaaacagttgttatggaggcctgcattagtaagacctggtctgccacaattccactgtacacatgaggatttaggaaggccaaatgatctgcctcacgttgcccagtaggtggagatggtagagccagaatgggaacctggaggtcggcttcctcagcctgcacacggaaacagtgcagggaagcttcaccaggtgacagcccagagcagcccagggactcacttcctgtcatcactcccaccccccaccacctcatcctggtagtaccacccgcgccaatgcttctagggctcttgctggacccacaggtggactgtgacttcagtctgttacctccttctcttcattctccacgaaagaacttcagcacatcacaagttcagttacttcactactggcagtaaaggaaaatctgtaagtccaggctgttgacaggcaggtgggaagcaagctgtggagctccaagaggcccaggaaccggaggcaggcaagggccgggctcagagccggaggaatggcggaacgtctatgtgagggtcagtcacaccccagctccccgctatgaccctgccagtgactgtcctactctacccatgcaggaagtgggggttcacactccagacaccaggcaccaaaaaatgggggtaaagctccttaataaaaacagaggaaattgacttaataaggttgacccctctccttagccttcttcctgtcagcttcccaagcactgagcaacagacatatattcctcatgaggaaagtagcggattcttctctcaagatattgaacattcagtgaccaaaacaagtcacagatactgacattcggagtcccttcaatgggacaggggactctccatgtgatcatgaagcccaaacatcaaatccaccaccatcccagacacacacactccagattgcagtcagctgtctagtacttgactgttcggtataaacagacaggtgagagtcaccaactatgtaggataatgtcagagatgtcataaaagaagggacccccaaactcacaatccagggtaggggtgggtggcaggaggtctgggaagaaacagaggcgacagagaaagcagaagaaaacttttgataattaaattaatattctcagagagacaagagaagatattgagatattgcctccaaaaaaattagaatggggtgctatgaaaaaggggactatcagagaacgagaaataatacttggaaatttaaaatatgatagctgaaattaaaacacaatgacagtattgaaaataaagctgaggaaatttccaaagaagtagaacacaaaggaaaaagatcaaaatgtggaacaaaattagaaaaaaaaaaatctaaaataaataggtgtttgagaaaagggatcagagaaattattaaagtctcagacctcatatgggagaaaaatctatatcaaggcaatcatgaagttccaattaaaagagttaaagaaaagatcctgaaagtttccagaaaggaaaaaaatgtaggttgcatataaggcttcgtaaacagaaagcagttgctttcccggtagcagccctgacagcctgacaattttctttctggagtttctcaattaagtgcgaaagtagaataatgactcatcagaggaacatgggtttagaaagttaacctcgagtatctcttttctcaaggagctacctgagaatgtgtttcaggaaaatgagagtgtagacctaggaagtggatgtcatgagatcctgaaacttggggatgtaataccaaagtgtggcaaaaggaagtccctgcactaatggcagagggaggtcccaggacaagggctgtgcaggaaccctgagaagaccccgtccaggtgggaacagaggaaagagagccatagaagatgcctccaggggacaaaaacgtgactgcagatggcctgatgtgtgcaatgttggaaaatgtttgagaagagttttactgctgtgttagagaatctggagagaattcgtggcagatacatagaaaaataagcaaatgaaaaaaataattatggattttaaagaaactaaatacaagaaaatacaattgcaacaaacaaaaatataagaaaatacaattacatacaacaaaatgcaagaaaatacaatttaaagaaaatacaagtagattttattggttggcttttaaataatattacatagtcctaaaatatgaatactgtgctaaattttagtattattattattattattattattattatagtgtcttactgttgcccaggttgaaatgcagtgacatgatcacaattcactgcaacctcgaactcctgagcacaagggatcctcctgcttcagccacccaagtagctagaactacacagctattttttttcagagacaggatctcactgtgttgcccaggctggtcttgaactcctggcctcaagcaatcctcccacttcagcctccccagtcactgcaattacaggtgtgaggcaccatgccaagcttgaatttcaatataaccaaaaatctgtgatttagctatttggggagaatatagagaaaggggctggggaagcaggcttataaaagtgctaaattctcatcttatattcaggaaaatcagtagagaatatctaaaaggtataaatcaataagtagctccagaggtttttttttttaaaaaaaaatacagctgtttaattgaaagagttaaaagtgtgagaaggtgtctctaaggaattgggaaggggcgggaagcagggaactgctttttgctttagtcctagcaccactagacttttataactatgtacatgtaatactttgttagaaacaaaaattaggttgaaaatgaaatgctgtccatcagaaaatgtgctcagaaagcttgaagttggaatcctatactatcttagtctgttcttgcactgctgtaaaaaaatacctgagactgggtaatttataaagaaaagaggtttaattggttcacagttcccgcaggctgtacaggaagcatgatgctggcatctgctccgcttcttgggaggcctcaggaaacttacaatcatggcagaaggcaaaggggatgtacacataccccgtggatggagcaggagcaagagagagaagggaaggtgctgcacactttaaacaaccacatctcataagcactcaatcactatcacaaagacagcaccaagggcaatggtgctaaactattcatgagaaaccgcccccaggatccaatcacctcccaccaggccccacaacattgggggttacaattagacatgagatttgggtgggaacacagatttaaaccatatccaataccaaataatcactggtcggattcaagtaagtggctgctatgaaatttgtgtgaagatatgatagtgcattttctattgatgcttaattggggtttaaaatgatgtgatgatggagaccagcaagcctgctttgcaggctcagccccgctctcctgcactagctagaggtgcctccctggttcctcttgccacacgtgatgagccctggccttgcctaacatgcagtcacaaagcttctcatgtgattgactcacttccaagctgcagagccttcagtgtcatctcgatcattctgtaaagcttttgactccagccccgggctgggtctccagtccctctctacctgcctcattattctgttactgttgactgacccttccagtctcagacactaatttctgttctgtctcacatctttcatatcttccctctcagtttccagccttgcctcctccacttatccgtgctggcctggtccctgccacctcctttggcactctctttgccatatagtgaatctcttattcccagcttggcattctcacccattgtcactttacctccatagcactgaccttggtagcaagtacaaattgcagtgatttcaataaccttaaggttatgataccatcagtcttgcaaatgcatggtattgttcaatgaagtctatagggagttatagaaataaagccatggataaggagaattatggtgtgctagtggaagcagtatccagttatcagtaggtgctaaagcagcattagtttttatttatatttatttagcatctttaacacccaggttaccaaaaagaacattctgtctcatgaggactttgtaaaaggagtgaaaatggatataaatgagaggggcaatgagttacttatgtattgattgaataattatttatgaatggtgactatattctgaggctgaagattactgagaggaaatgttttcatgccggctttcatggagtctatgatcagttgggagcagtatcaacaaacaataataactctttgcatccagaagcgctatcagcactggaaaaggcacgcatataatcttgttataataaaaaaatcccagagattgggcaacagattcctcagaacaggactcagagatggtgaccatgggctggagcagaagcatccatgatttattatttgtaccacactcactgaaagcctgtaagtccacatcccattaagcatgtttacttacaaatcccatccatgtgccactgcatttatatagtgtacattataaagtataactaaaatcgatattaaaggataacatttttaaaataagtaaaagcagaagttctaacatcatctgcctgagccccagtgatcacccttggcacctcctgagccgcactcctactttgataccatcagtctaatccagagtggagtcctccctgttgcttctgaagaatctggatttaataagctcatccagagatttgagataactcacaattgacaactccaagggcatcatgtgataatccagatgtttccaggatagtgggaaaaaccatttgtacaaggcatgacttccccgtgaatgagtctattcaagagatcaaattagattgaagttgcttagtgagcatagaattagaataaatggaattgtggtctatagagatatttcatcacacttgaataactgatggaactacttttctcctctctgcggatatttctgtctgaataaccagtgctgggcctcaaataaatactgacatgttttacttttagctttcctttttctagaatcattttagacaactgcccttctgttaatacatcaccacctcagaaaataagaaggtacttgattggattgaaattttaaaatgttaattgcattcgtatcctggggatacagcctaaagagacagaattgctttgcttaaggctgaagtctggctggggactttgatctctgcaggctctcgggtccttaaagggctctcacccaattaggatgagctgaatccttctggccctgggcctcatctttattccctcccagcttcaggactctctgatgagcgagagcgtagatttaggttttctcacagaggtgcacctgaacgcctcttgctgtgtagtaaggcagatgttgaggggggaggaaggcttacccttgataactagcaacttgagctttgcaaagcgcctttctgttcctgttaccagtagcctacactacatcatacaatattctcctccccaagaagaaagcaacctatttgcctattttctcctactgaaatctatgattttatactttgtttaaaaaaaaaatagcagccgagcatggtggctcatgcctgtaatcgcagcactttgggaggctgaggcaggtggatcacttgaggtcaggagttcgagaccagcctgaccaatatggtgaaaccccgtctctactaaaaatacaaaaattagcctggcatggtggtgtgtgcctgtaatcccagctactcaggaggctgagacaggagaatcgcttgcacctgggagggggaggttgcagtgagcctagatcgtgccactgcactccatcctgggccacagagcgagactctgtctaaaaaaaaaaaaaaagaagaagcttaagactgcactaagattaggaacacattaagaacagtttttaccctaatgaagatatttacaaacatattttgcactagttccctgtttatgtattacctgcgacagtaattaataggaatgccattggctgagacagcttcagagccctagatacctagggaagcaagccaaatcctcttcaatgtaaatactgaaacgaaactaagcttatcagcaatcagaaaccaccacctaacctctaactaaagactttccacattaaccaatcaaacggtttctttgtcttgcatccacaaacacatttctctctctccaaccccgcaccccagtagacaacttgaattctggtgctgcccaattcacgaatcactgaatgtccaaataaacatgttaagattttaatatgcctaagtttatcttttaacatgcctggggacttatctagatgttgctatattctagacatttctaaaaacaaaaacaaacagcattaattaaataagaccatattttaatatttcataatttaaaattatgacttaagcatggcagaaccaacacaaagtaacttttatttgaaaatagtagctcaatttaatattgcatatgtgtataatttgcataaaaggaaggaaaaatatcatttgtgtatgaatagaaactaatggagtgcacttagttgattcattgtgccttttggagaaaagatatagcaaataccgtgttttttaaaaagcatacatttggagtttagtatcagagctcaaggctttagtaactgctttaaatcacacccatatattttagtctttagctgtgacagtaagtgtactcagaaatgtgcacattaaaaaggaatttctcccctgaagatgaagttgagagccaactcttgatcccatattaaattcttagtccatctgtcctaatggagtctgagtaacgcagtttggtgtttttattgcatcctgcgagctgcttttctcctggaaacactggctgctctgtcaggcaatgagtggggagaggcagctggtacaatcacatcttctccaagagctcaaggacagaggctggctgagagccatttggtgggctcactgcctcatccccatactatacaacaatcccacaggccagagcctcacctgcagtccccaggaggaagtaggaagggaagagaaggcaactcacctctgagagtttggcgcaggagaggtgaggaaactgccctagcctagtctggtcacttctgcctcgttcccggctcctcacctcctccaggctccgtcagttgtattcctgaagcacctgcaccaggtgtctgggtggccgttgacacaggagtgagcactggctcttccaaggcagaggtggatgaaaagcaagagcaaactaccaaaaactttgttcttactttgtcatcctgaggtttatctcagatgctgcttgcaccagaccaaagctaccagtacatatgcaggagttcaaaacagcccccacccacccacagagtaaccccaggggcttctcccaattgttgtgtctattggcatttacttcttagagtcccataggactccttggtaggaaccccaactatatcaatctttattgttatataattataaaatattgtttatcataaatattataaaatattttattgtacaatttatagaaattctatattaatatttaattttatatagattgtatatattaatactttaaatatctttatatgtaaatgaatattatatagacacacatataacttttggaaagtcaaaaatatatttgtgaggatttggtccaatgttgttcaacagaatgagagaaaataatgactattgctaatggtacttattaaactcaagcaatgggtatctgttacatgactaggctgatcagggtgtgagttaacctgatttttttgttttcttcccacagggaattattggaatgccgcctctttcccaaacccatcctcctacctgcacttctctactttccaaggggaaactagcgctgacatttctttctacttcaaaacattaaccccctggggagtgtttcttgaaaatatgggaaaggaagatttcatcaagctggagctgaagtgtgagtataagttgcttgtcaactcatggggagccactttcgtcacctcagggtggtccgggtcctgattgtggaaggccttttgattcaaacgtggaaggtttcctttgttccaggagcaggactagaggtggacacacaagcctgagtttgggctccaacctcagtccctgtccttgggatgctctcagggaagcaggcacatccagattctcaagcaattagtcaagaagatgagagagaacacaccgccctgagaatgtgggagaggaatgtttatcttcagcttcatgtcttgtgtggctgttttccaaagagacagggtcaaaaataggtgaggggtgtgtgcattgacccgaggagcagggagtgaggaaaatcatgtcaaggtcaaggaagacaggaatgataactagtgacatccgtgtgagttcaggaggccacggagaccacaggactgggcaattccatgacacagagtctgcaggattcctacagaggacccacacctgcccaccctctgcaagtgagttctggatgtcatgtacttagccaaagatacagagacaataagaggcagagcaagagaggatgctgcttagctcagctcagctggccttggagcaaacatcctaagggggcgttcaggcttggggagctccgtcagtggaaggtgggggttagctgcacaagacttgagaagcgcaatgcttgccctacctggaccctttaaacatcagggccccaattcagctttaggaagttacaatcccctgacttccaggccagttgattatttgcaaatgttgaactccgttggctgtgagagtcagggagactccactggctgtgagagtcggggagatcaaccacaaggacgaggccaggctatgtcccctgtccctttacaaaacctcagccttacactcagcatatcaaaaagtctcccttccggccaggcacggtggctcacgcctgtaatcccaccactttgggaggctgatttgggtggatcacgaggtcaggagttcgagaccatcctggctaacacagtgaaaccccatctctactaaaaatacaaaaaaaaaaaaattagccaggtgtggtggcgggggcgcctgtagtcccagctacttgggaggctgaggcaggagaatggcgtaagtaaacccgggaggcggagcttgcagtgagcctagattgcgccactgcactcaagcctgggtgacagagcgagactccgtctcagaaaaaaaagtctccctttgccaagtctgtcccctttaaatgagtgcttatgttcctgggtctggtctgagaatgatcccaaatccatttcccatttctgctgaaatgctattggattcacagtagcattcttaggttcaattccacaccgtcaggtaaattgctcaatctctttgaatcctaattttctgatttataaaaaggaaatgttaatttgtgggattgtgatgagaatagaatttaaatactcataaggcatttattttggtatctagtagttattgtaattatcatcttctgaggatgcccatggcagatctgatctgagccaggtctgattgaaagggaggctaaggctatcctggtcctagaattaaaattaactaattaattaaaatcccccctttactgaattctggataagaataattgaaaggggattcttgcttccctcagttaaaattaactaactgaatcaaactattttctgacttctacataagttggatcaaattttagaaagattttatggccacaaaagaaaattgccagttctatatttgagtggttctgtaagtttctataaaagtgcttggattcccccatctttattttatgtcctcaagttttgtaaagccacgcctgggtaagaaggaacacatactagatagagggagagcaggtgtttctactcagccctcggggtcaaagaatttctctactttcttctacttttttctttttttttgagacagggtgtcactctgtcacccaggctggagtgcaatggtgcaatcatggttcactgcagcctcgaattcccaggctcaggtgatcctcccacctcagcctcccaagtagctgggactacaggtgcgtggcactgcacctggctaattgttgtggtttttgtcactgcgggatctcgccatgtcggccaggctggtctcaaacccctgggctcaggcagtgtgcctgccttgacctcccaaagtgctgggattacaggcatgagccactgcacccagccactaatttctaattatgaaaaatctttagagctgtcttcagagttttccaggtctttccacagtatgaaaaccatgtggcccatggttcacagtatgaattacagcctccttttgtcaaatacctttactttcactgtatcctttactctgggcaaaaacatgtgaaacgttcaagacccagattcgagcctctaatcttccctcagagccccctgtatctactaataaccagagagggtggaaagacattttcacgatccccaaaatgtcacatattagatgcccatcattatatgtcatctccatcagggttcaaaggagcctcatggagagggaggcagacttctgtatttaagaaaaactacaaagcaaaccaaaagtggtgctttcatgaagaacatggagaaaaaaatggccatgatggaggcttgttgctgtcgctgtctcatcaatcacactttttctttaatttttttttatttttttttatggtgtctcgctctgtcgcccaggctggagtgcagtggtgcaatctcagctcactgcaacctctgcctcccaggttcaagtgattctcctgcctcagcctcccgagtagctgggattacaggggcccgccaccgcgcctggctaatttttgtatttttagtagagacgggctttcaccatcttggccaggctggtctcgaactcctgacctcgtgatccacccgcgtcggcctcccaaagccctaggattacaggcgtgagccaccacgcctggccgctgatcatactttttcagtcagacacttcgccatcaggattcctgagacattgggtagagaattctctcaggcccacttccttgtgtgaggaatcactctgcaaacctaattgttttcacaacagtggcgggctaccagaggggcctcaggaaacgttgattctgaagttaaactctttagaactgtctctatgtttttcccatttagcttgttaggccttctgatctctttctgataggaattcacattttttttctctaagcgtgtctcagaggaatttggtcacagttcatgactacatattgctttccagaatgacagttctgttaattaattacattgtgcccttctgtcaagagtggaagattctcgactcagaaaacaatgagtcagtgtacactaagttaatgagataccatcagcatcttatgcacaagtagaaaaacacagagataaaattagggcaatctcactcattagcatgctttaatggtaacattttaaccctatacttcatgtatttactattcatatttattcattcatttaatgagtatttactgagtatctactatgtcccaggtacagtgctagtgctgaggtaatttagtcaaatcaagtgtgatttctttccctcaaagatctttctgtttgttttagaaagcaggcaagtaactcaggagttatgataataacaaaaatagctcagcttcattcagactttcaggcctcgttccaggcgttttacgtgaatcatctcacactcctaaccaccctgtgaagtgcatactagcattcacatctccattttacaaacgaggaaactgaggcacagggtgagcaagttgcctggccaaggtcatacagccaggaagtggcagagctggtgtttgaccccaaacattatgtgtctgtcccaaagtcattgctgctaaccttaaagcacactgcctcacagaacagatagcaagaaagaggccgggagcactgaggggaatttttaaacctgactggcttgacaaggagcgcctcccagggatggaatgctttaattaaattttgatggataagtagaagccagtaaggtgaagaagtgggggaagaacaggagccagggaaaaaaggaagtttcaggataacaccaaatgaacgaaggtgtcggagactgaaccgaaggacccaggaggggacaggtgcagtggggaggggcaggggccagcaatagcaaggtgggcacagatgagcacccaatgcactctgccagggggagcatctgactcaacatgaccctgaaggctatggagagccagggcgtaacttgatcaggtttgcattcaccagagaaaagactggaagccagacaaccagccatgggagcctctgttaagacagaggcagaatgcatagaaagagaggaagacagtgatgaagcattgtagatatgaaagatccttcaatgagccgagatcacaccactgcactccagcctgggtgacagagcacagagcaagaatacatctcaaaaaaaaaagaaaaaaaaagaaagatccttaacagatagattccacagacattcaacaaatactcgtgagggttaagtggacgggaagatcctagaatgaaaccagtgtttctagttttgatgttgtgtgagtggggcacctttcatgaaggagtctgacattcaagagcaaaatacaaactgcattctggatattttgagactgagtctctgtgggctataggaggatctaatcaagtggacacatctagaggatgctgaatggacaagtccagaacccaacagagaggtctcagaaactcagtttgggagtcatcatcacttagaggatcaggaaataagcattcagtaccctcagcatggatgagattgcccaaaacaaatgtgtagagagaggaagcaagatgtacaagaaagacaaccagctcacacctgtcatcccagtactttgggagtagcagtaggtcacacctgtcatcccagcactttaggaggctgaagggggagtatcacttgagcccaaaagtttaagaccagcctgggcaacatggtgaaaccctatctctacaaaactaaaaataaaacattagccaggcatggttggctgcacctgtagtcccttagcctcctgcccagaggctgaggcaggagaatccctcgagcccaagaatttgaggcagcagtgagctatgatcacacagctgtaccccctagcctgagtgacagagcgagacctcgaggaagggagagaaggaagggagacaaggaagggagagcaggaaggaaggaaggaaggaaggaaggaaggaaggaaggaaggaaggaaggaaaaagaaagagaaagagagaaacagagaaagaaagaaaagaaaaaggaagaaagaaagaaaagaaaaccacattcaaggaatagaaggaagaaaactagtttgcagaaaactaacagagaagtaggaagacagtggtacccagaaaccaaatgaaaaagacatttcaaaaaggaaaaaaagagggttagatattgctgagaggtccctaaaacaaggacataaagtgaccatcagatttaacatgtagaggtcacggtcaaaaagtcaggtatcactagggtgagtggaagtggatttggagatcaagagagggtggttttgttcattctagtttgaggatggtagagactttagcattcatatagttgaaggagaaaactatggtagagaagggggattggtaatacaggagataaagggactggctgaaggagcaaggtccccatggctgtgggcatgaggtagacccagcatcgcagcacctcacaggggtgagaggaagaggcggaagtaaagagaacagcgtaaaccgcccactaggaagtgcctttccaaatcagaatttgttgttgttgttgtgtgtggacgtttgtttgttagtatttttgagatggcaaagaaatattgttcaaaaaaaatttatggagcagatatcagaaaacccagactctaaacttttcttcatcactaacaaccatggatctgtccatgtattttttcagttacccctaagggattagcttgactgctctagatcctttttctgactgagagggccatcataaccagggtcccaacctcgggccaccacctcctgagcacctgccctactgctggtgctgggaggcgctggggaagctgaggtggaaacaggagaacccagcatccacctcctagtgaaggagacaaacacattagtgacagtgtggatacataatttcattgagagctttgcaagtgccaggccctgttctaaagcttttgtaggttattaacttttgtagtttacacagcaagttttatacacattttacagctaaggaaatgagagcatagagttgacactgccgaatccagatatggtgcatttaatcgttaaaataagtaaattacaatgataggcacaaagtattatgaacaatcggtggagaggtatgtgacctatcctgggaatgaaggggaagatgagggaatgcttcagttgggtcataaaaatcaggcaaaaaagttaaaggaatggggaaaagaattctaggaggaagaggcaatgcgaacaaaaacacaggaatggggagtgtgatgggcgtttgggaaactacaagcattttgtattgttagagtgtgaagtatgacacaggcagtgaagatttggggtcaagtctcagatctcattctaaatatatggtcatctaaatatttatctagtatttattgagtacctgctatgtgtgtacctaaaatgaacgtaagaagaagacatggccccatcccagaggcacacaccatctagtgggaaagactagtaatcttaatctctctctgtctctttctctctttctctctctctccctctctctctgtctctcttttaggttcaggggtacatgtgcaggtttgttatattggtaaattgcatgtcacggggatttgatgtacagattattttgtcacccaagtaataagcatagtacctgataggtagtttttccatcctctccctcctcccgccctccacgcttagtacacgtatccatgcgtactcaatgtttagcttccagttataggtgagaatatgcaatatttggttttctgttcctgtgttagtttgcttaggataatggtccccagcttcatctatgttgctgcaaaggacattatctcattcttatttatggctgtgtagtattccatgatgtatatgtaccacattttctttatttgagactagtaatctctgttattataaaactgtgtgtgtgtgtgtgtgtgtgtgtgtgtgtgtgtatatatatatagttttttttttttttggacagattctcactcactctgccagctgggctagagtgcagtggcacaatcttggctcactgcaacctctgcctcccgggttcaagtgattctcctgcctcagcctcccaagtagctgggatcacagacatgtgccactatgcctggctaattttttatatttttagtagagacagggtttcatcatgttggccaggctggtctcgaactcctgacctcaagtgatctgcctgcctccacctcccaaagaactgggattataggtataagctaccacctacagccagcctataaaataatattttggataggataatattagaggtacgaacaatatgctgtggttacttagatgaggcaatatttacttctgactggagaaggagaaaagtttccttgaagatgctaacattttaaaagagccacaaagtaaatggaaaaggaagtttcaggtttagaatgccaaaggaaaaaagcacagcatcatagatggcatgaacacatcaaaaaggtgtggctccgtcatacacccatgctgcgagggttacggaacattagttaccattatatctccagggtcaccacaatgcctggcatgtggtaggaactaaataagcatttgttgaatgaatgaaatgaatgaatgaggtgctagtctgaatggagagccccagaaaatctaggtggagaagcagatcaccacgactgaggtgctggcgatccaaatatagacaaggaataatatgtggaaaggtggaaggacaggtcacggttagtgaaattttggaactcacgatttcacaggaaagcagtttgggcggtaagaagaatgaaaattgaaatggaattttgtaggttgtatcaaaaggctgcggagaaagtcagggcactgggaggccagagtagtgttggttggtcacctatgtcactgttgaggtcatcaatggtgaagacaagaggtgaaatggacagggaatccatgacccaaactttactgtcctggggttcaaacagtgaccacaatatgaacggggagaggacgagtcacaggtggacgcgaagccgtttgaagactctggagccatagagtggaagaagtacggagaagggaagaataggccaactgttcgcctggccccaagatatgggccactcagaaaaggggttacaattctaagggttgtaagttagggtccccttagggtggactgcaatcagaggaaggaagtgtttgaaagtgtttaatgatacaacaaatagtgaccatagagtctatttttgtttaacaatttaaaagagattttagtctgggcacggtggctcatgcctataatcccagcactttgggaggccgaggtgggcagattgcttgaactcaggagttcgagaccagcatagccaacatggcgaaaccccatttctactaaaaatacaaaaattagctgggcgtggtggcacacccctgtgatcccagctactcgggaggctgaggaacaaggatcacttgaatccaggaggctgagattgtaccactgcactccagcccaggtgacagagcaagaccctatctcaaaataaataaataaataagattttagaggacatttgtgaaggggatttttggagggaaattttgaaggaaaagctcactgagtaggtaacattcaggaaaagcaaccagaaactgttgtaatactttaacataagcttccatgttgcccaagtttgagatttttaaggtatcaggataacttggagggaatatttgcatttagcagacatatctccacaaaaatgtgcaggcagcggcctaatgtcctactaatcttaggaaataatatgaggaaaaactttcatgttcaagatgcagccttatgcaatatacatgctcaagaaagtcagaagaaaatattctgcaatatacagaaactgatgagtcagaagaagtaaactaatggcaatttatcttccagtatttcaaaattggaacaactttttatttttaaatagtttcactcttgtagatgtgaagaatgtctaattccacttaactgggctgttgttctgttggggtgttatttaggatgttttaaaaaatattgtgttttttattagtacaaatcaggtgttagcacctggatttttcacacatatattatatttatttatttagaggcagggcctctctgtcgcccagcctggagtgcagtggtgcaatcttggctcaccataacctccaccttctagacttaagtgatcctctcacctcagcctcccgagtagctggtaccacaggtgcacgccaccacactcggttaatttttgtattttttgtggagacggggtttcgccatattgcccaggctgatcttgaaacctggactcaagcgatccacccgcctcagcctcccaaaatgctgggattacaatcgtcagccaccatgccgggcctctggatttttctttttaattatccaagccaacttgggttatcaacatggatttaggaagaattttagtgtttctactactttgcaagtctaattatggtttcaatttatattcaacatttggaatctgaaaagtgattctgacttggtcattactatacataagaaaaaaaactattctctccccaaaaataaaatttgaagacctgaatatttaataacaacacttgtgattaaaaagaaattctctaacttctcgatttaaacctttgatttgaattacagaccaaaaagaagtttggaagtgtaaactaaaatgaaatttgtgctatattaaagcttttcatataatagctttttgttcttaataaatattaaaagatatataaatagttggtaaatcaatttagattaaatttatccagatttctttgccaattacactgaagggacagttatttgaatgtacagtagaggtatcctagagttatgaagatggattttagaatagaatgtcttctggatataaaaatatttcaagttactttagagtttactggtccactcatgtcctgatctggaaatttccagagaagattgggaattcctcctaagctggccagacagagtgacatctctctacagattctagagttctgcctctctcccactacacttcagaggtggctttgaaagaccacccaggcctcctgaccagccctctcacgtggcagctcctatgggtgccacataaccgcagtctctccacatcgcctttcctccccatcgtggagggtaccttcctggtaccaggaaggatcttccatttgaagatacaactgccttcttggtaataattcctttgccttgggcccacatcctggattccaagtaaccaagggcaggctacttccagtcacacccaaagagatggcttgtccctcggctggggctcaacttctgctttggaaaccagctgaagtccaggacacaggctccccaagacctcactagagatctggtgtccttagactctccctattaaactccagcttatttacatagtcacgggcattttaggacaataaaaagaaagtaaacatcagaggcaggatttcctcaaagacattacattgtacatacatgacggtatgtcctgatttctttcatgcgatgctcgaaaataacctaagtaatccacatcgattactgcagagaagccagaagagtaactattcctggggatagctgatgtcaactaggagggggtgcaaaggaactttctgggtggtagaaatagtctttatcttaatgcaaggaatgattgcatatgtaaaaatgtatccagctgtgcattaagatatgcacattttaccgtgtataaattacagctgaatggaaaagtagaaaaagagaaaaactctgctctgagaaaatcttgaatgacaaaaaagttaataaatcactcaatttttcaactacacttagagagaccaggattctaagctgactgaccagagaccagtccttgaacctctccagactttatcatatccacttgtaaaacaagaaggttgaacaagatggtatttaaggtctcgtctaccatgaacaattcggcaaacctgccggagaccatcagccatccagtgtggcttaccacctcccaacctaagtgaactcacagccaagcagcaccttaacttttcatgccagggttctcagttctcctaaggatgatggggggagggatgtgccacaataaaacacatctgcttccagtaattccagtcagcatatatgctttcaccaaacgtagtcaggagatctcctaacattattgccacctaattgtaaatgctaactaaggagccatcagaatggcccacgatacctcaagctcaacatatcgaaactgaaatccatcattttcactcaaaagcccccttctgtgctcccacttagttaatgtcatggccatcttcttcattattcaaattagaaaactcaatgtcctatttaaagttttactaacctccccataggggatagactgttttatcttgatagaacactgcatttttaatataaagaaatgctattcttcctgtaagccatcataccagaacaatgccacagaaagcatcaattcctactagtcataaaaggcagctggaacatagatgtgaacataatgaaatcataccaaatgtctctacctcccaggatggctttgctagttgaaatccctggattctggattcagacaggctcataatttgactccctcactccagtccctctatcctgataaccaccctccctagtgaggccaaatttctacagatctggtccagttactcctttccttacagaccaccatgattccccctgtgccttataagacaaagtacaatcccaagcttggtaagtgatttacggcctaacttaattttcaagtttttttcccctactccatacaagctttgcccctcacccaccagcaccatgtgccacagcctcagctatgtccagctactgatattccctggacaccactacagtttcctaagactgactatgtgtctgcctgttccggaattgcttccccttcattgaaatcctgcccacacaaaattttttttatcattttgcatcttgatttataatataaaaaataagacagaagacttcatttccccaaaaataccaaaatttttacaagacaattcattaggtgcattgcctggaaagtagcaggaatcctcattagtcagcatcttcacatagcatttgtctgaatggagtagtttatcattactccaaagacatactgaagtttcattaaaattttttgatgtaatttttcttctatctcactctcttggattctaacgttttcttttctcttttcttcttcttttttttttttttttttttttttttgagacagagtctctctctgttgcccaggccagagtgcagtggtgcaatctcagcagctcaccacaacctccgcctcccgggttcaagcaattctcctgccttggcctcccgagtagctgggaccacaggctcacgccaccacgcctcgctaatttttgtatttttagtagagacaggttttcactgtgttggccaggatggtctcaaactcctgaccttgtgatctgcctgccttgacctaccaaagtgctgggattacaggcataagccaccacgccctgccaacactttccatattatttactctatgtggtagttcatgaaacctttcccttctaaaagatggcctgttaaagtgtcaaaaagaccaacaactagaattggcctgcctatgaccatctgtaagacaacagaccctctaagagaagaaatcaaagaagtttgaattcacacattctgagacagacggaagaaagatatgctattattgctggataatgaacacatggatttatgagaaaagcagaaatatatatgaaaaatttaaattataataaggttagagactttccatctgccattctaggagctaacagtatctccataggcttgatatttttataaaaacaagtgcttcaagaaaagagttaacagtcagtcagtgtgtgttgctaatgctggagaattgattcaactagggatgacacttgggaccaattaattcaaagctggctttaaaaaaaaaaagtagatacaataaatcagggagtagagcttcatttaaatatagtgagggactgggatagattacttgaaaaagctcagaaccaaagattgtctcaaaaggccaaagacaactataagtaaaacaagtgctaggtttctataagctatcaaacactgaaatcaaaaccatgaaagaaaatactggccaactggatgtcaactggaaaatttatacaaagtttgttaatttgtacttgtatcccctcaatctataaaaattttaaaacatgttttaaagcaacaagaaataaaaacagtttgttataaatgaaaattttcaggaagttatcgttctcaagatgcattttactgaaattacaagacaatttttaatagcaatcaagtaggaaccttgaggagaaatggggaaacgtaaagacttacatgaaatcttatacgggagtgtggtcacagtaaaaatatatcttctttaaaaagatgtttctatttcttttgtattgctgttttacctttaattttttaattttttttttttttttagtttaggtacttctcaatttttaaggggattgtgctctagaagtttctgatctagttgttcagaacctgaaatgtattttaatgtagacaccgcattgtatatagcactcacattccatagctaaccgtaaagagctctgctgttgctgtagttgagtgttgattcaaggtacacaggacaggctgagatctgggtcctggcttctggaggccatgagatgtagaatagaaatgttgaagaacaaaaagaattgtttcttgtatttctgaaggtcaagcttgagcatgacaaacttctccacagggaaagtttttatttgcctttttgatagtcaaatcacggtcctgcctctccttttgttgggagcctcattttggtgggttagtaaagggaacatctccaacattcataggagcatttgtttaaagggctcccacgtggcttccagccacttctctccactctgaaacttctatgaattagagaatccccctaattcattcaaatatattacggcctatatttttttaatattacaatgatctgacacagttgggtattgaaaatagagtaaaaccattacaccacaattatcccttcatccctgatgaacatcctcttgtccatttttttaatcatacgaataaatgaaaaaaatgtgataaggtcataagagagttaggaacattatgtaatcttctttaaaaataagataagctgctctacccagtaaaaccctaggtttctgcagccatatgacagtctgatatgcatgctatggtcggtcacggtggctcacgcctgtagtccagtactttggaaggccgaggcaggcagatagcctgaggccacgagatctagaccagcctggccaacacggtgaaaccctgcctctactaaaaatacaaaaattagctgggcatggtggcgtgcgcctgtaaccccaactactcaggaggctgaggcaggagaatcgcttgaacctgggaggtggaggttgcagtaagctgagatcgcgccactgcactccagcctgggtgacagaatgagaatctgtctcaaataaagtaataataataataatatgcatgctatgctctggtccatgaagaccttccacacagtgatttagaggttcagactccttttctctgtggctccaccatcgtctagagcccgggaagtctagctggcaaagagagaaagggaggatagagaagcattctctcttcttgaccacactgaaccagcgtgaacacattccttgccctcctccctttggtaagagctagtcacatgtctccacctggatgcacagggaccaggaaggcagttactggctgggtagcagctttgcgggagtgatgatgaaaaggggaaagaaaccttctgtgaatggttagtggtctcttttacaggtactatgacaccaaaaaggagtaaactttaaagacaccaaggtaagtttccaggagatgcagcatttgatttgcattgaaggatgacaggcaaaaatgagataagggcatttttctggagagaaaacagcataggcaaatgcaggtgggggaggaagaccgtgcaacatagaagcaattgaaaggaataaagccgaagcccaaggaccacttcaaagatacctctctctagagaaatgacccaccgcctatctgttaagagtttgacaaatgaaatctggctgaacctcaggccttgtcggaaattagtcattttgcttgcctttgcggatggtgttaaaatgatcaaatttggttttctgcatctctgagtttgattcctctgatgagaactgatgcgaatgccaactgactttttatgaagagtggttgatatttagtattctacagagtctttctgggtaagtgtaaccagagccagtgaataatagaagcagtgtatatctgtcaagtgtaattataacactgaattatgctcatcctgcattccggttcctgtatacattagtttaaacatcagaacatgctggcatttcagacctgtgaggattttactttgaaaaatagcatgcccttgtttttagccatttttaacaggaaaaaagaacttatatcttgttcaaaattattttatggtaaagtttgaccactctgttttttaaaaaaatcttctcaagtttctaaaaatagggaagaaatgaggaatatttcagtctagttttaaatgccctctaattttctgtatttaaataaaatcgtatacaataaaataatatcttattttgataaactgaactttctgattaaatagttgttaaagttacagaatagagttgcttataaagtcaccaatctttgccagagaaagtggaaattatcagattgtaactttaaaattatgcaagtattgtttatcgttgaatgatttaaaaattcagagcagcaaaaaggacaaaacaaaaattcagctataatcccatattccaatatatttaaattatcattttggtgtctatatttctaaacatttttctatgcatttatatatactttttttttacaaaaatgagatcatagggtacatactgttttgtaacctacttttttatgtaataatattttaagaacacattttcatgtcatttttcttaagactccataacaatatttttttttcaactgagaacaaggaccataccagaatctccaagagggcatgtgtagtttgaaaacttataattttatatttagaaagaaaacccaaaaatagctattgttttggtaatataacctacagaatataaagcatagaaatttccaattggctggtcggatgtttatctgggatcttctgaggtttgttatattaccattagcctcctacatggggcatgattagattactatgtcaacaaatgggagcacagattttgaaagattgtgaaatacagtgcctcaactgccaagcattccatttaacccacagtcccttgctgttgggcttaacttttgaaagataaatttccacacattctgatccactggcttctggttgctcattcccaatcataacatatgatagcatactatctattttaagtatgtgatatgcgattgctttttatcacatactcacatatcacagcctcaagctgcagggcagctcaaatgatgaaagtggaagacaggccgggtgcggtggctcatgcctgtaatcccagcactttgagaggccgaggcaggtggatcacctgaggtcaggagctccagaaaaacctggtcaacatggcaaaaccctgtctccactaaaaattgaaaaaatagctgggtgtggtggcaggtgcgtgtaatcccagctactcgggaggctgaggcaggagaatagtttgaacctgggagggggaggttgcagtgagccaagatagtgccactgcactccagcctgggtggctgagtgagaagaagagaagagagcagaggggaggggagggggggaagggagggatggggaaggaaggagggagggagggaggaaacaaggaaaccacactggaaggaggaaggaaggaaacaaaccacattgggaagagagggaggaaggaaggaaggaaggaaggaaggaaggaaggaaggaaggaagggagggagggagggagggagggagggaggggaagggaagggaggggaagggagagggagggggaggtggaaggaatggagggaacggagggaggaagggagggaagggagggagggaggaaggaaagaaggaaggaaagaaataaacaaacaaggaaaccacattgggaaatccaagcaaagatgggctcagcaggtcacatggtttggatatttgtccctccaaatttcatgttgaagtgtgactcccgatgttggaggtgggaacctagtggacagtatttgggtcatgggggcggatccttcatgaatggcttggtgctcttcccatggtaatgagttcatatgagatctggttgttttaaagagcttggcacctcctcctcctctctctcgcttcctctcttgccatgtgatgtgctgctgttccttcaccttccgtcatgagcataagcttctgaggccctctctagaagtcgatgccagcactatgctcatatagcctgcagagccaagagtcaaataaacctcttttctttataaattacccagccctaagtatttctttatagcaaggcaaaatggactagaacagctggatagtactgctaaccgatgaccctatccccaaagctgtttccattcattctctttgttgagagtatgtcaaaccatcccaggatggaggctggagatgagtttaaccccacctgcaactgttctctcgatggagctactctacagaaaaatcatgttccattagttcactaaatcgtaacaaaagtaaatgtacttgtttgaacattgtacaaactagtcctaaaagggttctcacgtattttatatgcgcagtctttagggaggcaaaaatgttttatgcaatctatacaagaaagttatattttcagctgttatccaaaacaaaggaagcgtactctgtgaaaaattggtattattgtttaacaatatccatttccagaggaatgcttttcttaagtagaagttggctgacacaaccataagggatgctgtgaagtgatttctgtcatttttcatacatggaaacatatgaactcaagggtctactaactcttctacaactttaaaggagcacttatcctgggatactttcaaacctgagattctgagattctatatttttaatgttcaacccttagtttcctcatttctaatattcattactaagtagacgataaagatcaagttaagcatagcttcagaaaaactaataaaataatttaaattggttatgcatctcttgtgacgattctaaggcaaaaggcacttttatagaagtctttcacactttaagaaagcttgctatatagaaaatgattcagttgggcacagtggctcacgcctgtaatcccagcactttgggaggctgaggcgggtggatcacctgagttcaggagttcgagaccagcctggccaacatggcaaaaccccatctctactaaaaatacaaaagaattagccagatgtggtggcgcgtgcctgcggtcccagccactcgggaggttgaggcaggagaataatttaaacctgggaggtggaggttgcagtgagctgagatcacaccattgcactccagcctgggcaacagagcaaaagtctatctcagaaaaaaaaggaaggaaggaaggaaggaaggaaggaaggaaggaaggaaggaaggaaggaaggaaggaaggaaggttctcctttcctctctaatgtctctccattcccatttaaagtctctgttgatctgcagcataattttacttttttctccactatttgtccaatactgcaaatgcactgtagttgaagagaatctgttgttgtaatggaaaacagaatcaatctctttttatactctgagcctatagcatgtagtatatatgtcctcatttggcactttttaattttcattacagagatcttctctgaagtcatatcaaggtgacactgaaaggatttgatagaaaggaaacaatttgtggcaaaacagagagagaaaaatactacctgtgatacaacctatcggcagagtcacaagtcagtccacagaaaccagaaaacagacgtccccttggctgctttccttctgatagacttatctaaagctctcactagcaagcatgctccttccaaagccatagcctttcatcctcagagttcatctttggcttttcctcattatcagtgtccctatcaagatagccatgcatagcacagttatttagaaggcacaattaattgacttgtatgctgtctccttgtaagcttcagcttggtctgtgttgaaacttgtcagcttttcccccaattcatgttgtttcaacctgcagttttattacctcctttggatgccaaattctcctttctccttgcactctccaaagccatgtattttgatgaactggctctctctgacatcacctcaaaccaacttaataaatcacccctagtcttctaccaaagcacatttccttaaatgagttttctcattttgccgcacaacctgaatatggtcggaagaaacacttctttgaagtccatcccctcctcaatctgctctcctcttcatctctaggggatccttaggtatgagtttcagagtttctctaaagcagcttctgggtttccctttattacaacactctatccccagagtaaccatctgggacctttatctattcttccaaaatgggtactgtctgcccaatgaacagctgtgctctttccaaacaagagggtatttaaaacccaactgcaagtcctacatggggtacaggggattgttgccagccacatatcattttggaactatttttgccttctttctttttaaatcatataggcctattaatattcaaggagttattctcaaaaggtggttaaatgcatagaaaaactaaaattagaagagctttgcattttaaagacagctttctgtttttgtatggccaatggtatctcccttttgcttccttttctctgtggatgtctttgtttgtgaagttattttttaaccataataaaaagcttaaaggccaaaatacataaagagaaatacttcttatactcaagaggttatcgagataccagagattttaaaatgagttcgtaacattgattcctaagctccaggcatttccttgaagaatttccagaagacttcaaataaatttttcttgccaatgttcattttcagatgtgtttaacaccaagttttctggtgtgaatatgcatatatgactctaaaaatctctacattcagaaactaaaactatactaaaagaaaaataggtcattttttatttccttcataatatgacaggcaatacagtagttaggaaaactaaagctctatatctagtcattactggattttagtgtctctcagcctcagtttcctgactaatcagtgagggtgggctcaggggtcgaagtctattcactgaagcttttaggtcttaacattattggattcaatcacatacttcttttttttgagacagagtctcacactgttgcctggtctggagtgcagtggcgtgatctcggctcactgcaacctctggctcactgcaacctccgcctcctgggtcaagtgattctcctgcctcagcctcccgagtagctgggattacaggcaccctctatcatgcccagctaattttttgtatttctagtagagatggggtttcactatgttggccaggctggtctcaaactcctgacctcataagccacccgcctcggcctcccaaagtgctgggattacaggcatgagccatcgtgctcagcctcaatcacatacttctaagctgatgtgattgtttctgtttttgtggagttacaaccagttgcaaatttagagagaccacattccccataagactgcatatgcttctgacaccaattgcaagttcagaagttccccaaaccacccccaggtttgatagttctgtagaaggactcacagaattcactgaattctgctgccgaaggctgctatactcatgctgcattatgggtgaagaatgcacgtgaaaatcagacaggggtagaagcacagatggcagagtccaggaacagtaccagatgctgagtttacagtcaacctctctatatagattcaggagcacatttctttcctggaacgggtgtgtaacaatttgcatggggtattgccaatgagggaagcttcctgagcctccatgttcagagtctttactgagactccgttatataggaatgattgattgcccacatggctgacctcagtttccagcccctcagaaggctggagaatataagccaaagccccacacccttcatcacattgttggtcaatctggcatggtaaggccccatcttttttctttttctttttttttttttttttgagacagagtttcgctcttgttgcccaggctggagtgtgcaatggcaccatctcggctcaccacaacctccacctcccaggttcatgtgattctcttgcctcagcctcccaagtagccagattacaggcatctgccaccacgcccagctaattttgtatttttaatagggatggcatttctccatgttggtcaggctggtctcgaactcctgacctcaggtgatccacccgcctcagcatcccaaagtgctgggattacaggcatgagccaccacacccagcccaggccccatcttaaatgccatctggtgtggccctacccctaaaacacaatgttagactatctggaataacccaaggctcccaggcaaatgaagacatgcttaccaggcaggacatcccaagggcttagatattaccttcccaaagccaaaggcaagggccagacctcttgagggcaaggctaaattctctattacacagttctgaaaatctctctgttgaggacaagaaagcaaagattcctaggacttactactagaaggaaacctgaaactcctaatgtttcttaaagtaagattccaggaccacttgcgtcagaatcacctggcattaacaaaatgcagactccaaagccccaccccaaacctactgaatcagattctctgtaacagaagcattggaatatgcattttaagcattttcctttagcagttttttatgtaggccaaaacttgagaattgtaattaagatccaaggtccctgttcctacaagtagagtgaaactagcatgcaataaagcaaagggagaaaattctgcttcttattccactggtgagtttatcttgggcaagccattagtcctcaaacatcatatgtttgaaaataacgtttagctacatttgttttaaacagacataactaatgtagcatgctcttagactgagaaaatattcattgagttactttgtgctcttgggaaagatgcttgtggaatacaagatggaactccatctagttcggctggccttgggaaaatgagtggatttctcttttcagagtatccatgtgatcactgttgccttcctaggcaggagtagtttctattcatcctttcattcattcacaaattggtatctactgtgtggcaggcaatgttctcagtgctgaggagagaacaatgaacaaaacagaaaatgcctctgccttcctgaggccaggaccacatatatattattccagatagtgatacatgctatgcagactttttaaaaatcaggattaaaggggaaaggacagctgagagcgaagtttgttatttaacatagaatgtttagggatggagtttctaatatgatgacttgtgagcagagaagtaaacgctcagccacagagttatttgggtaaagtgaacagcaagttctaaggccctggggcaggagcagtttcaaatgttgtgaaggagaaagtcctatgtggtggaattagaggaagactaagaggagtggaaatagatatggggagtacagacatctctttcaaggaatttggaaacaaaagggtgcatagaaatgaaatggtaacttttgggatagataaggtcaaaagaaaggttttatagtgccagtggttgttaagagtagagatatgtctctgtgtgtgtgtgtgtgtgtgtgtgtgtgtgtgtgtgtgtgtttgtataacaacccagttgtagagggaggggagaattgtcagagtggtgtccttgagctggtaggaaggatggcatcccgtgtataggtgcagcagttggccttgaattaggaacatagatgaactctttacttctttctccttatctctctgattcccatggcgaccttattttcagccttcctgcctcttctcatgaccctttcgtgttaaataaatccttttatcttctgatgtacagttagtacttcattcagaaaaaaaatacaggaaacaaaaaaagatattgataacactgttcaccatagagtgaggctgaaatatctgttctaccaattaccagttttgttgtatgactcaaatgagatttattgtacagaagatcccccaggaagctgccacccctcgaaccttattttagaatggaaaaaacgtatcattaccaaaactaaacagtgttagctggtctgcccatcatgctcatgctatataactttccttctcttttctcttatcctgttctgtactgaatggccaaattttttctgctacttcaactgaaactgtggtctaatatctaaatgctccctcacctgctgagaaaacttagagccaaaaacacctggtattggtcagttgttaaatttatcgctcaatatactaagcttggagtgatttgttgagttagaatgagagcaaatagtgccacctgctggaattacacttggaaggggaagcgtgaacatgccaagagctctccatggttttgtcccaatcattactttaagcctttcagatgaagtcatgagcctgctttattagaaagtaatttcttccacctatattcttttctgatggcaatatgccaccttatgtatttctcttttagtatttctcttttctccctgtaatgattcagtatctaaaattaccattaagaccagctgtatttcattttatttctcttagaatctcttgaaaaattatagaatgttgccatttgaaagaaccttagaggttctccgtagtttcaaacacattttggacacaggaacttttgggaaactatggatataatcctcactttggacctcaaactgaggcctgaagcgtgaaaagtgaaaagaccaaacagctgaggctctatatcagttaagatgctttcagttacaataaaaatggcttgagcaataacataacagcatatctcacataagaaatcctaaggtagatggctctgggattaatttaaaagttgagtagaccaggtgtggtggctcatgcctgtaatcctagcacactgggagtctgagatgggtggatagcttgagcccacgatttcgagatgagcctgggcaacatggcaaaaccccatctctacaaaaaatacaaaaattatctaggtgtggtggtgtactcctgtagtctcagctacttgagaggctgaggtgggagaatcatctgagcccaggaggtcaaggctgcagtcagctatgatcacactgccacactgcagcctgggtgacagaacaagaccctgtctcaaaaaatacaaataaagaatttttaaaagttgaacaatgtcagccatgacccaggctcatcctctgtcctctctgtcctctgtatctctgacatttgtgaggcagctccagcaacattaagaaccacagcttcccacccaatattaaggggcagaaaagggactgtcttttccttataactcaccaaaagactccactcatgtttcattggctagaagggaattatgtgtctcatccaaagtgggtagctggcaaggagcctggaattgccatctttgccttcattaaatccagatccatcctgtgggccttgggtagggctgtccttatgcaaagtgcaagactctggaaacacagagattccagggcaaaatccggttagctcacaaagaaaaaagggaaagtgactaattattgggagaaaaatctccatgggtctcttccacttttgcctgccttctgagcaagaagcattgacagctttgtttataccttttttaaggatgtgtgtatagctaacagccttggaagatacagatagtgtcttcctctgggacagagggtagatttatttcatggccagagtaagaaatataatgtcactctccggggcagaaattgagcaagtttgctagtagctactgtaaaaagattggggtttcctaagtccagggtccctcagctgtgaagcaaacttattgcatgtgcagcatccacctgggatgccctgcattcccctgcaagggaaagcaatgtgaacgggaagctcaggctgcctgctgtgttgtgagtaaagaagtcctttgtctctgacccaggagtttcatgtcttctgccagcatcatcagactgtggccatgttaaactatggttctgccagcatcatcaaaccatggctaacttgttagcctgcaagtggggtaaagtctcagacccttcccagttcttgatactcatggaaaggcaaccattcatgtttggcacagtgttctttccaatgagccaggctatatgcatccaattctcaaatacttatttctggaaatgagaatttgttcggtatataagaaattcctttttcacaggcagaaacagggcaacacttcagtctccaactggagacacacattaagcgaggacagtgtcattggctcaagtgtcttttatgctgtctcccttttattcgctcactctctctataattatctcttttaaaatgtcagttgctctcacccagaagaccaagagcaatcagccacaaactgaacttagaagcttttaaaacacactggctgtctgactgggggatgggatttctcaaaggcttcccgcagcaatgtcagggaagctgacattgagtggctgagaaaaaagagccctttccttggctctcacagtgggtctttcagatccttcctgaggaagcaacggaaggggtgtggaatgtgctgacttcataaatatttctccagcagagcctgaatggaggctgtttgggaagaaagttgctcgtggggtcctttggccttgagtccctcttactgtatcccattagggtgagaggctctgagctacggcatcgtcctggcaactttcttcccttctccagaataaaatattgatgttaaggtgacggtgaagaaataggggatctattgggacaagcaaaaagtatagatattttctagcgacttctggcactcagagtttttccaagtagtgacagtttgaagacctggacacgaattcatcatagcagtaggagaatcacagaggaaattagaacagcatttatccctacgagtcaaaccttagggttaaactcaatttatccctaaattctatttccttgatggcagttgatgcctttaaaatgaaacaatctttcctacttagcccaggaaccctcgttctcttgctgttctgacaacttacatttaaaaaatgctcctgctaaaatacagtgttatgagaacagaacagatttaatctgaaaccaaggctactttttcctcatctgctgtatcagaactacagagaaagatcacacagcctgtgggtcatattatcatcttcctgcattctgatcatacttccatggaaaccttgatggaggtcactggcctgcaagttcaatccagtcccaatgacccctggaggcaggggcttctaatttagatgagatatttttctgaagtgtgtgtccaatgaccacaggtgttgaaatgaaagttctctcgctaacgacatgaaggatcaaaattccttggtacaattaggttgattaaattgagctctgtgtctaatatccctgtagctcaataaagttaatgcagctttccaaggggcccaacacagaggcagggaacagtctaggtcctgagagaatctggcccaccatggtttctaaattagaagtttgattgcttgtgacatcgtcttaaaatggtaccagccaaaagaagctgaattttccattagcccaggaaaaaaaaatgacagatatttaattaaactgcttagagattaggtggaaagcttattgatggacagaggggctgaatatctttataagcaaagttaggcactggtgtgccacatctttaatgttgagaagaattcacccagcctaagggagctgaagacgtgtgtgctgcttcagcctgaggctgcctctcctgtcaatcacaagaaaaaatatacatttaaaaagcttgtttataaagcactaggtggtcactgaggaacttaacataaaatataaaatgtgaaattagaaagctacttatagctaaagttaataaagcaaccacccaatccatttgccaattgttgagaggtgactaattgcagaggaaggttgatttggaggtgatctctaaaaaaaagaatttgtggtcagtgctagagggtaggttatgagaaggagcctacaacccagatggggaataaccaaggtttgcaacagacgatgtacgacagggattattctccagaaatgttgtgctacctttcaggtaggcacaggtggtcataaaatgtaggtcaccctcattacaccaacaataggtcaccctcattacaccaacaataggttaccctcattacaccaacaataggtcaccgtcattacaccaacaataggttaccctcattacaccaacaattcaagggtccccaactttcaaaagagtataaagatcaatgaaatcaagtttcataaattcccccaaagcagtagctctcaactctagctatgtgttaacatttcctggggagtttttttaaaataccagtgccaactcttgaccaactgagtccaaatctctggacacaggtgtttcaagagatctccaggtgactatgaatcacttcccaaggagctacttactgaaaaggtaaattgtatgtggaattagaagatatcaggctctgaaatctgacaaaccttggttcagttcgtgactccactaacttactgaatctaagacactcaacatgcgctaacttctccagacttcagtctccttatctggagagggtcaatgatggtcacatcttggaaggcttctaaaattaaataaggaaataaatatatacctgacacatagaccccccaaaacacccttggttattaatggttaatgattgacattttatccttcttccattgattttgccatcgacctttgtaggacgtgacaggcttagatgatttttcctctccctgctttgtttgtcgtctagaatttactgctatttggtatctgggagaaaaatactcatgtttttcatgctttctgctcctccagctgccacagaagtgtccttttcatttgatgtgggaaatgggccagtagagattgtagtgaggtcaccaacccctctcaacgatgaccagtggcaccgggtcactgcagagaggaatgtcaagcaggccagcctacaggtggaccggctaccgcagcagatccgcaaggccccaacagaaggccacacccgcctggagctctacagccagttatttgtgggtaagtaatggaaaggtaaccatggcttccctctgttgatttttaagagcctgcacaatacaaaaaaaaaaaaaaatcagcctatgcaaggtttgatatagagatccttccaaaagtaaaggtgttggcctcttgtagtctccttcaagacagaatggaataaggaagaagtttcaggagacctagatctcgttccacttccactcttgggagctcactgtcctcagctataaaatcagagtgcaggctgagacatctctcaggtctctctaatatctgcaattttaggtttatggttttagaagtgtataaagttatttgatcatttggggcacttgtaactgtgtggaaggaaaggaaggaaggaaggaaggaagggagagagggagggagggagggaggaaatgggctaagttcagatttttttgaaatgataaatataaagccattcctttcttgcctattctcaaggttctaggcagagaaagatttagacttttcctgacataggaaaaaagatcagtacaaaaaagaaatttaaacagatcaaaaagttaaactacctatgcaagaagtggatccagacacccagtctaatctttttcacctgtctttctgctactgacatatttcagatgaacctaaaattacttcaaattcatacctgcttcccatggctagttgaattttaaattttgtttttgagaatattcatatgttaggaaattagcaacttttcctctgttgaatgaaataaagaagtgagtttgaaggactttgtggatgcatcatcttagacccctctctagggggtcaattgatcagtgcagtcaactgtggaagtctcagacaaagcaagataagaatgtgacttggttgctgttcatattcataacacctgccacttgggctccaccctacgttacagcctcactgagagccagttaattttaacaaggggcagagtccccacagtgtctttcatagttgtgttgggaagcttgaagagcggtagaatgtcattaaaggaaaggtaaaattagatctccattcattttgtgtgatgtcggccaactacaaaacaaaggtgtgggtcaatgagctttgaaagtgagactgacttttaacaaccacatcagctggggctataaaagagttatagatttagaaataaagtatttcctaattacaactggaaatcagccctttccaaatccttccctcaagttatagatcacaaaattacacattattttttaattagctaaatatcaggtccattgatccctgctgagcacagtgaagaaatttcacttcatcaacatgtgtggcccagattagctaggacaagtttcttcctaaatactgttaattctgaacatgctgggtagattctatctggttttcatcataacaggtgaccctacttgactcaacttctcgtttttttgaccctgcccctggatatagaagtccaactttagttttgttcctttctgttggctaactgtggctgtgtgtaagaattttgaagacctagtaaggttgtaaaatgaagagatggaagagtatttattatggtcttggaaggaacatcaattcacttaaagaaggtgacccaataataacttaagaaaagagcaagggcctgagatcagaattctacagaaccatggaatataagggataaacagaaaaagaatatctcaggaagaatgaagaggaatagaaataaggaaaattaggagagagtaatgtcacaagaggaggaggatttgattaaaaaggtaatggcaaataatatcaagcaccatgagtaaaataaggctagaaatgtgcgtgtgtgtgtgttttgagatggagtctcatcctgtggccaggctggagtgcaatggtgtgttctcaactcacgactcactgcaacctccacctcctgggttcaggtgattctcctgcctcagcctcctgagcagctgggactacaggtgcatgccagtatgcccagcaaatttttgtatttttagtagagaaggggtttcaccatgttggccaggctggtctcaaactcctgacctcaggtgatccacccacctcagcctcccaaaatgctgggattacaggcatgagccaccactcctggcctgtgttgttttaatttagcaattgtaaaaccattgatgaccgcagaaacagaaatttcagaacaggaggctgacgtgatgagtcagcaatttcttttgactagaaaatagtctctagtcccagtttctaattcctgtcaccttaaagggaggcacaaggcacatctctcagatatgagctactttagccaatttgtgaaatattgttcggcaatagaagtctacctcaggtgaagtgagaggggttgttacaaaaaaaaaaaaaaaaaaaaaaaaaaaaggacggccacggtggctcacgcctataatcccagcaatttgggaggccgaggcaggcggatcatgagttcaggagttcaagaccatcctggccaacatagtgaaaccctgtctctatttaaaaatacaaaaattagggctgggcgcagtggctcacgcccgtaatcccagcactttgggaggctgaggcaggcggatcacgaggtcaggagatcctgaccatcctggctaacacggtgaaaccccatctctactaaaaatacaaaaaattagccaggcatggtggtgggtgcctgtagtcccagctactcaggaggctgaggcaggagaatggtgtgaacccgggaggcagagcttgcagtgagccgagatcgcgccactgtactccagcgtgggagatagagtgagactctgtctcagaaaaaaaaaacaagactctaaaactaacacctagttcaacagctatgaatttctggagccacttatctccaaactattcagttagaatttagggacttaggtgttagtctcagttcacctctaatataaaagcattttcttgaccaactattaccatcttccctctctgagtatcttctatttctatgttttgtttgtttgtttgtttgttttacatggagtcttgttctgttgcccaggctggagtacagtggcatgatcgtggcttactgcagcctcaacctcccaggctcaagggatcctcccacctcagtccccaagtcgctgggactataggctcatgccaccatgcctggcatgaggtctccctatgttgcccaggctgatctcaaactcctgggatcaagtgatccttccacctcagcctcccaaagggccggaattacaggcatgagccaccatgcctggcctcttccaatattagacattttttattacatgcttggtaatgattgaacaataccagggttgccaagtggtcagtcttctcacaatggtgtgtggttaacaatatggtctttgactaccacctctgcctcttgccaattgagaaaccactgacaaattgcttaatatttctgtgttaattaggaatacagctcctacaccacagtattaaatgagatattccatgctaagcactcaggagagtgcctcgcctagggcccataattattatcattattattaataatagtagtagtagtagtatttgagacagggtctttctctgtcatccaggctggagtaaagtggcgtgatctcagctcactgcaacctctgcctcccaggttcaagtgattctcctctctcggcctcctgtgtagctgggattacaggcatgtgccaccgtgactggctaattttgtacagaaagggtttcaccatgttggccaggctggtctcagacccctgacctcaagtgatctgcccgcctcagcctctcaaagtgctgggattacaggcatgagccactatgcccagcaggtccattctcattaaatgtgagtttctttttcctttactatcctttaccttttattccctttattttcttcttcctccatgtaatagttacccttctcttaaagaagcctctttcaatgggctcattacttctttcttgaaatattgacttgaaatgtgatcacttccactcaccaaccctacaggaaagctcacatgcagagatgtccctcaatattcagaattattctgctagtcctcagcttacctgcagaggccacagagcagcaaactaaggcccaaggattttttcacagtcagccaagaaatcagaagttcatctgaaaacatcacaccagcatccctgcaacagctaagatatgtgacagaatggcccaagagctccacctaggttccggaaggaagggctttcatacaaattaaagctgaaacagactgcaaatagttcttggctttgcacacagagctctacagaaggccaccttccacccactaacctgtgttaatgtaattgcctgaagggtttttcttgcccgctacacaggtaaaccaaattcactgagacaatgttattgcagtaaataaagcgtttaattaacacaaggacagccaagcagaaggactggagttattactcaaatcagcctctctgaggactcagaggctagggtttttaaggacaatttggtgggcagggggctagggaatgggtgttgctgattggttggagatggaatcataggggtgtggaaaattgtcctcatgtgctgagtctgcctcagggtgacagccacagaactggttgagttctgcgtcccaagtctggatggaggcaggtggtttccagaatgcaaaaatctgaaaaaaaaatctcaaaagaccaatcttaagttctacaatagtgatgttatctataaaagcaactgaggaagccacaaatcttgtgacctccggccacatgactcctgagcattaagggattctagaaactacacctacattttaacagagttcaggcctctcccataattctaatctcatggcctttcattggttttacaaaggcagtttcaatcttccagccaggagggaaccagttttaaggagggacaattatcatccttgctttaaagctaaactctagctgggcacggcggctcacgcctgtaatcccagcactttgggaggccgagatggggggatcacgaagtcaggagatcgagaccatcctggctagcacggtgaaaccccgtctctactaaaaatacaaaaaaattagccaggtgtagtggcaggcgcctgtagtcccagctactcgggaggctgaggcagaagaatggcatgaacccgggaggcggagcttgcagtgagccgagatcgcgccactgcactccagcctgggtgactgagcaagactccgtctcaaaaaaaaaaaaaaaaaaaaaaaaaaagctaaactctaaaccaaatacctcccatggttagtttagcctgacctatgcccaggaaggagcagggacagccaggctgtgaggctagaagcaggacggagtcagccatgctagacttttcttgctgtgtgatctttgcaaaggtggtgtcattagcgaggccaggctcacatgtccttttgcaaagtaaccgaaaaaaaaaaaaacagagaagacacagttcacctcactgcacatctaaaatataattagaagctgtcatcccaaaagggttaacacaggtcttttggaagttgtaagaatccagagattattctggtttaatcaaaaagtaacaaatacatttaaaaactaagagacacagaaagaaaaaaagcacttgctggtatttgtctgaaaagtgcaggaaacttttcccattttttgatccaaaatgagtgtccagcatatgacgagctccctggatggcccagcagaagcacttaagccacatgttgatctgaagcctcagccagcccaggtgttcggacctgggctgtccgtgggccagatttttcttaggcggtggagaaagcaaacaagctcatggtcattgtctaagcatgaacaatgccaggctggattgagcaaagccagctttggcagagacatacaaggagtttggagccctgacagctgatagcagcggcaggagtgggagaaggcaagatatctgctgggcccccagcctgggaggctggctgccagcccagggcatggccaggagctggcaagcaaacaccactgcggggagccaagcaggctgttcaggtcagggagctaggacagggttagcatgcagcaagctagacactagccagagcatgcaactgctcttggcagtcattaagggaggagatcagagttacaagatctggaggccatttcagacagcttcaggaagaagtcaagctcctaagtggctccttgacagaggctaggtcatcttaactcatgacaaatgtccgtgctcaatttacttggctctggcctcttctgatatctctctagaggttaaagggaaccatctcttttgtgcagtccaaaaaggagttgaaaaatcaccctcagtgcttcaagctcttttgcgttgggcagaaagcctgactgagactcagtggaaggcacgctgtcttcaggaggactcagagactacctgagagtggggaagcccgcagcctcttcttcctctgacagtttgtctatcaggagacttttttctcctgggtggcaacctgagtttatggaagagttgaggtttattaaatggacgtataagcaactacagactgaaatgttataaccattctctgagtccaacctccccaaattctaaaatacagcttgtttggtcagctgcttctcatactctctgtattccaaaattgcaaatggatcattccagtgccatctgaaatgcagtatcattgagagaccaaagagaaaatcgcatttgtgtgtgaaggagaaaaatagaattctaataatgaaattcacccaaatctatgtatgaataaaatggctgtttctcatatctaagaaattgataataaaagatgtacaactcaggccgggcatggtggctcacgcctgtaatttcagcactttggaatgctaaggcgggcagatcatctgaggtcaggagttcgagaccagtctgaccaacatggtgaatttctgtctttactaaagatacaaaaattactcaggcatgctggtgggtgcctgtaatcccagctacttgggaagctgaggcaggagaatagcttgaacccagtgggcagaggtcacagtgagccaagattgtgccactacactccagcctgggtgacagagtgagaccacatctcaaaaaaaaaaaaaatgtacatctcaaattgcaggaattataacctagagaatgtgtgcctgcccctgtttcctgcaaacctgcctcaaaagcaaccacgtgaatgctgactgagacaccccggtgaaccccagggccaagtgcttcccatgcttcccctcaatgagtccacacgagtctataacatagataacattgctaattcttgttttattctcacattaaagattagttgacttaccgaaggtcgtgcatttaggaagagacagagatgggatttggttccagacagtctgactccaaagactcagcgctttaatcattcctcttgtcaaagcaaaaattgcactgggcaaagttgaacaggcaaggaagatcttcattcagggctgttgcgacagggtagagaagccagaatgcagtcgagctcgcctccacttcagctaagggcaggagaattttgtttctttattttgattttttggttttttttatttcactaaaatacaatgggaaagtttttacaagctgggataggagggatcatagggtgtctgtgtttgctgattggctctacccaaaggaaaagtaaactttcacaacttggagttaggctcccaccctcccgtggaggggagacagggtgctattttccttgacaattaccatttcaaagagatgactcccaagtttttgaaaaagccattcctgggttgtaaaactggcaaacagctttttaaaaaatttatatctcaaaagggcagagaaagaattaacaataacaaattttctaaagtaagtgctcttaaaaagtgaggtcaggggtctagggtggaatggaggggtcctatgtaaagtttagtcaagctgaaggcaaagttcaggccctcttggtcagtctataccagcgtcccctgactgagatgaccctgtggcccagagggtatgtggaaaggtgcggtgacactgggtgctcccacagcttcccacaacgtgcaggagaatccatcccaaggaagatttgcaggccccacgtgcaataccggccccttgtggagcactctcccagttatggagtctatgggagagactgaagttgacaggcagtggtgaggctggacatcaggcagccctggctggtattatgcagattataaagtcgccatggcaaagatctaggcctgcagagggccactgtcaaacgcaaagggtttggtttaacgagaagttaatgcaaaagcactcttctcagggaatgagacttcttacttgacagtctctatgacatggaaataatgttttgtttttgttttgttttgttttgagttcctttggtaaagcttttataaagtcgtcaaagtcagcatggatctctaagtctcagacacattcttcggggctttgcagactctctcagcagcatgtctcctgcgctctttcctgaaatactttcttcccacagattccacagccgtgtgctgtcctgcttatttttcctaccaagctggccatcacttagtctctcctgcattccctccttcctccgcttgaccactaagcattgcagtgtcacagagccttcctgtcttctcatccgaatattgtcttggatgatctcattcagcccaccatccaatggcttctgataataatttgtgccaatgtctctcaaatttaaatctccaggcctctcttctctcaggaactctagatccacttatcctactttctactttgtgtttcaacttagatattaaatgggcatcttagaataaacatgatgggaaacaactcttgatgcctcctggaaatttgttcctccaaaagccctccccatctcagtaggtggcatcaccatctaatccacccatccaccctaaatttggagttacccttgatttccttcttccctttctttcttctctttccctcatcacttcctatccaatagtaagccctgtgagtctacctccagactgtccctcaaatgcagctgaggcaggagaatagggtctggaggcagggaagataggcagattcatgctgacttcttggaactaaatcaaatgggaacgcttcagcaatgacaggaaggtgaacggctgtgtagcttcacttcatcctctccatttacttatgccacacactgagtaacatccttgccatttacatagggtgcatactgagtaaatgactttgtcacttgacttcgtcttcttcatttacatagggcatataccaagtaaccaatgggaaacctctagagggtgttgaaaccccagaaaattattattattcagaaataaatgaatacgtttatttatgtgtcctccccctagaacgtaagctacatacagcatagacggaggatagggtccaataacaactggtcaatggttacccaataaatatttgctgagcaaacatctggatgaataaataagtgattgtgatttttctgggttaatatccatattcaaaattagatcatctcctttccaaagcaagaagggtttttccttataaactttctccagaattcttttctcaaaatgtgatgatatttaccatcttgggaaatatctttttactgggaaccacagactgaaatcaagcatgacagaagcagaagcagcaaaaaaaaaaaaaaagtcacagagaaagtcagcatattatggaagacagcatttcaaatcagtctagagcctgagcatagttttcagtcttcctgatatcaaattggggtcttgcctgtttggcggtagctgtgatgctggctgcaatcctaatgcagagtttctaccccaacctttgtaactagttcttggttctctctgggatagaaatagggagtgatgtcgtaattagaaaccattgccatacattaaagagtaaattaatttgctggacaaaatctagcaaaaaaaattactacattgaaatcaatcgaccatatgcaaagcaaaaatgcaaataaaatatagaagctcctccaagaaatgccttctccttcacagttgttcactacaagggttaccagccctctattcttttctgaacctgctgggccaccacgctcagtcggctgctatcttctcaatagaaccatctccacctacgacccccacaaagggcaaaggatagccccttcccacttacagttgccatgtatgttttctgccctttgccctttagggatcaaaactaattgacttttgcaattccagctacctttcagtcagagcattaccataggaagtgagtgatgataggtacaatgtttgcgctttttttttttttttttttgagacagagtctccctctgttaccaggctgaagtgcagtggcacaatctcggctcactgcaacctccgcctcccgggttcaagcaattctcctgccttggcctcccaggtagctgggactacaggcacacgtcaccacacccagctaatttttgtatttttagtagagataggatttcaccatgttggccaggatggcctcgatctctcgagctcatgatccgctggcctcagcttcccaaggtgctaggattagaggcatgagccaccaagcctggacaatttttgctttttttaaaatgtgctcccaaataatcaaatcaacagtgtacttttaatgtcttttgagctcccaactaactaaaagataatctgttaactatattatatgggtagaaactttacggtgaacattctgaacctaagaaactaaaggttcaccttctcatgtgtcacaagaccaaatgcttcaggaactctggtctttcttccaacatcctcatggcaattggaatggtctgatgcagagaagacattttaatgtaacggtaccacttttgcaatcaatatggaaaaatgtttttcaacaaataaataatttcttatacagattttttatctttccgataaggactgaactaaacttcatgataataaatggcaactgtcccacagaaaaagattgtaataaaataaattagtatcaatgacacaaatattgaagaagggatagatcctcgcagccccatagttcctcccacagtacactatgagcgtgagaaaaaagaggcccacttttagtattccgcattcagataaacagggtcgtttcccatcagacgcttccctctcatgtttttatctcacagtttggtttctgctccttcgtgttttcaaggccccctgatgtgcaggatattgcgtgggtctctcttcctttcatggtcctattgtcacatcctgacaatgttcctctttcattttaatttcattttattacgttttttcttcaccattgccagcttcaccctctcgccatcgccgacacccactgaaacgtattttatggatggtcttctagtcccaccctctatatatttgttcaaagtatacatatcattgtggaaattcgtgttgtctcttgtgtgccatgctttatatgggtggcattgtactacagatcccattctgtttcttactctcttccctctgccttacattgttaagatctatttgagtagttctctgaatactatgtgcatagtgctccattatgtgtatttaccacgcatcatttattctatcccctaatgatgaatacctaggttttctgcaactctgccaccacgaataaccctccagggaatatatttatgtgcattctctgccacctgtgtgaggacgtcttgtgtgtgtgtgtgcctctgtgtgtccccagaattactgagtcatagagtatgtgtgtacctaatttcactaagcactgcttgacctatcagtttctgagtataaattttaaactttatttactgaatttctatcaatagttctatcagtggtagcttcgggtaattgaagtctattttgctagttagatgtgttcatgatcttcttgatttattgttccttgtaccagtatataatttccatctttgttccttatgacatttttttttaaatctcacagttttgtctctgctcttaaaactaccacactgctgggcgcggtggctcacgcctgtaatcccagcactttggaaggctgaggtaggcaaatctcttgtgcccaggagttcaggaccagcccgggcaacatggtgaaaccccatctctaccaaaaaatacaaaaattggctggatgtggtggcacacacctgtaatatcagctacttgggaagctgaggtgagaggatcgcctgagcccaggaggtctaggctgcagtgagccgtaattgtgtcactgcattccagcctgggtaacagagtaagaccctgtctcaaaagaaagagaaaatgactacactagccaggcataatgatgtgcgcctatagtctcagctaccctggagctgaggcagaaggatggcttgaacccaggaggtcatagctgcagtgagccgtgatcacactactgtactacagcctggggacagagcgagaccctaactctaaaaaaaaaaaaaagaaaaaagataataaatgaacaaactactatgctagccttcttgttgttgctaatattcctgttataacctggtattttttgtacaggtgtttgtatccttttgtttaaatgttcctcttagatttcatattgctgaaccttttaaaaatccatttggaccaattactcctataattttgacttggcagtgaaaataaagatgcaatattttttccatctatgttctcaagacttgtgactcctgtacatggatcggaaggatccctggggctgggggtctctggttcagatccacagctattgatgaaggtgttgttttttggttttggtggtggttgttgttgtttttcttacctaccctgtttaaacacttcatgagtgccttccatttgaactctaatattgtttgttctggaaataccagatatttcttcagatagtttcttgcctgtgtttattcttttcttatgaagctactattgtgcagatgttgacacttctaccctccgtaattcttgacttttgttttattcttctaatctctttattcattcctattgtcttcatggaaggtttcttgacccaatatcccaacccacgaaaatgttcatcagctttatccgttctgccattcagcccctccaaggatatctttattttgacagttatagatttttcacttcaatatctccaactaattcttattcttatagtttgtcattgtcctgtgtctccaatatcaggaaggtgggattctgctaattttgctgccgcttcatgtcggcaccataacgcaggtgtcttttatgcaaatcctacagttttctgctgtcattggttctgtgtcttcagcgctgcttcttgcccttatttcgcagtgcttgctgtcctcagaggtcctgtcatttcgccttctgagttcaagcatattcccttgagatttccaaatgccacctttgttattgtcttcctacaatgaaaaacaaaagttcagggcctgcattgagctcctcctggaaagttgagggggcaaagaaaaactcctgcctcaggacaaacctctggcattgtcatccctctcaaccctttcttgtttccagtccatgtccctcacccacctcccatacacacacacaacttcagagtacctcactcccacctagacaggggacagccatcttccactgtcattgattcttaaaccagtggtgtatctataccactaaatctagcctctcactacccgttcctccactaataagcatcttattgctatattgaagtgtctgtctcaaaaataaccaaatccaatagcctgttactgttgtctgattttccttgacttcttgctcttatttaacaattgtcactgtgccctccttgaaatcttgacatcaaaacactccagtcttctgttttctcagcctctctgccaactcgcctcccttttcccttttcctcaatccccaagcttctcttctttttcctccacccctttgcttggatggctgacatacccatgaggcttggtcatcagagctacactaatccctcacggatccatcccaggcttgacctgggactagcatccgcaaaggcttgtatgtgaagtctgagagtgaagagaacagggtgccagcttggataataacaccagggattcttgactccggatttaaaaaaagactagatacaaatgtttaaatagagactttaaaagacagatggaagcaggagagggggagggggagatacatgaagatcagcagaaagaggatgcttattttacttcaaagatgacaaaactcaccagcaggacacttaatatgaacaataacctaaagatatttgcaaaaatgtatttagacaagagttctaggctgatatatttgacatctgggtttattaaagtttactaaaatagctgttaataattttgaaatttggatccaactagaaaatatccccactttcagatgcaacttggaactgtaggtcccacagtaaagcaatggcttctgaaatcagtgctgtcagactgagcttagggaaagtatccatcatccaccattttagcagtggccaaagcccataactgccttggtttcaaaactgtagtactgagcttttgcactaagaaataaatatgatcttaatgacagcatcaaaaaagtgtcttctctttgttggcttagagattaatttggacattgacattcctggctctgtgagtattgcatttcccctttcagcttcagccatccttgtagctttagagacaatggtctgcccaggtgcaggggctcacacctgtgatcctaacacttttggaggccaaggcaggaggagcccttccatccagtagttcaagatcagcctgagcaacatagcaagaccttgtctctacaaaaaaaaatttttttaattaaccaggcatggtgacatgtgcctgtaaccccagctactcaggaggctgagacaggaggattgcttgagctcaggaggtcaaggctgcagtgaaccatgattgcgtcactgcactcggcctgagccaaagagcaaaactgtgccaaaaaaaataaataaatataagacaatgttctggcaggtggtaaatgtcttgcctcaggtattaatcactctatcagcattttgtatacctaagtacaacaatgtctagaagcatatcagacgtaggagaagaaagtgccttatatgatgtaagcccaaaaatcaaacggtggccagagcatagtaagagtgcaggcttaaaagctatccagcctgggtgtgagttctggctacttactggctatatgacagcaaatgaattaactctcttattctcagttcactcgtctgtaaaatggagataataatatctagctctgagagtaaagttctggaatagtgcctgatacttctagtatttaattaatattagcttttgaaataaccaatagtttaccatgcttatcctgccaccatagcctctacaatgaatcagaccacttagctccacccccattgcataacatttcacatttggacacataggagtgctttatactatggaaacccagtgtcccttcagtctctattttgaagctttcttctagtttaatagtttggattcacatgttctgcatgtcctttactctgaggacacaagaaaatccatgcaataataatgaactgaaaaaaatccatcctattgatggagttatgaatgagcactcatgagtgtcatctgaaaaagcaattttccaaaccccagttctctcagtatgtgaaagcttttttcatacttgccctccaatatctagctgacagagaaactactgatcaatacttgtcaatcatgcagctctgcactaaagaatatggagcaatttcctttaactctctacaccactgaagactcttggccattctgctgttctcagttcaaccagataactgggtttatattttacacacctgcactgacaccacaggtattttgttttgttttgttttgtttttttgagacacagtcttgttctgttgcccaggctggagtgccgtggcacaatctcggctcactgtagcctctgcctcccaggttcaagtgattctcctgccacagcctcccaacaagctgggattacaggtgggcaccaccacacctggctaatttttgtatttttagtagaaatggggtttcaccatgttggccaggctggtctcgaactcctgacctcagtgatctgtctgcctgcctcggcctcccaaagtgctgggattgtaggcataagccaccacacccagcccaccacaggtttttttttaacgggttcaagttgatgcttcagacctaagaaacaatggtagcatatagaacaggagaaatagcaggtacagaattgcaacttgggaaggcccagcctgcccaaacacatagctgcttttgccccctgacctagccagggcagctgtggctgccatgccagagagccaaggtcagggtgggtcacctagacacagaggagtcctagctctttttcccaccagtcactcacaccattccagtggcgggctcaagacctctatgctaattcacagctctccagtccagacacagccctccacgaatgataagatagcaacgacacccatcctaactctgtgctttcttttctctctctttttttttttttttttttttttttttgagacggagtttcactctgtcacccaggctggagtgcaggggcacagtcttggctcattgcaagctccacctcctgggttcaagtcattctcctgcctcagcctcctgagtagctgggactacaggcagatgccaccacatctggctaatttttgtatttttttattttttattttttattttttttttagtacagacagggtttcaccatgttggccaggctggtctcaaactcctgacctcaggtgatccacctgcctcggtctcccaaactggtgggattacaggcatgagccaccatacctggctctaactctgtactttccatggaaacagtgcagtgagaagagggaccccaaggtcactttctcagggaggtctagatcagcccgagcctgataacccttcctcattgtcttggtctgcttgggctgccctaacagaataccatagtctggtggcttaaacaataaacattctcacagttctaaaagctggaagtccaagatcagtgtgtccgtagggttgctttcttctgaggcttctcttcttggttttcagactgctgtcttcttgccgtgtcttcacttgatcttttctctgtgcaagagcatccccagtgtctgtccctcttcttacaagaacaccagttctattggattaggtctcacctttatggcctcatttaatgttaagtacttctttaaaggtcccatcttcaaatgcagtcacattggaggttagggattcaacagacaaattttgaggggacacagttcagtccatagcactcctgatacctctagtatcagatttatatacacatcatctcagccatatttaatttattccaactatgtgcttctatagaatgtgcctatactcaataatagcaataatcgtaacagctaccagtaactagaattagtgcaaagaagtgcattatctgttattaacacactcctacgcggtgcatattgttatgccaatgccacacataaggagactgaggcccaaataggacctgggaagctcacatgccatgagcggcgaagccaacacatagaagtagatctttgtgaccacagttcatgctttcttcatccctgcttgctgcctcccatacatcaaattgtgcctggcatcatcgtgcagctatttgtgatcaccttgggattaacctgcaggcaagaagcacgtcctcatcatcattttacaaatggctttcctgacgcctttcactcatgaactgatcatgcaacagctttgctcttctgagcatcctgcaaccgctctcatctcatgcctccttcccttccaacaggcctcccctacttgcaggatggtacccccttacctttttcctgaagccctctctccatggacgagctcatgatcccctttctgtcacttcctcagtggggcctatcctaaccaccctacttgaaattgcagcctcccccaccccactccaactctggatcccagctaaccctgcttgacttttttctccatagtggctaccaccttctaacacacagtatattttattttcttattgagtttgttgttaaatttctctttctgcctgcaagaatataagctctacaagaacagagacttttgtgtgttttgcttcaatactatgaagcagacaaacaaaacatctaaaacaaggcctggctcatagtaggcgtgaaataaatattttttgaatgaataaattagattttatgtgtgtgggctttagtgtgattccttctatggtgaattagtggccagtctctttgggcaaaagtactcaggaacccaacttagctctttattaagttctgaatttgaggacagtgtttttttttttataattcctcttgatcattgtttttgccctttttgtttaatttaatagccgattattttgtcccagtcttctgtgcattttacagttgtattattcattatgggtagttccagcattttcataattaatctttaattgcaatacttgcaaagcatttcacaagaaaaaatgatttacaaattaaacccacatctcaccttggataattatcacaggtctgactaatgtgcgtgaagcccttgcatggcagggggctctctacaatgacaatgtgttgattttctaattaacaaaggttaagtagcgtttttgcttgaagacctataatttaaacttatgacgtttgtcaccaagaaagatttctacagagcgcagaagtggaactcaaataattttcactgattctagtgcattaatgtcttttacataatatataatgaccgttttcaggacagaagatttttcttcatattgactagatcaggaaaagtaccttctagctcactgtcccatttaaataaatcagggactacctaagcaagaaaagagcctaatttatttagttttcctttatagagcgagaaatggcatttcactcacctgctttataaattatgaagagggaggacaaaactttttatttatttatttatttagagacagagtttctttcttttttgcccaggctggagtgcaatggcatgatctcggctcactgcaacctctgcctcccaggttcatgccattcttctgcctcagcctcccaagcagctgggattacaggtgcatgccaccacgcctggctaattttgtattttcagtagagaagggatttcaccatgctggccaggctggtctcaaactcctgacctcagatgatctgcccgccttggcctcccaaagtgctgggattacaggagtgagcaaaactttacttaatgaacacaacaaatacaaactagactacagtcatatgttacacccagttaaaagagggagaaaaaaaaaagtcagacatcggtgcaaagaaagaaaaagcaagcaaggaagagatttaatagaatttgagagtgtttactgaaattcagaaaaaaagacacaggcccagagggagagcctgtgaaccgtgagccagagtaattcagagctggaaggagtcacagacaccatctagttcagcctcctttatctgtggatggggaaaccgacgctgagagagactatgtaatttgatgaaagccacacaactgagtagaaatagttgatgatcctgagaaggaaagatccacaaacacaagtgcaggaagagagatggatccatgtagaacctaagaagtccaaagacccaagaatcaagacagaagcagagggagaaaactccgccccactaaatcctttctgaaatgaaccctgtatatataaataattaagtatccatgaatagatctaaatatctgccttaatgatataataaaaatatgatttactctagatttatttgctctgccaattgaccctttgaaaaatatctccattctcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcagcactattcacaatagcaaagacttggaaccaagccaaatgtccaacaatgatagactggattaagaaaatgtggcacatatacaccatggaatactacgcagccataaaaaatgatgatttcctgtcctttctagggacatggatgaagctggaaaccatcattctcagcaaactgttgcaaggacgaaaaaccaaacaccgcatgttctcactcataggtgggaattgaacaatgagaacacatggacacaggaaggggaacatcacacaccggggcctgttgtggggtggggggaggggggagggatagcattaggagatatacctaatgttaaatgacaagttaatgggtgcagcacaccaacaaggcacatgtatacatatgtaactaacctgcacgttgtgcacatgtaccctaaaacttaaagtataatttaaaaaaagaaaaatatctccattcttcatcatgttaacattcagagtcttttcaaactctcaatcattgctgaagatccatgaaataccaattgtttccaaattaaaatacatcccagatagacaaaaggttaacatgtggagagaagcaaaatcacaaacatgttagaagaaaatatggttgaataatcatattattttgtattgtagaaggtctttataagcctctgaccaaaggcaggaatcacacaaataagacaggtggatgtgactacaaaaacatgcaaaactttcatcgggaaaaagaaacaccatagagaagtcaaaagacacaaactggaaagatacagctgcaataaagagttatttataaccaagagttaaagctcatattgttattaatcaataagaaatatattctcttgtattcccagcaaaaagcgaagaacacaaagaaacaaaaaataagaaaagggaaaacattaaaattactcagctcacagtatttgaggtgatgcagatttaaacagtgaatcctttttgcccccgtcgagcagactggcatgaatacaaaaaggcactgaccaatattagaattgtgtggagaagatgaaaatctcataccctactggtgaattagaagttggtaaattcttcttagaagaaaacatatttaaagtgcctttaaaatgtatatgcccttcatcctagcaattagacttaaaagtatgattaactaattttaaagaatgaattctaaggaaaaactggacgacaagtgtgcaaaggttttcataaagattatattattatagtatcatataaaatggaaaattttaaaaacttaaaagtccactggtggtgcaagagcgaaataagtgatagtgcattcacagaataggatgctatgcagatactaagcaagatgttctcgttgtacatttattgcttggaaaatgttgcaaaggctgggcacggtggctcacacctgtaatcccagcactttgggaggccaaggcaggcagatcacgaggtcaggagttcgagaccagcctggttaacatggtgaaaccccatctctactaaaaatacaaaaattagctgggtgtggtggcgtgtgcctgtagtcccagctactggggaggctgaggcaagagaattgcttgaacccgggaggcggaggttgcagtgagctgagatcatgccactgcactccagcctaaacaatagagtgaaaatccgcctcaaaaaaaaaaagtttcatgatatgttaagtgcaaaaagcaagtttcaaaacaatgtgtatattatgattccatttcttcctttttatttacacatagtatgttcatagaaaaatgaaaaaggctgttccctaaaagtgaaagtagttaaatctgagtagcgtaacagaatctgttttgtattctgcttctcagtatgtttatagtgaccacaatgactattacattgatcaccaggcagaaagagatggggagatctaaaaatgatttctacattttagcatattttgatagaatataattgtcttaattgactagtgataaaaaatttttaaggccagacatttatttaataaaatgtcttttggaaagcccttattgcaaggacaaaagccataatggctaaaataatagaagccaaattgaaattctaacacacaaggtgtaactagagggttgaagttcttccaaatcaggcaaaggccctcattctcttcagcgtagaggtgtgaagcccagttgacaaacagatggcagaatgggaaatccttcaaagtagttgtttttaataacttcttttgccatctactctctcatagctttgatcaaaaaaggcactggactctcttcacttctctattccaatatgttagaagaaatcaaatactcccaagggagtcatgattaaaaccaatgagtcacccagtgagagaactgcaaggcttgggtttgcagagatggtacagcaactcatttgccacttcactgatggggttttgcaggcataagcagatgctaattcatctctgccactaaagcctttgatattccagtcctgtctgaccaatctactggagtttatgacttttcttaagataatagagtaagtgatcagaatcaatccccagcctactgatcttacctgaattccagtaaccctactgactactccatgtttaaagacctccaaatctacatctcagaaacatgtacatctatgagacccctgactggaaagttcttctcggtattaagtggtctacacagaacagggcttaagacaataaaccctgtttgttgccttaggaataagacagatctgatacagttgccactcaggaactatgagtccttgagtaaacttcttaacttctccaagcctcagtttctccatctgtacaatgggaataatgcaaataatatctactttgataagttgttgtgaggaccaggtgagtagcatatataaggtactgtatatagagtgcctagtatgtagccctcaatgaaggagaaacttgggttttatttttattaacagtattttcttttctaaatgctcatcacctatttctttcaacagttttacctactattcattttagattagtttccagaaaagttgttactctaagatgcaagcatgtatataaatttgagttcgtccttttataccagctgctttaaaaagattatagctaagaatactatagacacaattaaatccatttgtgatagaatgcctcaatgaatctttctgtgaaatttcttgggaatattttaatattttcatgctcatgaacctcagtccaactctataacttactccaaaaatcacagtgaacgtgcttattgtgctatatgtcgtgtaatgacatttagacaaaagcaatgaaatctgatctaacctagcaataaatgtggtatagctgatttctgtgtaaagttatcagttccagcttccagctaccccagacaaggagccttgggtagtcttgacatgaacttaaaagcaaagcctctcttgagacaagaaccaagatctacaatcacatttcaaacggatttatgtcttccaactaattgacttgttaactatgctaatacattcatgtctctgcctttatattttttcaataagtaatgctacagaactcgatgttgtgagattaaagagcaaagaatctagagatttctgtaaacgctttttctataggaaaccagattagacttccaaaacagctgatataatttttgtgcatctccaaatattttatttctgtaggaaacgtgttgcttctcagaagatggctcttttaattaggccttatagcctgcagggagaaaagcttcaactttctctatttagataggaccaacttgatagtgacaatactagatgtgctatgcagtgtcatctcctaccacagttgttcaaaatatgaagaattaagcaatagcagaggttattccctctgaactctgtgccttctgtcattcccaggtggtgctgggggccagcagggcttcctgggctgcatccgctccttgaggatgaatggggtgacacttgacctggaggaaagagcaaaggtcacatctgggttcatatccggatgctcgggccattgcaccagctatggaacaaactgtgaaaatggaggcaaatgcctagagagataccacggttactcctgcgattgctctaatactgcatatgatggaacattttgcaacaaaggtaaggtggaacccatttccagagccacttttgcgtgtctttttaagcccaaatcatctatttaatgatttttcatatgtaaacaagtgtaccttattctgaggttaagatgatcagaatttttctctcaacttaggtaggaattttccaaccaaaatcatttcctaatcatttttgtttgataaaatgagagaagctctgtgtatggtgcagaatttcttccagattctagcaaattattcactgcccgaaacactacaaaggcagtctcattacatcttaatggtgagtgataaaataggtggccttcaaaaggggaatcaggcctgaccctcccacgttaggatctccaatagatcaattgatcagtcaatttctgtagtgaatcagccagtgcaccccagtggtcttgatgcccccaccccctgcagttgctaagagactggattcaagctacactcaccagaaagctcctctggtcagtcattaacatcattattattactcttactcaggatgcctttgagtggctctcagcctaagctaaactgcagaaatgctgaaaaaccacatttaattggtcagcttagagcatctgttattacttggttattttagtcttgaataattcctttaatccccagtagattccgcagagccaatgagcagagtacaagagcccaatgcatatgcatgttatcatttgaactataccctgtgatcctgcttgaccagaagaagaaattgactcaactggtctgtggcttaatttcccatatataaatgagggatgaagagaggaggagctggtgcttttcctaagccacaattgaaatgcatgtaaatcactcctctctttctaaatgaatgtatagcatatgggtaaagttttctgtgagcggttggtgcatctcttaataagaagctttacataagtagcctgttcagactctgatgaatacatggagggttgtttacactggcattattcacacaagatgccacacacagaaggaggaattgttccataacattctctgtacctccaggctactgtttggcagcgctataatatgagcatacaaattaggccagacagggtatgaaaaatgagcatgagacaacaacaaaggtggaaaggaacaccattgcagaataataccaaagcacattaacagtgctattacagtgcatttttctgttcagaacaacatggttccatgattttcctgcggcacacaattgaatgggcctgcagaacacattaattttgcacttgtagaaatgacagtcttgcaattaccattcattgtgcttgatgctaatttaatgcagtcatttccttgccaaagtaatgtctgaatgcaatcaagtaagcactaatgcctgcgagattccactacataagtaccagtttaaagaaaatcaccatccctttatttttggagagttaggttaaacacagtagctcacgcaaaacctctggagattaataggcaatagtcatgaatagaaaggcaggggcatatcctctccaggttaggccacattgcagataaagtgaaatgacgcctgtgtgttgcctctgacattatttcaacatgtttacacaaaagacatctaaatatttccttattatctgtttagcagaatgagttttcatttgattcaattagtgactttaaccaaaaaatttaaatagaagactgcaaaacatatttggaaatcatttatgagcatccttctgagtcaagtacctccttgacttggtagaatgacagtggaactgtttcagaggaatcccacagctgtccaggaaagctttgtctgcactgaggcaagctccatcagggactggaaggatctcccagcctgatgctgtctctgctctggacctcactctccaggtagcctggtgcctgcacagcagttcctgtgaccgccccccacctcaggctggtgcttcagccaaacagctcagcctctacaaagagctttggcattggccgaagaatgagctccatgcaaggccttctctggccttcctttgggagtataggtctatgcttgcagatgtggaaaacatcgctaatattttgccaagtgaatgaagcaaggcccaacctaccacacacagccggactacgtgtttatacaaaataaaacatgcatacacgcagagatgaggcaaacaaactgtgagaatacacgccaaaatattaactgtggttattttttgcaggaggataaaaatactagtattttttcttattttattttgctttaagttctgcgatacatgtgcagaacatgcaggtttgttacataagcatacgtgtgccatggggtttgccgcacctatcaacccgtcatctaggttttaagccccatatacattaggtatttgtcctaatgctctctctccccttgccgccaaccccccaacagacccctgtgtgtgatgttcccctccctgtggccatgtgttctcactgttcagctaccaattatgagtgagaacatgtggtgtttggttttctgttcctgtgttagtttgctgagaatgatggcctgtagcttcatccatgaccctgcaaaagacatgaactcattctttttacagctgcatagtattccatgttgtatatgtgccacattttctttatccagtctatcattgatgggcatttgggatggttctaagtctttgctgtgtaaatagtgctgcaataaacatacatgtgcatgtttcttattttgtttttgcttagctacattttccagtctttgcacaatgatgtatttcctctaacatcattattttttcttctttggaaaaataatagtaggaagccaagttcttaccccagacatttgagggataactatctctggtcataaaatatctagctatttattagatattattggaccatctagttgtactttctggaatggagaagcatggtcaggtgaaaattttatgtaattatattgtccctgagaatctcaatacatttaacaatgcatttgttaaatctcaatacatttagcagaactcattttccacaagcagctgaagagatcacccttcagatgggcatcggaggaagggctgccttgttggggtcaggttgcatgaaaataaagacctcaagacactagtatcacactcagctatgtgagaggctcacactaggacaggcttgggacccaaaatagcccaggtcataaaatagcccagggggacagataagctaagtctcacccctgtatattattagcccatccaggagaatggtgggcagacagcccatactgtttgaattctgtttttccctcctctccttctccccctcctccccatcctccttatcatcctcctcttcttcccttctcttcctccttccttctccgttcaccataagcacaatctttatttctacatcaatccctgtctctgtctctgtctctccatattccatacctactttccctctctccctttcttttgctggagtgtatagttgaatatgtaagtgaaattaccgtgtcttgtcactttgttgaactaggaagacagggctggatttgagtaggttcctcatgatcatctcttctgctttgtagatgatgcactgatactcactattccgcactagtcaaaaccacacaagaaggggacttcctctaacctcttatccaaaacccttttttcttttctttctttctctttttttttttttttttttttttttttgagatggagtttctctcttgtcgcccagactggagtgcagtggcacaatcttggctcactgcaacctctgcctcctaggttcaagtgattcttctgcctcagcctcccgagtagctgggattacaggcacccatcaccacatccagctaattttttatttttagtacagacggtttcaacatgttggccaggctagtctcgaactcctgacctcaggtgatctgcctgcctcagcctcccaaagtgctgggattacaggcatgagccaccacacccagcccagagccctttttcaaagagatgcctaaagatttgaccaccagttaaagtgttagctctcccagggctacttgaatctttagtaggagtgctgactggggaatatttcatggtttggagatagcacaagggcgttgtggaaaccctacaactagaccatgcaggcagtctcctcatctgtcggcagataactgagcagcatcccatcttctcagcacgttcatcaatgaggagcagtttaactcagtggaggtaggtcccttccaatgcagaattccttggcaccccatcggctgaggctgaggggagaatcatcccagactacatggaaggtttaactgtgggtctgtcatccccaggattattggggaccgaatggatagttgcttggtcatgccaaagatagttttctaacattaaaactgctccttcttggagagtcagatcccaaaacactcaagaattctataattatcaatgtcacttttattactaaccagaaattagagacataatttgcagtacactctctgtgtgtcttctctgtgtgtttaagcaagagagaaaataacatacctatagtagaggcagcaatttctgtgtttacttttcgtggttgaatgccatagtagattgaatagtgtcccccaaaattcatgtccacctaggacttcagaatacaacgttgtttggaagtagggtccttgcagatgtgattatggtaagttgaggtcatactaggaggttggccctaaatccaatgactgtgtcttcataggaagaggagggggcacagaggtactgacagacatagaaggaaagccatgtgaagacggaggcagagatcggagttacactgccccaagccaaggaattcctgaggctaccagaggctagaagagtgaaggaaagattcttccctagagttttcgaagaagcgtagccctgagaacaccttgctttcagacttctggcttcctaggaaaataatacaagttcgaagaaaaacctaccatcttcttaattcttgctcttaacaaggatagcagctggtatttattgagaacttgtctgctaggcagtgtgctaagctttctaattgtgttagcatcgtttaatcctcaccacaacctggtgaaatgattgctattactagtgctcctattgtaccaagaaggagatggttgtagtagcctgccccaaggttcacatattagtaagaggcaagactccctttcctttcattttgtagcaactaaaagcatagcctctagtcttaaagctttttgattattgtgattgagtaaaaagaaattagaatattactggatgcagagtttatcataaaaaataggatacaagaattgaacagacactgtttttttttttttgctacatctaggtgtaaggtttattcatttattgactcttattgagcaaacattcattgaacacctaatgtgcccagaagtcttgaatgtatagttgaatctgactacactgaaatttccaaagcattttaatggtttacagatacaaaatcaggcaagtctagaatatatgataggaatacatgtgaattggatatcacccaggctgctgaaaacagttcttcattatgatcctttcaccaagccaagttaagcaagaacttatcatcaagagacacaaagatatctccaaattcactcatctgcactttttttaactataaaaatgttcatgttcatatgccaaaccaggactgcagttgaaaaatacatttctttaatcactctgaaaccattttctgagttagggagttctgttttcttctcaaacattcatttgtttattgcttagaaaaaacttgaagaataaaagtcacaggattactgagtgaccaagatttgaatagtcattcaatcattgcagtgtttccatcatttacagtcacacaaataatgtgccaccctccctgtgttccagctaagtctcctattctccctatgagtattgtgaagttagctaatattttataatctgtattattaagatggtagaagaaattgtttatagcaaattcaagtctcaacctataagatgatgatggaattagatgtcagtttgaatccatctttctcacatacctgttacgtaaccttaggaaaattgtttgtcactgagccttatcttcaggaatacatagtaactacctcttaaggataccttgaaaatcacacagaataatgtgaatgaatttccacatgaaggacctggcacacagcagtccaacagcaaatgtccttttcattcttagcagctctttgctttttggtttgtgtttttgtttttacttaattcatgttgtcctttaatccttccctaatagctttaaatgtcaaatgcctaactggcattatttcggtgatccttgagtattggattgtcatttcggtacttcaggagcagtggcagtgtcctaaaatgtcatttctacttaattttggtcacagtaaaagtattctgaagccctgaagggctgagaagtatgcagagattctggaagatgcaactggaaaccacacccaccatatcggactggttttgtcaatagcgcaagtcttggagcaatgtatccagtcctttcaagaaccaagttgggtcaccttagtaactcctgcatcccttcctgactcaaggcccatcaggagacaagaaagcgctgattagccaggcacactggctcacacctgaatcccagcactctgagaggccaaggtgggaagatcatgtgagcccaggagttcaagaccagcctgggcaacatagtgagaacttgtctctacagaaagacaaaattagccaggtgtggtggcacatacctgcagtcccagctacttgggaggctgagatgggaggattgcttgagctcaggaggtcaaggcttcaatcagccgagattgtgccactgcactttagcctgggcaacagagcaagactgaggaaagaaagacagagggagagagggagagagagggagtgagagagggagagagggagagagagggagagaggcggggtgcgggggagagagagggagggagggaaggagggaaggaaggaaggaaggagagaaagagagaaagagtgagaaagagagagaacaagagagagaagagaaagaaagggaaagaaagaaaagggaggagaaagagggagagaaagaaggaggaggagagaaggaaggaaggagagagagagaagcagagaaagagaagaaaagaaaagaaaggtcccagactcctttttgctccaagagacctcaggctcaagtccacgttatacctctaaggaagagagggttttccacttgcctcctagagaaacatttcttgttggatgtgaggtagtgggtttgccaaaagcggttggaagactgaacaaattctgttccacagctctcagtatgaaacagggaccagaataaatgcatggtctacccttttagagcaggttggagagaaaattaattaatacaaaatatataaacaaatagggagaaaaagaagagaaatgttggaagtatgcatcttagaatttcacccctatgtgaaatcagctaagctgttagtgacaatggccatttttcctcaggtctacctatccagtcttaataatcccagcttggaagacactttcacatcagtagggagagaaacttttcacaggcttctttttcattttcagttggaacaggaggtttgacagatttggaagaaggcccaaaggaacaagaatagaaccctttttttttcttttcttcttagagaattattcaagtagagaaaatatcccttctctcttaatgtatttcttaaatcttcagaccttaggatgcaatttaaaagtatcatggtaactgtgatggttaattttaagtgtcaacttgactggtgttccatagggagcaggtctatgcaagcctacctccaaaggccaagggagctgagaggccaaagaaacagtctgacaaagccagtttctcagaagaaaaaaaaaacaaattgaatagggacttaccaacagaagttgcgtctctggtatctacaagatgagatggtggattcctttacctcctcagacccagggcctatataccatagagaaagggtctacatgcttcagaagcaagttaccctagagcagaatttgcagtaaacagtagataaggtggaaaacttagtggcattctgcaactgggttattcagaagccagcatggtgcattagcatccaagaaggaggtgctttagcccctacacctagaaatctgtaaagcattactttgaggtgggtctgtgaggctgtttccagagaacattagcatgtgggtctgagtggatgaggtggggaagagctaccctcaatgtgggaaggcattatcctgtctgctaggggctgcagagaacaaaaacagagaaaaggtggtagtgtctatctatctactagagatgagatatactgttttggggcaactccaggctccctagcctttgggctccagaacttataccagattctcatgcttttgagcttgggctaagagttacaccattggcttcttttgttctgaggcctttggacttggacggagccacaccactggtaccccagggtctccaccatgtagaggacgtatcatgggacttctcagcctccacaattacatgagccaattcccctaagaaatcccctctcgtatgtctatatctatatagtctgttgattatgtccctctagagagaaccctaataccataacgcatgaaaataatctgattaaaagcttaaaaaataaagagagaaggaagagccaaaaagtcagaaaatatttatggatgaaaatccataagtggacagaagtccacaaatatgtatggaaaaagaaaataattttgacttaattcagaaaagtcaaagctgcagagatagctgccaagtttaagtggctttgttatagaattttgtggtggtaaaataacattccccctagcctgaggttctctttggggtcccagatatttgagaaaacctggccaattaactttcttagagaaagagatttaaaaattcagtgcagaaaaagcaagtcctccgtaaactgttctaaatctaatacaggacaaagtgttcggatttggctttggttgtaggataaataacttttgtttcaagtgtgtgcccttttttttttttttttttttttttttttttttttgagacggagtctcgcactgtcacccaggctggagttcagtggcacaaactcggctcactgcaagctccaactcccgggttcacgccattctcctgcctcagcctcccgagtagctgggactacaggcgcctgccaccacaccaggctaaatttttgtatttttagtagagacggggtttcaccatgttggccaggatggtctcgatctcctgacctcgtgatccgcccgcctcagcctcccaaagtgctgggattacaggcgtgagccaccgcgcctggccaagtgtgtgcccttttctaatccccaccagtgtggggacacagctgaattttttttcctgagtgttttatttgtatatgttgttgagtgtttttatttcctgttcttcagcaatgatcagaactctaaataatgtgaagttcacagaaataacactctttatcttttcccacatattagctccatgacttgagctgaaactctatacatttcttttcttttcttttgtgagccaaaaaggaactggtctgataaattgtcctgagggttttgcttttagattgctcacatgtttggctgccctgcaagcaggtccattcaccaacgtccacgctgcccttgagtactccatcacgtctatgggccatgaagacctgcctctgacatgcaatttcttcactccacaaccatttgcgcgcttatcatttccaacaggcagctctggccttagcaactgggctcattccaggcattccttggctacaggaaatttactttcttaaataatcaagcctgagactataatgctatagcctacccattttatagatcaacctggctttgaactcactcacatatttttacctctattaattccaactggttacaagagtgtttgatttagataaataggcattttatatttttctgtttaaaaccaaatcctgagaaaacaaattatgaagagccagctgctctctctgagccatccttttcttggcattttaaatgtattaccttcattttctcaagaggactgggcacaggatatagtgaaatgtttaacttgactaacaatactttctagctactcttccaagggatatgtttactaaatataaggtggcttttacagtattcaagttctataaggcaaagactctcaattaaattaaattattggcagtacaatttaacattctacattctgtgtgaacgaagtaatttcaagcagtttgatcattaataataattttattccttcctatacactgagcacaagtttagtgaaatacgggaacatgtacagagagcctgctgtgggggaagcagtggattgccagcaaggaaggacaggatgaataagactaggctgggaatgcaatggaggggatagaaccaactgcagcatgcagggaaacaagccagaaggccgagtgagagacccccatggatacccacgctgaaggttctactgggagggctgcctgattcaaagtcttgtccaaggacagcatggcagatagtggtgggttgcacctaattctgagggcgtaatttgggttaagggagaagactctttggaaaacatatatcattaaagcctaaagtctaaagacaaaagttttaaagcatctcaatttttttaaaattgtctttgaaataatacaattgatatttacaagaaatacttatttgctttttttttttttttttttttttgagacaggctttgagctttgttgccctagctggagcgcagtggtgcaatgatggctcactgcatcctcgacctcctgggctcaagtgatcctcccaccttggcccccagagtagctgggactataggcatgtgctaccataccctgctaagtttttaattttttgtagaaacagggtctcactgtgttgcccaggctggtctcaaactcctggcatcagggtatgctcccacctcagcctcccaaagagctgggattacagtcatgagccaccatgcccagcctacttatttgcttttaatattacaaaattgaattgctttagacattaatagtggacaaaatattttaggagttagattagcttaactatttttcaaattatattccaccagccaaaaatatttcatgaggctttgccttctttaatttctaatatgaaaacagtagggaattttttccatttttcaaaaagttattctaataattaatatgattttctcaaaatacacgtctccttgcagttttttcccttactcccacctccagataattttatatgaacctagtggacaccttccccttgagtatttctgccttaaagataactttaaagatacaacttcaaagatagatcaacaaattgatatgtaaaccaggcacggtggctcatgcctgttaattccagcattttgggaggctgaggcaggattgcttgagcccaagagtttgagaccagcttgggttacacagtgagaccccatctctataaaaaaaataaatatctaaaaataaattgacatgtaaataagtttatctttgctttttgttaaaagaggtcttctaaaaacttgcttttatcaactttaacattactaaattttattttagtattctgaagtttagaccttaactaatgcaaatttgcttactttagactagtacaaatgacttatgatttacctgtgccagtagccaatctcactttctgtgcttctccctagggagttgggtcaagtatagcttacagagaaataccaaattctagcccttatgtgaatcatttctcagcaatcctcaaaggcaccaaaatgtcctttcacatcttctatttctttccatcctggatttatgaccagaaacacagacaacactattctaaactaattttgtttaaagaaaggggaaatttgtactttttgagtttatcccaattaaagagggaatcttatattatatagaacagtggaacaagagtaacttgaattccaatttcaacattattaaaaaccaaagtgaacaatcctaactaggcattctgtttctttataaattgcactaattatataaaattcattattcacaaggctgtgaggatcaaatgagctgatggatgtgaaagtgctttgaaaagcattaatgttataaaatgcaaattattattaagtttattaatcattgagtcactgaaagcctctttagtgagaatcctgcaaaatgtaaaccattatctttcaagagctgctaggaaatcctagacagaacttttctatctgtgttgttagtgttgccataaccaacagcaaaacttttccctctcaattgttgacattagtgctcgcccgtctctctgtacagcactgaaatgcgttatccagaagctccgtgctcacaacaatccagcaagactttagacctcagagttatactagttcatgacaggcagtactgtattcatagtcagccaacccttgaatgcatggccctgattaaattcctgtctctgtcatggaattggcatgagtcatttggcctggaacatcattaaagcagcaaacacacttgagattaaataagaatggattctaaaacatcctcttgaggttgttattgagatcgttagcaaatcatgttggttccttgagtatcttatagagtttcaagaaataaaaagcaactgctacattgtagaaagtacatctaaaattttcctcttatcccaagtgattgacagtctctctgcatcctctgccccgttaccaaggatgataactcctgttcagatgaatgagtccagatttttctcaggtctaagccaaatgtaacccaaatatttgaacaagtccattgctagtcactttttagttttcagagatgaataaagctataagtaaaatgctttctaaagctttactattgaagtaatttgatttaaatcccttttaaataggtctattttagcctgttgacttttatatttccttaacaaatgtctcttataaaggaatcttgtaaattcagttaaaaatataaattaagtcatgtaagtcaaattaaagcagtagatcaagttataaattgaaacaagtttataatccctctcctctattaactaagttaaaatgttatcttctgtggcctcatacaacaacctcctgaatcataaaccacctgaggttatgacaaacacttaataacttcttttaaaatatcaaggactattccaaaagacttttatttctgttactataatgaatttatgattactcagactttcagcttttgcgctaacattcaaatgtcattgggttacttattccaacacttcttctattactatagatggttaaaagttcaggaggccccttttgtcacaaaatcaaagtatgtcgtggttgaaaggactatttcattcattcatattcaactgatattttattaaacatttcctgttatgccaggcactgaactaagtgtgttcacatagtttaccttatttaatcatcacaacaacattcaggcattgatatgatcacctttatttacaaaatgaagaaacagagacttctagaggttaagtttatcatccaaaatcacattgctagtaaatggcagattgagattggaatcctaggtccctgactccaagcctagtgttttttccaccatatacactagaatgatgtcctctttataacacactcactggatcagatccaagttgtgttcatggagagcccgggaccacatgaggcagccctcttcctatttgagcatttcagacaactggaaagatttccctcatcctgaaccatcatctctattaaagatggagaatgtctccatgaagaaacagtgggtgtctggctctgggttcaaattcctgtgcctgtaagaactcagaaacacctatgcaccttcaaaatccccaactctgtggagataaggaagagcacctggcctaagtttgacacaaaaggggtatttaatagctgattcattccttactcttctgtttcctttaccaaagtctcaatggcccttaaaactaatatgctgacacacggtcagtggtccaatttgctatggctattctcccaatgccccaggaggccttgaaagatattggccttgcttgttgtccaatgtagaatggtaaattaatgagatccttggataccagataacacagcttgccctgtgtgtcctctttctatcttatcaccctgatgactcagggcaggcctaagtcctaaaagttctgaagaagtttcccttctttctttgccgttctttctgaggccctctctgtgcggttgagcaaggaaacatacacacacacacacacacacacacacacacacacacacaaacagagccaggtgtgagctggacctgtcggtttctaacaataagtcttagataacaagataattctttgtgtttcttagggtgccacccacacaccgtatccatgcttttgtgttaatagcagagacttctctttctgaatatatgaggagaggaataaaacaagggatgtgaccaaataaattcttctgacatgagagaccactttagattgccttattacaaagaagctgatttgcagggtaaacacaggccatgccctgtaagttttcttattgatgaaattcatgctttgaattactgattgatggttgctgaaggatggcaatttctctgttccagtctggagactgcgctacgtaaaacgagcttctgatgatggaaattctaaaatccaaacaaaacatggaaacaattttttaaaactcgacatctatttctatgaggagctaggagggtggatgcaattggtcagctccagctgtttccttgcttttattgcacagttgttacaaagaggaattcagtgtacaactatgagcttccggccgctcaagctactgcattacactacatggccatactctgatcccaacatgagctttttttcctctagccaaaggataatgtaaaaattatgacacaaataaaatatttatcctctaggcatgagtaaaggaattcacaaatcagaacatagcttgcaagcatacaagagtatgcttgagcagtcccctctttttaataaaaatcaaccatatgaataaaaagctgccctgccccaacttcaccccctacccatcacagaccacaccaccaccccaccatccccgcatacatgcgtgcacacacatgcacacacacacacacaaagccacccactaccattgcagcagggaatcactgatttttttaaattaaacttttagagaacccatgagtttagatggaaaaaatcgtgggagagtaggaatagtttaaggaatgtgcttggagaccagccactcttcacccaaaatgatttcctttgaaattcctgacttgttccctttctgtcctgtgacctattgttctattaggccattctattctattacagcatcatttgaatcagtaggagtgggtctgggaggatggtaataccatctctttaatacctcaatgtggacggaattgaaatggccaagtccttacccagaagagctgtcctgaagaaggagcattgagtttgaagggaggagccaggtgtaatttaggagtggggaagacattggacaagctttgaggagatagttaagatgacttccatgaaaacagagagctgaagcctgttagtaacagactggaaggaagaaagatactcctttctttgctgatcttgcctaaagccagcaggtctgcactggcaaaaagagaggaaactgtctttctctcccctctggcagtttctcttctactaagatccagaatccaagctaatggcattagtgctataatttggtttcactactaaataatctttagttattgatccatgttagaattttgtactattggaaaatgtattctgagttcctaaaatcaatttatattattataatgtatgtaccgtactatcattatgtacatagtattagcatatatagcatttcattcccttgaaaccacttggtcttcatacccatcacttaaaaatactgcttcatattattccacccagtgggtttaccaaaatttatttaacctaaatatttcacaatagggaaatggcaatttcaatttctgttcttaaaattgtttccaatttttttattgtaaataatactgcagtaaatgatttttgcaagtggcatttcaatattttacattatttattgaggatggattgccagatatggagaggtagagttagaggatgtaaaatgcttaggcttttcacgtacaaagctagtaagattttctaaacacagtgccaaagtacatgcagtatacactgagaatgccttgttctctgaacactaccagcaatgtttttcttttttttatttttatgaagataataagctaaaatggtaacctatttgcctttacttcctccaaaatccctagaaaaggatttcaaaatttttttgaaggtaagagtcaatctaaacaaagaggacaggagaggacagcaacatttagaaagacggcaagcaaatggaggaataacacacttagtagacaaagggaggccaacccctaagctggttgagggagaagctcaagagcaggcaattataaaagggcagttccttttataaggaaccgactcctgcaattactgccttaactcattcatgaaggtggaaccctctgggtcaggctctggtgagggccctcttctgggtggcagaagctcaagggcatggctcctcttctctttgcccttctgccatgggatgatacaacaagagggctctcacaagacgacatcccctcgatcttgaactttccagtctccagaaccacagccaagacatttctgttcattgtaaattatctgcggtattctattatagcagcacaaaatggactgagacaggctgctatagcggactgccatagcagtctctgttgcactagaaggctcagaaatgggtagcccctggcacctcagaaagatagacttaaaaacggaaggatcagctaaaaatttctatatgaagacaatcttctcctcactcttgcagctgggtaactgccccagagccaaataaggcagaagacccaagatttagtgtctggaggggcttcttttatctcttgaagatttggaagattgtgttttccaaggacggctgccacaaaagctctcctgacacctgtgcttccagagccaagtgactgctccatcaagacgtgatatctagttttcctctccaagaatctggacagccttgggacttgcttaagccaacagaatgtggcagaaattatgctgcctgacttccaaagctaggttatagagccaaggtgacacgtgccttggggactgggccatgcacattggagtactgattgcccaggaaagcagtcaactgccctgaggccaccatgctcaaggaactgcactaggttacgtggatcggacacatgaaaaagctttgagatgacctaaggaggtagagagaggccaaatttctgattcacagaaaccattagagataatgaaataattgttgttgttttaaaccagcaagtttggggagcaatctgttaggtagcaataaggactggaacagagaagatgaataatagttttttggttttccaaaagaacttactctccaagtattatctttgtttttgctaaatcctttgtattagtctaggctcttagagcgacagaatcaagaggagatatgtacctatatctgtatctctatatatgaaaggagatttatttggggaattggcacatgcaattatggcagaagtcccacaatcggccgtctgcaacctggagaaccagggaagccagcagcatggctcagtccaagtcttaaggccacagaactagggaagccgatggtgtagctctcagtgggaggctggagccctcagacaccgggcggccactggtacaagttctgtagtacaaatactggagaacccagagttctgatgccaagggcaggagatgtcccagccctaggggaaagacagagagagagagagagagagagagagagcaaaaaaagaaaaatagaagaaaaaacatgcattcaaatcattttgtaactcctaattattaggacgataataaaagaagattccagattccagacctagagagcaaccagtacagactgaacaaggaagatgaagagctccatggggactatctttgtctttagtctctttgggctgtgctaaggattgaatgtgtcccccaaaaagcatgcactagaaatgtaatcttcaatgcagaagtgttgggaggtgaggcctaatgggagatgtttaggtcgtgaggactccaccctcatgaatggattaatgctgtaattgcaggagtcaattccttataaaagaacaagtctggtccccttttgtgcactcttgctctctctctctctctctccctctcctctttcctctgtcttctccctctctctgtgtcctcttctctttgtccttctgccatgggatgttcaacaagaaggctctcacaagatgccatcctcttgatcttgagcttcccagctagcttccagaaccatagtcatatatttctgttcattatacattatctgcagtattctgtgatagcagcgccaaatagactgggacaggttgctatagcatactgccatagactgggtggcttccaaaacaaacattgatttctcacatttctagaggctggcagtctgagatcagtgttccagcatggtcaggtgctggtgagggccctcttctggattgcaggctgctgacttactgttgtttcttcatatggcagaaggagagttcagagagctctctgggtctcttttataaggggactaaacccattcacaggggctccaccctcatgtcttaatcactttccaaggcctcacctcctcctaccatcaagttaggggttaggatttcaacatgtgagttttgatgggagacaaaaacatctggtccataacagtcaagaaaaatataaaacagtttacttctgtttccttccagtggtgagataagggatgagttagtgatgagtgtgcagaaaacaaggcaaatgaagaaacaaaagattgcactggaatgtaaatgcaagtgttttacaacatatatgatcaagaacaatgcaagcttgttacttagaaatatgaagttgatgccaaaaataagatggcttctgaggagtgggaagtggggaggtggagtggagacttccgttaatgtgtttcagggcttacagaagcacttgagtcctttcttaaaaatgtgtaaatttatggcgtacaagggtaattttgttgcatgcatggattacatagtggtgaagtcagagcttctaaggtctccatcactcaaacaaaatacattaaataaactctcgtcatccacccctacacccttctgagtctccacactctatgtccatgtggacccattgtttagctcgcacttataaatgagaatatgcagtatttgtctgtctcggtctgacttgtttaacttaaagtccttagactatgtatgtcacaacattcataaaaactgatcaacttaaataccacattaaaatgattacagaaaaacgcaagcaaaaatataataaagtaattttttcccctccctcaaagccaactgataacgaaaagaaagaaatggatgaccaaaaaaaaaaacaaaaaacaaaaaaactctccatgcagtgagccgagatcacgccattgcactccagcctgggctacaagagcaaaactccgtctcaaaaaataaaaaacctccaataaaatatggcaatgctcattgccacaaaccacaaattaggaaggatacgtgacacatgccaactactttgaaatttgcatcagaatgagagaggaggcagttaattcatgttttcttaacttcactcaaagttcagcaattcctttagctctatttcagtttcttcatcctattgctttcttatgaaatatgactttatttttttcctataaaagtagcagaaatgattgaaagttctttgcattttttggcggtgtttgaatttttaataagggccacatgtgtctttctaaaaattaacctattctctttttaaaaattaacaaataaaaacttgttctctttttaaaaattaacttatttgttctctttttaaaaaatgaagatttttttcctcaaaatgaatatacttttgaggtaagaggattttcacctagtattctaaaatcacaaaaacaagtttattatttttattttattgcaaatatttttcctacatggttattttcagatcaaataataggattttggaaataccagcctgaccatactgcacagattgagaggttaggtactaaattataggcttttagagggaggtaaagatattagagtccatctccactccactccccacagataagggccaaggccaacctagccattaggtggggtggacacaacccacgttttgaggggcccacacatatatgttaaaatttctttagaaatcagaagaatacaaatgaacttcggggtcaaagaaaatattttaatatttaacattaatacattttctcttgaggccaacattgtcatgaaatacacattttcataatttttttttgtggaagaaagggaccacaagggcaagtgtgcctggggcccatgaaagtcataatgtggccctgatgaggattctgggacctaaaaagattcctgtaattggtggtggcagagtctggaccaaagctcagggcctctaactcctcctctatggtgctttctgccatgctgttctctggcttgggtattccacacactccatggtccagcccacactccttatctgaccttacctctggccatcagtcatagttcatcttctgctccagttaggtaggcccagcctcatttcctgtaattcatcacaaacactctccatcccagctccatggagcctcccattgttcctagtccactgctgttcattcccagcactggctctcactcctcccactctccccatgtggagaatccttcccgtttccttctgcttgttcaagaggatcctcatctctggagactttgtcttaacactgcctttttttttttttaactgaaacagggtcttgctctgtcgcccaggctgcagtgcagtggcgcaatcagggccaactgcagccttgacttcctgggctcagatgatcctcctgcctcagcctctcaagcagctgggattacaggtgcatgccaccatgcctggctagtgtgtgtgtgtgtgtgtgtgtgtgtgtacatatttttttttgtagagacggggtttcaccatatggcccaggctggtctcaaagttctgggttcaagcaatccacctgctttggtccccaaagtgttgagattacaggcatgacccaacactcctggcctctttcaagtacctttaaagactcctccagccttgagtgatctaccctatgtataaaagcatttgccatttagtaacaaattatcttttcttattcatatttgtcttatatgtcttagttttctttccccaattatcttgtcaggtccttaagctcagaagcgatattagtcaaggttccccagagaaaaagaaccagtaggataagtataatatagataagagggaatttattattggaagtgacttatgcaattatggaggccaagacagtctatgatatgccatctgtgagctggaggcccaggaaagcccatggtgtaattcagtctgagtctgaaggcctgggaacagggagccagtgtgtaacctccagtccaagacgagaggcctaagaactgaaggaagtggggtgggcggagtcccagggcatgagaagaaggatgtcccagctcaagaaaaaaaagagacaacttacccttccttcacctttttgttccatctggcccctcaatggattggatggtgcccacccttattggtgagggcagatctactatactcagcctactggattgaatactaatttatggcaacaccctcacagacacaccccaaaattatgttttaccagttatctgggcacccttagcccagtcaagatgacacatgatattaaccatcacagaagccatgtctcatatactcactgagcatatatatgatcagcactcagtcaacacccaaatgattgtcagaaatctctcacaactccccctacaataatagggtcaagtgctacctcttctgggtgtcagaaataggcttggctttcctttctctttcttgtatttgtaccctctgtgatgaaagtcacgctgtctgattgcacattccttctgggcaagggctgatgtcttctcattatgtattgtcagtctccagcacagtctgtgctacaaagtaggtgtttggtaagtatttgatgaatgagcattttctagaaccaacttttaaattgaatttcttggtcctggagatgtttatttttcatgtgagttttccatctctgaaaaaaataggaaaagaaaagacaaggaaatgagaaagcaacttgaaaacaggaaaatattggtgaaagttattttcacagaagtcttagttgacctttctctgtagcattaaattccttccctgtagtattaaattcacaacctaagctatagctagctttccaaactagacaagcatcccacttaagcacaattgatctcatttcagtttgtgtctttgggcaatgaaataccgcaaagactttttctacctatgctttgatgctttttaaaaagtattttctaaatatttttaaaatgtttgaaatacacaatgataggataactccaaagctgtcatatttgtcaaataattcaagtcagaatttaatatatcctataactgagactcttttataaaattgagacaggcacctgaagaccatttttatttctgtattttcttggtgtcccaagcaaccccctttagagaaatcactaatatttcctgagcaattgaaccacaataaagaccgtggaaagaaaaaaaatgggtctgctcagacattcagagcacgcatccttacaaatgcattctactgacctgcaaaatgttagtgggaatttataaatgcctacaaaaagaatatccaagtcaacatttgacctgtcaaatctaatcagtttggttttgatcattgtaccgggttgctattcgcaaacactaattgaaagcaaaaacacaaacagcatttttaaagagtttctaggagaatatcccatttgcacacacgtcagattaattttccccagagttgagcaatttcaggatcaattgattactgatcccaaggaacaatcaaaaaagaaattccctgaaaaatttttttgactgtcaagactcagcatgggaaactatgccatgaaaatgcagtttgaatagcttgtcttttaatcccaagtgaaataaatcaatcatctattagacttttctagttccttgtgtagtcagggatagaagagttcgctgcagcaggattcggaggaactggggggatctgggtccaggaactcgtctgatcactagaatggggcagggagtgagcagaggagtttgcagcacacagtagaggaagctggtaggcacagaatagtaactggcaggcttacagctgggaccagaggggtccagcaatgataacagctcccggcactttctaagtgtattaattaactcatttattcacacaagaatccaataagggagatagttttaatagacccattttactaacatgaaaactgaggcattgataaattaagtagcttgctcaaagtgacccatctctttggcagagcaaggatttgaacatagacaattttgctctaacacctgtgcccttaaccactgacttgtaactgttccagggagaagatgagcctcttttgggcagcagggcagtggacagccactgaaaatgtgagagctggcaatattcaaagaggcacattgagatccttccaggaaagtctaactgcttgcaccagggtccaggctcaagggagggattcagggagcagcccctagaagtaagtgctttcacttgctaggcagtgcttccctgactcttaggctgcaaatttctaaaaggaaaaaaaacaatgttaaacacgagtgccagtttatatacctttatatattcagttatacattttgtaaatatattacagaattaatgtacatcataaaatacacacaaagggaaaaaaatcattcctttacatcaacaacctactataaatttacttcaaatagcattcatcagtactagcactagaaatgtgtgtccctgacgaaaaatatgtttttacataatttagatcttttattttgaaatttatcagaaatttcttgattagaacccagttttcctagaattattccctacttgttagattatttatccacatatagatgattccgtgaaaaaatgcaaagcaagacccttgatatattgtgtaatcctgaaactatatattaaaaacaaaatagtcttttagaaagcctgcagcagtaccccaaaataaaggtcacccaagaagaaaaattctccctagaataatgcctttaaatcccggaaacgaaagctcaagtgtttacccgttctttttaacattttcagagcaatacaacagagtcaatgtatgaaataaggcattggagttcagtgtaagctaccaccaatgacagaacatgtccattcagggcaaagatttatttttctgattataccaatgacccacacatacacaaagaaaaattaaattgaattaaaagaaagcatttcagcaatcttgacaggcttgagccctctgacagctcctagaattctatcagccgatcatcatcgtgttgctaaagccagctgcctcttgaaaccaaatttaatggaaagaggaggagctcaacaaagcagcttaaacatctcaccttcaaagctcattgaaaactaggcttcctatcagtcatgtgtcaaaggttcccctcatcctacaccatacagattagttcttcaagttccatttgtgtggtcatcctttgagtttccttgaagctctaaaaaggctaaaaggttatttccatctggagccactggagccttaatccatgtatcttttccctgcgcgaatctcaacatggcggaactggaaagtgagactcccaacttccatgtgaagggaacgatgtcaggcaggctgagaagcctgagggtggctggttccaaagggactgacccaagcctgtagcgagcaaggaggctgcctgctacccagagccaccaccccccatggcagcagatcacagcccctgttctttctcttttgaagcttcaggttagggatgggcaattcatagcaatttgtctttgaggtgataggtttggcaaaggggcatgatccaagaagtaagaaatgtgtgagaagtttcataaaggttgatggcgattgtgaccatgtgacctgtgcaatctttaactcatcgagtatctaatgtagattcttaactgccttgagtgcttttaagggactccttctgtgggggcttcatggggatttttcctaatggttaagctatgtaaatgtcttccacagctcctgtaaaatctcccatgctgaaataactacatccctgctctacagctatgaggattgtgaccgtatgtgtcccagcaagtggtagccaccatcataagctttggaggacactgtgttcttctagatactccctgggccatcttttcagatgtgccctttcagaagtggtcgccctttcagatatgtccttgtcttagcagttggttaaagcttcataggatatttgtattcaaggtgctagttcaaaaacatgaccttgaattcatagctgcgaagctcaactgagagaaaacatatttaggaggatggaatccacgcattgccgtagaaaactccttctcaccctggtggatacaacttttgaaaaatattgatacctgggccccatctagaaattagtctcatgtgggtgctcagagaacatagggaggtcattggggatggagtagaatgagcaaagaagagaagaaaatagggtgagagaaacaatggggtgtggaatggggagaagaggtgcagattagggagggcatggcaggccatggtaagggcttggcttttgcccagagggaggtggagttcatagagggttttgagcaaaggagtaacatgatatgacatatattataaaatgatcactctggctaaattaattccttttgccattgcatccttaaaataaacctaaaaatgcagaaaaactgaaaacaggaaatgattttccaagctgctactcaaatgtctaataacaagaagtgactagaatcctaaatcccagaatggtccacgtattatctccccagattcctgatagagatatgtagaaggcacatttcaagcaggcttatattgttttattctaagagggctgaactgggaatgtgaggtttcaagtccttctttgcttaggtgtatccagaggtaatacccagaaactcaaatttagtggtttgagatagactgtagacatcctgttgttaaaatgattccaatgcccatgtcgaaaacacgtctccaaaggctggaaaaatcaactgacattgacaaatgcttttagttttcctttcttggactctatatagctgtactgtctatacagtaaccacaagctacatgtggaggttgggcacttgaaacggggctagttcaaattgagattgtgctataagcataaaacactcagtagattttaaagacttagcatgaaacaataggtttatgtgttagtcaaggttctccaaagaaattgaaccagtaggatagagagagatacataagagggggtttcttaatggaaattggctcatgttattatagaggccaagaagtcccatcatatcccatctgcaagctggagaaccaggaaagccactggtataattcagtctgagcccaaaggcttcagaaccagggggacaactggtgtgagtcctggagtccaaaggctggagagctagaagcaccaacatctgagggcagaagaagacggatgtcccagcacaagagagggtgaattccccttcttctgcctttttattctttccaggtgctcaatggattgggtgatgcccactgacaattatgatcctctctattcagtcgactgactgagatgctaatctcctccaggaatgccctcatagacacactcagaaatcatgttttatcagccatgtgggcatctctcaggccagccacattgacacacgaaattaaccatcacaatgtaaaatgtctcaataatttttacatagattacatgttgataaaatattagatatactaaattaaatacaacatattattaaaattcatttcacttttttactttttaaatgtggctacaaaagaattaaaattacaaatgtgggtcccattacacttcttttctttctttctctctctttttttttttttaaagacctctgtctcccaggctagagtgcagtggcacaatcatggctcactggagcttcgaactcctgggctcaagcaatcctcccttcctagcctcctgagtagcagggattacaggcatgcaccaccaggcctggctttcacattatatttctactggacaggactgatgtagagcttttcaaagactcctcttacataggaatcatagccctctatgataaccttcaaaatacacctacgatgctaccattctccgcagtaatttttttaaagaaaaatgctaaattgcttttttagatctttcttgtaggcaagatataaatagaaggctttgaaaggcaatacaacatagtagttaatagtaagaacttggtagatgtgtgactgcaggcaggttgtttaccttctctgaatctccattccctcgcctgtagaatttgaataatatgtaccccatggtgttgtgagactaaataacatagtccttaatgctccataaatggtagagcctttgtaattggtgctgaaatttaaagacaatgtggagttatcttggattcaggtgatgagattcaacataagaagcaatgcctcaagtccttgcaccaacagaggtgcagaaattcatcatctccctaatgaatcttgagttttctttatacttctgtcatttgattagaaacaaactctcagcatgtcagatttatattcaaatctcagaataaaaataattacagaagcaaaatgtcatttggaaagggtgtgtttggtggtcagaattgtggttgccacgtgccttcgctaaatatcatgactaaaagggaaagacatgcagatctttgctaggaaggcaagagaaagaagaggtgaataaaaggcttgaagctcttgctactctaatcaaattgttttatttgtgagagttcgctttagcttgctctttatgtttgaacctaagtcttttcacctgtgacctcatcaccatttttctaatattgctcagctcattagccttgaaatttataatttagtttttacaccattttatcctatttcttcccattgccaagcacaaacatttactttgtaaaaaaacgtgactgaatttattaaaccagtttgtcttcaaaagtttcccttttttatagacatgggaagactcaaatagttggtttccctaattctcaggagacaaaccagtgaagctgaagccagttttgtatgcaactaaactttgtgccccgtcctttgggtctccaattagaataaaatcagggatgggcaggcagcgtgcattttaaatcaccatccatggtcactattatttccaaactcaaaggcaccattagaacagggaaacatttgcaggcatttcattacaccttgaactattaaaaaaaataagacattagaaagaagtgattactttaaaactttcacacactatggaacaaaagaaatggcaatacacagggagatattatagtaaacaaattgacgcacacggttgttgttagtgaaggacagtattacaagcagatgaggcaaatgaatgagttgggaagagagtcaatctcacttcctgaagcaggggcccttgagaagcctgtgccttttaggctgtttctttgtaggattggcctgggtgctgaaaatagcatagagccttttgcagaatcctttatttcaaggagttgcggtatttcatatgtggcacggcccctcccttcaatggcctctctcctgccactggaaggtgtttttacagttccccttgtgacaaaggacaggtcagagagcaaacctgtgagcaaatcaggcttggcacgcacatcactaagcaacagatgctttctggaaaaccatttgggagtgtttcagatagtagtatgtgtgtgtatatacaaacatatacataatttctggggaaaaaatacatacatacatgtgtacatccatactttctgaaaatcacacacacgcattttccagaaactcatttgaggttgattttatgtgtacggagacagagaaagccatccatccatatagaaagccttttgcaagtatttttaatttatttcatagaagcctgaatttatttcacacaacaatgaataaatccattcttttgccacagacgtggtgcaaaaagaggggtgtgcttgaagcatctacaaaggggaaaaagctgctgatacagggaaaaaatattaaagtaaaattttagttgtcagctttgtaattgaagctgtctcctcacttgaaaatattgtttccactgaagtagaagacaaagggggatctggcaaatgcccccacgatgttcatttccccagataaattacacacatcgtgtgtgcatgaagatgaccagaggctctcactgtgctggggatacagtccaatcattcattcaaggctctgtgtagtcatacaacaaacgcgtggcctaaatccattctttttcttctttttcctttctcttctcattttttcttttttcctccttcttctgccaaaagacagataaagtataataactttgatgacaacctcattttcaggatctctcgataaatcataatccttcagttgtattttccaaaacctgcagttagccaattacttcttggtttccttgaggtgaatctttgctttttaattatattttatcttcttcaaagaaaccactattgaaaaattatagctaatggtagaaatacatcactaagatgtcttggattttcttttggggaggagaggtgggggaataaaatgaaaaaaatatgtatatggccaaattggtctgtgataccattaattcatgttcattaattcaaacagtgtacattgcatacctactatgtgctaggagttgggttgtactccagaaataaaaagtcaaataaaacgtgtttccctcaaggaaactatgttctccagcatctgcacatgtaaactaccaattccagtttagtatgacaaactctttggaagtattatattttgaatgtatttcatcgagaaatgaatgtgggccaggcaaggtggctcacatctgtaatcccagcacttagggaggctgaggtgggtggatcacctgaggtcaggagttccagaccagcctggccaacaaggtgaaattctgtctctactaaaaatacaaaaattagctggaggtgttggcctgagcctgtaatcccagcttctcaggaggctgaagcacaagaatcgcttgaacccggtaggcagaggttgcagtgagccaaggtcgtgtactccagcctgggtggcccagcgagagtacatctcaaaaaaaagaaaaagaaagaaaagaaaaggaaaaaagaatttctaagtctggttttcatagaaacaagtgcaaaacaagccagaggggtcattgccaaactagaaagaagcccagggccagaatatgcagggttagtggagaagcccagtgctcctgggcctgaccacctcttggactcggtataccatcataaacagcattcagtaaacatcttttttgaagaggcatagtaaagaactacctgctaagagtccagaaaccctgtgaggcctcagataactttagtaggaaataaccaagctcttgagttgcttgaagtagaatcccattagcttctaatgcttcctgtatttgcgccccattcaaggaagcaactctagagaatttctttgaatcctgttacttccatttgatgagtgagactcagctgtgatagtctatctgctttaagactgccgatacgatgtggcatgttctctaaagaaggcagaaggcttgaggacggtttgtgttgattgaagaacatttcagtgatgagttggaatatttagacaaatttcaaggcttaattaatatatgaaataaagtagttgcagagataacgaggaaaaccaaagttataatctatagttcatttaccttccttggtcagggcaaatattacaaaagatatgtactgcttttacaataatcagcaaatgggaatgactttgaatttcagaacacatatgggaatgtcatcaacttcgactttgaaatgtggctttttaaaattaaaatataaatcattctattgttaacaaaagtttatcaaaagtaatagggcttttgtagatttttggtttttcttttctattaagatctttactggtagagaaaaataaaattttattaattcaaagattccattgtgtttttatgtttgtgagtaataatcagtggttcctggtatctcatttcgtttttaattcccaaagcaggagctaataagcaaatcgctttgtgggtttctgtgaaaacagctagagtttgcacaatcgtcgcctagacagagggaggagtgtgggctctgaagttcagcagatttgcatttgactcttgactctgtgattagctgggtgtccttgagtaaactactcctgtaagcctcagttacctcatctgtaaaatagggatgatgacatctgctcaaagcgttgctgttgagtaattaggttaaatgagataaaaagtgcccattggcacctattggaactcagtaggagctcatgtcttcatggtgtgtaaatatgtacctggctcccatccacaagagtcctcgctgaatcaacaaactcacaagtgcctcttttcactagactgagactaaaaccgcgaattaaaatggtgtttgtcctcaagaaccactagggtcaagaattctacatggctcaggcagatcagctgagcacgtgagaaaataaggaatatgcagtctaagtacagagctcagatgaagcaacttgctgcctatcaacagaaagggtggaaacaccctggtgtgtgcaacaggcacaaatcatgtaattcagtaagtctacaaatatgtagttaaagaaacaatataatttctaaaagcagtctcctcgcagcaaactgtgaagttagcagcacagaagcaaactgaggcagagtcactggattggagacaagctgatttgtgaaagctgcttgagtaattgaccaacctctgcacaactatgttgcagtttactaaaccagtataaaggagaaaaaaagcagtagaaattaagagcattcgttaagctgtaagtcctttcattcttttggatatattattctaaatgcatcttataacattttcattaataaactgctgttttaattaatgatgaggtctcagtcaactgaatgacatttctttcaagaagcccacttcatacgcacacaaaagaaccctgaaatttttcactaaaggaaaggccaatgtgatccaactagttgaagaatatactattgcaattaaaaaatcatttaattccattcggctcaactcaatgaacatttattgaatatctgctggaggccaggggctagctgggattagacacagttcttcctttcagaaactcacagtctagagagaagcctggtgcatgaataaggcattcacctttaacctccttatccctgttctgttccttcccttctcttcctggtaaggcacgcttatttgcaaaagactttctacatgaaaaaaatatatatatgcatataggcatatacacacacatgtataaatattcatatataccctcaaagtagtttcccaaaattacttgtgtgtatacaaatattcatgttcatatatatatttttttatagaaatgggactatggtgttgtattaatgttggtttcctgactccaacttgctctcacatggttcaggaattacatataatatatattataatatatttaatatactagatatgtaacattaaaaattattttaattatatataatataatgttaaatataaatatatttaaatttttaatatttatatttaaattttgactaccatttgtattatatctaaatataacatatttaatatgagagagaaaacaaatatagtgaaatgttaaaagttagggaatccagatatggatgatataggagttattcatactatttttacaacttttcaaaattatttcaaggtatattggtcttgtaaaaaattttaaaataagggattcaagaccttcctggcctcaatcctgcctttcttcagcagcacctgcagccgtacatcaccccacatttaataccaagttatgtccaacatcctcccgctgtcgttcctgacgctgactgcacattagactaatctgagaaaatgctgaaatatgccaataggcaggcctctccccagacaatcagatcaggactcctgggagtttgctccagccatggttttttccaaaaacatagcctaggttgggaagcctggaggcctgtttcccaaacaccatgctgctgcattcctcatgccttggtgcctgctgtttccagtacttggagggtccttgtccacctcttcagtactgtagattcctattattttgtcaggatccaactcagatgtcgccttccttagtgaaaccatccaggcatcccacgccccacccacaggtagatcccatccttcccgcctcctgctatttatttctacacactctccttctacaggtttcccacactgttgtaatgctgtgtttgctctgtctcccaacccaccgcaaactccgtttgggaaaagtatatatcatgtttgcttttgtcatcagcatgagcctcacatatagtaggagtctaagaaatgtttactaaattaaatgcaaacaaggttatacttgttggaataaagttataacaaggagctatgggacacttgaggatgtgcactcttacagtgcaggcggcacttgcggaaggagatggagctcacgcagaatcgaagagtgaataaatagctaagtagtcgggcaggagagggaaatgggaacagcccgcctcttaggctggctggagccacgtggagtacgcgaaggagaatggccgctgaggccaagaagggagccagtccagacgatgaaggggaccaagagcgttagtcactctggaagcagagtgagcacctcgcactgcgctggcacacagatgcctctcagtcaagcattttagagaaataatgagtgaattcttttttgctctttttctttacatttggcaggggagtcatgggaccggattgaaactaactttcttcccagaagaatgtatttgcacatactttcccgaaaatgtcagaagatttacaggttttctgaaatgtattcagtgacacttcccccaaaatgatatgccacattctaagaagagggatatattttaggtttaagaaggacatggttagactaggatgtaaggcgggtcactgaaagtctgtgaaggacagattataggaggtaagatgcccattggaggacaccctttaagaagtcatcacagcgtggtggctcacgcttgtaatcccagcactttgggaggccgaggcgggcggatcacgaggtcaggagatcgagaccacggtgaaaccccgtctctactaaaaatacaaaaaaaaattagccgggtgtggtggcgggggcctgtagtcccagctactcagagaggctgaggcaggagaatggcgtgaacccgggaggcggagcttgcagtgagccaagattacgccactgcgctccagcctgggcgacagagcgagactccgtgtcaaaaaaaaaaaaaaaagaggtcatcacaggtgccaaagtgaaacccaagtgcctgaaccagaggcatgacagagctgtgcccaagagagaacagatgcaaaaggttacgaggcaatgcaaacagagagcttagggtgtctctaggctttctgcctttgagtgaccatgcagatgcagtgtcattggtcaaactagaaaattcggggagaggatcagatttgtgggaaaggatgaattccattgtgtgaagcttgagtttgggtttcccatgaaagaacaaggcggagtttccctacagaaagttgcaggttgggagtgatggagatgaggctctcctgatgagtgagtatagagtgtgatggaagaggagcactggagggaaaacctcagtgccccaacattttcaggatacacggaggaaaaagagccaatgccttacagagaagctgaaagaggggaaaggaaaaccaaagagagtttccaaaggctccaagagttgagtaaatcaaataagggcagaagtggtctgttcactttggtaactacgaagttcatgaacacctcagtgacagcaacttcacttcagtgaatggagttcaggccaaaatcaatgattaggaagtgaaaatgaggagatgagaaggtttctagaatttccccagttagattgggaaaatctaactggacctctgaacagcattctaacctattggtcagctcctctttcttgaaaaaccctttttccttggcctcattcagacctcgtgttcaaggggtccccggggtgccctaattacttcctctctgttcttcctttgcaagctcatttccctgtcccagtttgaaaagggtgacttctcagggccctcctgtcttctctcttcacacacttctcccagggaattctatccatgcttgcattgtaaataccatcataaaaatgattttaaaatgaatatttcagcccagacttttttggctctttgacttctatgcttccctgacacaaaggcacctcaaacttgacctgttcaaagctgaactttgttgttgttgaaacagcatctcactctgttgccccagctggagtgcaatggtgccatgatgggtccttgcagccccgacctcctgcactcaaatgatcctcccgcctcagtagctgggactacaggcttgtgccaccacaccggctatttttttcttttcttccttttttttttttttttttagcgacagggtccccctatgttgtccaggccagtcttaaactccagggctcaagcgaccctcctgccttggccttccaaagtgctgggattaccgtgtgagccacagcacccagccaaagctgaactcttgatacctgccatatccccaaccccaccaagattgcctgcctctgtgttcccataatcagaaattgtcaccaccatctatccaaaaatccgagtctgtcttaacactctttccttcacctttttaattcctaaacatcatcagattctgtccactctactactccaaaccatcattatatttattctgtcccattgcatagcctattcaatggtctacctatattccctcttttctctttccaatgcattcaccaaaatgcagccagaatgagctttcaaaactgaaatcagattatgtcacctttgcttaaaacctttcaggagttacccgttgctttctgtgtaaaaaccaaaatcctcagaataccacgacctttctatctagcctcacttcctactatggtctcccctgagggtttgtcatcttggcctccactacgttcatcctcgacattctcttcttcctcagagcctttgcacatgctcttttctcttcctagaatactttccctacccccgttaccagcaaaatctcactggccttcaattattaacttaaatgtaatttacgacctgctaaatctctgtcagctcatagttcacagatggcagttattacatatttgaaagaatggattaaaaagactgagtgctagccagaggaaaatagaggttcagggtaggggggcctttaagatgagaatgatttaaagcccacagcaatgaaatgatttgcctggccaaggtcaaaaagcgagttggtggcaaagccagggctgcaatccacgacttttgattcttggcctccccatgtcccacactaatcctttattatatgtcttagatgaagttagctgtagtgaagccctcatctcatttgctgtccccaaaacattctaacctgttgaccaccatgcacaacaggaatacgtattaacacagtttcaggagcatgacccaggaaattctataatagatgcaaactatcttcctgtttaagaccctagtagagttgttcagtggtgctgctcttaaattccaatccaagaaggccacccggctcccacacagtcaagccatagctgattgatgtgtttacagtaatatacttcacacttgtgtcttgtgggccacacgtgccactcaggataaacttagagatttttctttggcattttttctccattgtacagattcagacacttaaagcttattacatagaaactgacctagaagtgaccgggcctttggagagaatggcaggaaattggttacaatagatatggacccacctggggaaacagaactagcagaggtgaacgttaacccatcccaggtccaatgttgttagtccaaaaagattacagtaagttgaagaaaacatcaaacaaacagaataaaaaattcagcaaggaaattcagagtggtacacttggggagaaaaagcagattttgccaatgtaagaccaggagaaaaactggttgtgtttcagcattgcagtatcttgggagaataacaaaacaagtttaagcagagttgtgccatgcagattgcctggaaggaaccaggcctgcctgatgcagaatcatgatgcatgcagaggatgatgtccaaggtccccgggagcagaactccataaaattcacttaactcttttactaggtgactaattaaaaagcagttaatgagagtgatcattctgggcaatggaattcagccatgaaagtggttaatgacctgaggctgcagctcagttctatgcctcctctagcatggttctggctcccaggagagcctcctagactttagcagaagctgcacagagcttcaagaatccaggatatctgggaagaggtaggagagcgcattgggcgacagaaaggagtaagcaaatattaaagggtttatttacagcagaaggtaaaaagaaagaagctcaccacaatgggagctcaataaatgtggtttgcttgagcgactaccttgctgactgaaggagtggatagagcacgtgcatgaggcagcttgcacagtctgggagacctcgcttctcagctccttatttaatgacatcatgttggtagcttgaagtcggacaaggtggcagtattgacatcatgggaaataggcaaaaactataaatcagaatttttccctccccctcaagccagttgcttaacatctaccaacttaccattgggtcacttcgttgaaatccctgtgggagcagagttccctggggttcttaccttaagaataaacctgaaggcgttttggttttgctttcctattttaattactaatatacagtggcactcttcagtaatcttttattacacaaccagagtggctcagcatttgtgaagtctcctggcaaactcaccatcatttaaaacattgtttctgtggggaagttttccaagttgcaagttactgagtctaaaataaatttttggaaaagagcccatttgcaagttgggagctttcaattctgagtcctgataggaaagttagaaaacaaaaagaatcatgccaattttaaaaatataggttgcaaaatataggttgcaaaatcctaagtgaaaaggcaaaaggaatagaattatttaacttggagaagagaaagatgaagagcaattgaataataggagtgagtgccagctgttgtttgcttttggtttctgttttttgtgggtttttttttttctcccactgtaagcctcggggatttggttaaacaaggagataaatatctttatgttattattctggaatgaataattggtggattttatgtcaaacatctgcaaacttcttttcctcaatcagggataatttacatataacctgtgatgaggaccaagaaatagttaagacaaggttatttgtctacttgaaggttaactgtcaactttgtgaccctgagtccacagatggcataatgtatttcaaaactttgagaaacatgatataattaagcaaatcctttttatatcatagaatatctaaatacagaatttattatttttctatcaaaaatgattataaaacttagactattagcattatctatagtagtattatattgtctatatctgttagtattgtctattactagtatctatattactagtacaaaaccttaaaccaagcattctaaatcaatactttttgataattttacgagggaaatgatgctattttgggcttgttaatttagagttattttcagttattcattcagaagagatgagagaattgctttcttttagaatatcttttagatattgcagtaccctgatttggcattttcttaaagagatgtgaaacaatgaaatggcagctgtaaatctgccacttggagccttagagggcttacatcactcccaggctttgctttaacagttggtttatgatgtggtttcagaataacacttttgaacatggtatatcccttcctgcaaaactgacataaatccataaagcttttaatgatgtctctaaaatacagccaaagtagtctctgaggcatatttttggattgtttatctgaaatctctagattgctgaatctcccttcatgatctgccttggaatggctgtctccagggcagctgataaacgcatcatgtctcacccaggcggggaccactcagcttcgtgccccatcaggtacactaccctgcctcagctttcaccccaagcatctcacacccttgtgcgcataagtatcacctggggacctgcgaaaaatgctgcttctccagaacccctgagctaaattctgggactaggcctggggaccagcattttaacaggctcccaggaaagtggtcacagaaatgatgtgagagtctcagctctacatgctctctgactccagttctggcttcgggatggagtaactggagagaggctgacaggtggaagctgaggttcttgccggtgacacgctgcacctgtcactcaggtgctggggtctctgctgcccagacccttccctccctaggccaggttctgtgctcctcagtcttgaatttcaagcgcctggtatgcgtgtcttctcttgcacatcatcctgcctgccccactgtgattcatttgaatgccccagcctccatctctagcctgcctcccaccctccctccaagtcccaggtccacctcttctcacccccgccagagcctgttctcaggtaatgaccccccacattctctagcagaacctctctctgtggcaaactgaactgctcagtgtgttttctccaggcggcccgccctgcctgcccttcctgactcctcctccctcccctgtcctctgttagacacatttacagaagcctgtcctaggagtgtccatctgccccatcagactctgaactactgagggcaggggtcacctgtgccttgctcacgggatccccaacacccagctgaaatgtggtgggagcctcgggggtctcaagtgaatgactgattcttaaaaagaagcacgtgaagtttgtccaggcggcatgatgcctcagacttcagaccctctcactgccaatacactgtgccttcagctagaaagctagtcttcatctccgccacctacctgtacttggctacccacctctggccctccaggtcccagcttagatgtcttttcccacagcaagtcttccaccacccctgtgttccagggggccctgtgtctacctgatcctgcacttacccctctgcattctaataatctgtttacctgaatcctcctccaggtccggagctccttcagagcaagagttgtcagcacccagcatcgtgcccagggtgcagtcagtgctcaatagatgtttgctgaaagctaactcagcacatttaggtagtgagatggggttctcatcacatagctgctaaataaaccgccataacattcactgtattgtactcacactgttgatgcgtctcctcccacaaccactgctagatggaaatcttctcatgggaagtgattgtattttgttcatcttcacacttcagtaagtcaggcagcaatgagcatggattaagtagctgttcaatcctatgttttccaagaaggatagttttggcatgtggagcaggagaattctttttttatttttatgtatttatttatttttgagatggagtctctctctgcggccaggctggaatgcagtggcggatctcggctcagtacaacctccgcctcccaggttcaagtgattctcctgcctcagcctcccgagtagctaggactacaggcacctaccaccacgcctggctaatttttgtatttttagtagagacggggtttcaccgtgttggccagaatggtctcagtctcctggcctcgtgatccgccagcctcgacctaccaaagtgctgggattacaggcgagagccaccgcgccccgcccaggagaattcttaattgcataagacagccccacacattgcaggacatgctgctgtccttgcccgtgcccactaaatttcattggtatcccaatcattttgacaactaccccacctacacacacagttacaaaagttttgggggtaagaggaccaggaggaaaattgcactgcacatagttgaaaagctatagttaagtcttttccttacaacttggtgagaagcaatggactccgtaacagtgccatggtggattatatgtgtcaacataattaacagaaagaggatctctgaaatataagatatttatctggaaataaagcattgcaatgggaatatgcatgccatagttaactacatgcatattcagggaggtgaagacaaaagtttttaaaggaaaaaaggaggaggattacataattgttttaaaataattatccttggctacaaagatcaataacaagggtgacaccagtccaagtttggacaggcaaattcagggcagttgttcttgtagaaccgtttttttgtgtaaggttgcaatggtgtttgggcaatgttgtgctttttgcagagtctctgtgatagttcttttgatcaggcatttattcatggccttccccagctccatttctcagggctttcttttttttttttttttaacattagtgacttcattttgattctgacaactttcacacatgtgtgtggtgatgtgaggtgggggccaggacatgtcaccctcaatatacaacggtaacctgtctttgtaataatagttcactaatctttcctgagcacttatatattccgggcactaagctgtgtattatatagtttacttaatcctcacaaccacctatgaggtcccattttttagggacgaaattgaggctgagaaagtttcaagacattgacccaagttaacacggctgctacagacaagggcaagatacacccccaggcgtcggacttcgctgctctgtgccgacctctttaacaagaacaaacatcaaaattcccagttggaagactcctattaaaaactgtcctctcccattaattataacgtagagcagttttgcacaatatattctgcatagtgttaatttagtgggatgtcaagtgttgtgagattaacggttgcatgggcgatggagtgtgggaaatgctttcagcaaggcccttgtagaaggccgtgaaacagaaaccgtgaagaccacaggatccctaaggtggcacagcccttcacagtgagtcggagtgatttagaacattgctgagcaaacagcagggagaccggcaacaggagcttgctggccatgaagtgcctaatatccagtaagcactgctcaggctctaggaaaaggctgatgcaggaagggtttctttcttctaatttctcaataataataaaaatagatactatttatggagtactaattactctccacttcatagatgaaataccaaggcctagaaaaatgtgttaagtaacttctcctaaggtcacacagctatttagtggcagagccaaatttgaacccagttctctctaacttcaagacatgtgattgtaaaccctatacacaaagtctctaaggacgtagggcttataaaggctttcctgtatgaatatccaagcaaattcagtctcaaagaggatgcccctatgggttccctgtaccagggatttatttttggcatatctcttcaacctgacaattcgttccttggtctgagtacatgaaatttttttcagggtatgtgaatttttttcttggtatgtgaaatttttttctggtataatgtaagtttcttaaattttactatttttttaattttatagatttctatatgatatggtttggctctgtccccaccctaatttcaaattgtagttcccataatcccctcatgttgtggaagggacctggttggaagtaatttaatcacaggaggaggtctttcttgtgctgttcttatgataatgaataagtctcacaagagctgatggttttataaatgggagttcccctgcacatgtgctctctcttgcctgccgccatgtaagacatgactttgctcctcctttgccttccaccattattgtgaggcctccccagccatatggagctgtgagtccactaaacttctttctctttataaatcacccagtctctggtatgtctttattagcagcgtgggaacagactaatacatcataccctgttacatgctttttttttttttgataagagtatttgtgttgatgcaatagcatctttctccatagaacttactcagatgcccttcctggagccagtgcctgcactccatgaactgctggagaggtcattgtagggtatcggcatcagacctctcctcatttttcaattctctctctcctttataacagatgttggtgcattttttgaagaagggatgtggctacgatataactttcaggcaccagcaacaaatgccagagactccagcagcagagtagacaacgctcccgaccagcagaactcccacccggacctggcacaggaggagatccgcttcagcttcagcaccaccaaggcgccctgcattctcctctacatcagctccttcaccacagacttcttggcagtcctcgtcaaacccactggtaaggacaaggatacccagcctctgccatttaacatttgggcagacagaatgttctagcaagagtctatagattgttcttggtttgttatttattccccataggcttttttaagcaagtcacataacttctttgaaccccatttctctccatgaatatcaggaaaacaacttgccagctgggtgtgttagagcaaggtgttagagtaataatgttggtgaggcatgttgcgttctttacaagaatgctgttgcatgaataagagatatgtttgcatgtgtaatgattattttttctccctactaaataaacacatttggctggacactgtggctcacgcctgtaatcccagcactttgggaggccaaggtgggcggatcacttgagctcaagaatttgagaccagcctggccaatatggcgaaaccccatctctacaaaaaatacaaaaattagctgggtgtgatggcacatgcctgtagtcccagctactcaggaggccaagatgggaggatcacttgagcccaagatgtcaaggcttatagtgagccatgatcgtgccactgcactccaggctgggcaacagagtgagaccctgtctcaaaagaaaaaaaagactaataagaaagactaataaaacataaatacattcactaaatgtgctaaacagagatgggctttgaatgagtaaaattaattttacataaattaattttatcctgatttatgatagtataccagtaggttgttacagaacatctgaactttcaataggagtagaaaatcagaaatgtcttcattcccaatcctctcagaactttaaattcacaaagtgtatccctgtcataaaggttgcttaaagcaggagtttattttaattttttttgaaacagggtcttgctttgttgcccaggcttgagtacagtagcaggatcacagctcacttcagccctaacctctcaggctcaagcgatcctcccacctcagcctcccaagtagccgggatcacaggcacataccaccactcccagctaatttttttaattatttgtagagttgggggtctcacgatgttgccaggcctggtcttgaactcctggactcaagcgatcctcctgccttggccaaagtgctgggatgacaggcatgagccaccatgcccggcccaggggtgtatttttacttgtaatatcctgggccatcttggtcgtcaaacacacattaagccagagaggatctgagtgcacctaaaattggcatcctgaggagaatatgcaaatgggcttgtgacccttcagcagtgacctctgagagacatctaagaagccctggagtgtacaaacttgctgaacttgagaagtccacttcctctctgaaaatgaactcatataccttagaattctaagatcactcttttttttttttttttttttttttggagatggagtctcgctccatcaccaggctggagtgcagtggcgcaatctcggctcactgcaacctccgcccctcgagttcaagcaattctcctgccttaacctcctgagtagctgtgattacaggcctgcaccaccacgcctggctaatttttgtatttttagtagagacagggtttcacatgttggccaagacaatctcaatctcttgacctcgtgatccacctgccttggcctcccaaagtgctgggattactggtgtgaaccactgcgtcagccctaagatcacttttttaatgaataaaaatattttaagagcatgcaggaacaaatctctctaactcacttcccattggagccgaaaatatggagactctctctcccactgcccattgtttcctgcccttcagtgattattccactgttatggcatcttaaagagcaagaattttggctgggcactgtggctcatgcctgtaatcccagcactatggaaggctgaggcaggaggattgcttgagaccagtagttcaagattagcctaggcgacatagcaagacaccatttctaccaaaaataatttaaaaattaactgggcatgaaggtgcacacttgtggtctcagctgctcaaaaggctgaggcaggatgattgcttgaggccagtagttcaagactagcctgggcaacatagcaagactccatctctaccaaaaataattttaaaattaactgggcatggtgaggcacacctgtggtcctagctactagaaggctgaggggggaggatcgctggagcccagaagttgctggagcccagaagtgcaaggctgcagtgagctatgatcacgccactgtactccagcctgtataacagagcaagaccctgtctctaaaataaaataatttaaaaaaaaagaaaaaaggagatcaagatttttcccatgggagctagaactgttattactaacttaattcagcttgagttttaaaaaaacagtaaattaaactccctctctaggaaatgcactgttgcttaaaaagatggaggaaaaagtatgttccctagtattttccccttctgaaattattcctaaagaaataagccaaaagtcaaagattcatcatgaagatgttcatcataatgtttcgttttgttttttgagacggagtctcgctctgtcgcccaggccggagtgcagtggcatgatctcggctcactgcaagctctgccttccaggttcacaccattctcctgcctcagcctcccgagtagctgggactacaggcgcctgccacaacgcccggctaattttttgtaattttagtagagatggggtttcaccgtgttagccaggatgatctcaatctcctgacctcgtgatccgcccgcctcggccttccaaagtgctgggattacaggcgtgagccatcgtgcctggccaacatcataatgttaactatgaaaataaaaattgaaaagaatctgaaagttcaacttttagtaaaatagtaaaagagggagttgccattttatggaatattatgtatctattaaaatatttatgaatcgtgattaatgatatggggaaattttatgtatgttaaaccaaaaaaacatgaacaagatccagccttgaatgtgaaatattagctccataaaaaatatagggatagaaaaaaaaaagcaataatgtgaacacaaaagtgtttggttggattgtggatgatttttttttctcctgagcagtacttttgtatgcatgtcaaatgctttaatcagaaagatgaaaacagtaagtaaaatcagaaagtgaggatgaaagagagagaagtatggagcccctggtcttcaggagttcatcagtttatttctcctggatcagggtcaataggtttttttgacccactgatgttcactacccacatggaccagcctcccactgggcagataagaaccttgggtttcttctcaggtccctccccaggaggagggctctcacccagagactgtcaagaagttggtgaacacattcccacacatacttttattgtctgctcctcgagtcactgccacactagatttggtcctcaactgtattcgctacctcacatgcccactgctacacacccaccgctgctgtgccttcatcacctgccactgctgtgccctcatgcctgtgtgaggactttcattgtcttcaagggcgttgatcaatggattctgtattaatggccaccatttaatgaagctcactttgtgcccaaagccatcctgaatggtgccatgcattaattcccatgagctgcacaactctatgaagtagatactattattatttcctttctactgatggcaacacatgagtgcatggaggttgagtgccttgcacactcagaggatgttgggccaggctggggtttctcagcctgggtgtccgattccagacccaaagctccccaccggctgtactctccagggcaggcatctctggaactctcagtgttcttggaaggcaaagctgggtgggttctgtctcactgttacaagactatcctcaaactgctggtgaaaattcagctttttcagacttcaaatacaacatgtttttattatttgaagtttaaagttagaaaaaaaaggaaatcattaggaaaaaacatcagtaaggtctacgccaaagtatcaggaaaaagctactagaaagtctccactaaacaccctggcatcactcacatttcacatatcgaaagctctgctcactgtcctccagaaccagctgcccccagcaccaccactgcccatcagacacttgtgttcccaaggtcagtgtcactcaccagtgctccgttcttccctgcttttgtgggtcacccaggcaaacaagtcctgtgaattgaactcatggtgtccttttcctccccaccactactctctgaggcaaatatcttttaattcccagtagtgtttacgtcatggtgtccatagaaaattattatatttgaatggtaccagggtaaatggatgaggtcatgttttggaggccacctgcccagtgactccagctgccatccccttcttcatgtctgccacggtgtgaggggagccttgctcctggtaccccatcacccatctgtaggacagccgtgggcttcagcttgttggctgggaaattctctcccaatccatctctctgcttccagattctccccctcaccctttttcaccacagccagcaccgcctgcctttatagggtgtcttattttctgttgcttgtaacagaatacgtgaaactgggtaatttataaagaaaaggaatttatttcttatagttatggaggctaagaagtctgaggccaaagggccaaacctggtgagggccttattactggtgggaactctctgcagttctgagacagtgcagggcatgacatggcgaggttaagctgccagctcaggcctctcttcctcttcttatagacagtcccactcccatgagaacctgttaatccattaacccattaatccatgaatctatgaatggatcattccatgaatcgatgaatggatcattccatgaatcgatgaatggatcattccatgaatctatgaatggatcattccattcatgaggacagagtcctcatgatccaatcacctcttaaagggctcacctctcaatatacccatattagggattaagtttcaacctgagttttggaggggatattcacaccatagcatagggatattgcttaaaagggatcttgtataatgtctttattaaacactcagtggtgccccactccagcaaaaccaggagagactcctcagtgccacaaacttttaagtttgagacccaccaagctcatgggtgagatggtggcctgtagagctggaccgtctgggtttgaggtcggctttgccttttgtcagttgtcttgggcaatcagttggcagctccatgcctctgtttgctcatccataaaatagtgtctccctcacaggagtgttgtgaaactcaaatgacaatatgcatgtgtcaacagttattatttcccaggtccacggattcaatctacattctaacgcatattcagcaacccctactcttcgttttgagaaactcattacccctcaagcactctgtggtcatatgtgcacctgactttatgcctgcaatactcccttacctagaaatgccccaacttcctctctagccagacacctgcctttcattctaggctgagatcaagtcccacctccttttgatgacttctccttgctttaaactcctattccacttactttcaatgtcatttgtttggcatttaatgtactgtattgttatctgtctctgtgataaatatgccctgtcttcccagagagatgaaaagctcccagcactacatctcctgcctacgatcagtaccctgtaagtgtgtgctgatgataatgatgatgaccaggagagaataaatctgttaagcatgttatttgctgcatccaataaaagagaagtcccttataactgctttaattcacttgggagatgaacatgagacacagaagtgaagcacctcagcatttgaataatgttttattttaatggacaaatactagcattcttcctaccatcatttagcggtcctcttctgctgttatctgaaaggaataaatacatcatttaaattggattattcaagaatatcaccattactgtttatagatagtcactatatataaatttaaagttccaactcatctttctttctcaaagccaataatttctgctgccattaagtgaagcagttataggaatttaaaatcatatttacaaagtccaagaaggacagaaaagaaaaaaaagagaaaacaatgctgattttaatagagctgaggaacataaaggggccagtgacaaagtgacagcagagaggaaaatgtccagcgttttgcataattgccggttcctccgacctctaggcctctgtgtgtttgtatcctcagagccacacacatattgcctgacccatgccaggggatgggcatggctgtatgtgttataagtggactctacacttgtaaccaggcagaaagcctattttcagacctttaaaaaaaaaaagctgtgctttgcacaggaactaaatatatgtgttctgaagaaatgaataagagatgaatcaaggcagctgtatatttaagaaaactggctgggatgatatgatgtcagagcaccagaaataaggcagagagtaaaaacctaagacaatcaacgtgttttttctgcgtgttgccaaacaactgcctgatcatctccgtcattcccaaacaatggactattttaatgctattgggtaaaggaaaaaccgagtaaacactgaggggtggagagagaagcagctcaagaagtaggagcagcatattcaaaggccctgaggtaggaggagatcgtattttctagggaataagagaagttcgtggtagtttgaatgtaaaaagtgacagtgagtggtatgacttgaaaataaagtagcaggaggaatgcacatcagacagggcattgcaaccgctatttggaaagtacatctttattctgtaaagaattggaaggctttgaaggattttaaatgacccaataaaataatcagttacacattttgaaaacatggggaagaagacggtacagaagcagggagactgtattcatctgttctcacgctgctatgaagaaatacctgagactgggcaatttataaacgaaagattttcattgactcgcagttccgcatggctggggaggcctcaggaaacttacagtaatggtggaaggggaagcaagcacgtccttcttcacatggcggcaggagggagaagtgcagagcaaaggagggaaaggccccttataaaaccatccgatctcatcacaactcagtcactatcatgagaacagcacagaggtaaccaccctcatgattcagttacctcccactgggtccctcccatggcacatggggattatgggaactacaatttaagatgacatttggatagggacacagccaaaccatatcagagaccattcagtcatttattcaacaaatatttattccactcctactgtgcatcaggcactattctagacattgggaatagtcataaagaatagaaacaaaaattcttgctctcatggagcttatctttgaataggagaagacagacaataaacaaattggtacaatctatagtatgttgtgtgctaagaactgttatggggaaaatatgaggcagaaaagggagggcctggccaaggggaaggagagggtaaattccacttttaatgaggaagtcacagaaatgatcactgagaagaggacatgagagcaaagacctgaaggagtgagggcatagccatgcagagacctggggaatgagcatcctgaacagaagaaccggtgactgcaaaggcccttgggtaggaacaggaagccaatgtggatggtgaggagtgagcaaggaggagagtaacaggaggttaggtcagcaataatgaggagatcatatggggcctggtgagccattgcaagaagtttgatttttactctgagacggggagttactgggattttgagcagaggatcactctgaccaccgtgtggtgaggacactgtgtatctcagggtcagaggcccagtgggatcagggaaggttggagaaaggacaaaagctagtataatcccagcaaaagacactggtggcttggtccagggggtagagatggagatggcgacaagtggtaagattcagggcatattttgaagatcaagccaagaagacttggtgtcagatgacacatgtcatataggagaaagaggacagtcaaggcttttggcaagaataactggaaggatgaattggcaattcactgaaatgtggaaaactgcaatggaatacttttggggagagaagatggatgttctgttgcatatgttatgtttggggttgccagtaagatatctgagggaaaatatcaagtagacagtttgtgaaagagtctcctcaatgccactgtgtctcctcaaatgaatgtgctgaaaagttatttaactcactcttagtaagaaactactcctagaatttattcattaattttcaaatgataatttcacacttcttgactggaatatcattttgaagattgctgataagtacaggtgtttctgtagcttattaataaaaatatgctattattaaaaaaaaagagtctggagttcaagagagaagtctgactagggtatgaatgtggtgtctgatgggcatacaccttattcaaaggtcctacataggataggattgttggagtaggtaggtagacacacgagcagggcagaagagggtgccccctcccaccaaccaccaagaatgtcagacaaccatcaggtgatggtcaggcagttgctaaactgtctctctctaaaatgataattggctgcagctggcaccaaggaacgaccgtctcccaatagatagaaaacatctggagctggtgatcagcagcttcccaatcagatctcaggagttgggcaagcgggcccaagcatgcacactaagaggcaaaatgatggagtttaacgggtatatgaccttcctctaggaacactcaactggaaaggggaaaaaaaatgcctcaaatgagcatgcgcactacttcagtaaacacctgtgcatgcagcccctcccacgtgctcgcaggccactgcgcatgcagacagcccgccccaagggaagaatcaggggagaagaaaccaaaccccagaactatgccaatgtataaaaccccaaatcaagggccaaacagggcacttggatctctcaagtcgcccgcttggccctcttccaagtgcacttcctttctaaaactttttaataaactttcactcctgctctactaaaacttgccgcagtctctccctctgccttaaacctacttctgcccctcaagccgcattctttcctctgaggaggcaaggatcaagtttgctgcagaccctttgggattttccttcagtaacaggatcaccatggaaacaggcctgaatacaaaagagaatatgcttcagggctggtctttggggactgcaagagtaaggtgccccaaaacgaggggaaaaacaggtagagaaggaaaaccgaaagagtgtgtgctggaagccaagtgttcccgggaggtgaatgaattctgtgccgagtgaagatgaggcctgagagggacaattgcctctacttccccaagggtcacgggcccagcaagagaccgtggagcagggaagacagaagtgagacagagggctcatgctaaaatagggacgggtttggaggcagcaagtgtacccatctcttttcatggggttcggagcaaagaaaagcaaaggataagaggcctcacttgagagtgaaatgaggtcaagagcagtaatttttaaagaggaggctgactaagacccaccatcttctgcaatccaggcagaagatggtgcaggtaaagcacaggtgaggatgaaccaggagctctgtgtggagctgcctcagccagggagcaggctccctctggaattcacacaaggacactgtgggtgccaacagaaagcctgtggttaccgaagtggaaaagagtgagggaatttagatagatttaggagacgaaaatccaatccacggtgcttagttgaaatgccaggggcaaaggagtctaggatgacattctaaggtaaaactcagaaatagtgaaggtttgttgaatttcgtttagaaaacaaatataggaaatgtaattagctcttgattattctaacaaatgttcctttgaaatccaggaacatggcaagtgtaatgttaggatgcctaaataaggaagagcacagcgtgtgtgtgtgtgtgtgtgtgtgtgtgtgtgtgtgtgtgtgtgtgtgtgtgaaagtctggaaggagctactcccaagatgtttagaaaaattatctttgggtggtgggatttcaggtgactttcttttattttttttctgtttactttctatgttttaattagcatgttttattttgtaacttaaaatcagaatatcagttttgttcccctaaaaaggaaatgaaaggtgacaaataatccattaggtgatttgcagttggtcaaattcttgctagattgctggctccatttttaagctctgagatatcaacatgaaaattccaatttgagtaacaaatgagataaaatattgatgtctttaaaactcataactaagatataatatttatgcttgcagattaactaaaagcaggatctacattgtcatattagttattttcaatattgttttttattgttgggacgaagcaaggaggaaaaaaagaatatactgttgaggcaaagtgaactatcattgagggcaaaaagggactcaggggaccagggaaagccatctttcctgttgatttgcatttgattagtctgtaagctaaaataaaatttattacttggtctcaatgaggccacccaaaatctcatctttaagaactatgtttggccaggagcgtcggctcacgcctgtaatcccagcactttgggaggctgaggctggcagatgacgaggtccggagatcgagatcatcctggctaatacggtgaaaccccgtctctactaaaaataccaaaaaaaaaattagcccagcgtggtagcgtgcgcctgtagtcccagctactggggatgctgagacaggagaatggcgtgaacccgggaggcggagcttacagtgagccgagatcgcgccactgcactccagcctgggcgacagagcgagactctgtttcaaaaaaaaaaaaaaaactatgtttatttttaatattgtatgctcatgattcttttatatgcccaatgtcacactttgctgacggggtgagaacatccctgcactctgcatttatttttttatttcacatagtgtttcgtgggacctgcagatgtctcctccctgcagtcctatattgtatatgctctcattctttgtgtccaggcataatcccaacttggatcatttaaactatttgcatcttcaactttgagacgacagtcactgaagttcactgtgggcagattgtaaatatgtgcgagcctggtgctgtcagccgatatgggtcagtaggcctctgagctcgtgaatccaaattcaaatattgaatgttatctgtggacatcaagggagggagtaaagtttaacagaaattggatgggcatggtggctcacgcctgtaatcccagcactttgggaggctgaggcgaacggatagcctgaggtcagaatttcgagaccagcctggccagcatggtgaaacccccatcactactgaaaatacaaaaattagccaggcgtggtggcaggtgcctgtaatgccagctactcaggaagctgaggcaggagaatcgcttgaacctgggaggcagaggttgcagtgagccaagatcgcaccattgcactccagcctgggcaagagcaagactccgtcaaaaaaaagaaagaaaagaaaagaaaggaagaaagaaagaatctaagagcaggaattgaggggatgtgacattaaaatgaaatttagggcaaacaaattactgagctttcttttttcttctataggaagcttacagattcgatacaacctgggtggcacccgagagccatacaatattgacgtagaccacaggaacatggccaatggacagccccacagtgtcaacatcacccgccacgagaagaccatctttctcaaggtatacatacatgtacatataaattacatataatatcgcattatagtccctgtccctataatgcttggccattggttttgttttgaggggatagaagtagaagagatgctttttacactttctcctacaagtgcataactagtgaagtagaaatatatataattctgacaaggaaagacaatgatgaagttgaagacatcttttagggggaaatagaataaatgtttattccgtatagtctttctggttttcccagttctagatccacatatctatcaatttactgcttttatccattgcaccatctttcttcgccaagctctcagacatctgaaacttaccgtgtttcccagcaaaggttattttggtttctccgacctacttctttcactgctccaacacaatacaaagagctgtatttttctctctctctctgcagagcctttgtcttaaaaatcctcaaaacagtctttccccagaatctcagactctgactgtgggctttcggcacacaaagggatggttttattatgacactcaaattttacttcaggttcattgacgaccccggccctcaccactgatttttacagtgaagaaaccagcttgggaaacaccatgaataaaacataatgtgaggaggtctccctgggagctaggccaagacatcaaggatgggaactgtcactgcattctctagaaggagttcaaaatagatgcctgtcaggagaaagaacagcaggaggatgctgttttgtcagtaaagtggagtgtcatttggcaggggttcagcagcctctcagacctcattctgattcggctggatgctgtgggaagttcaggttgcaaagaaaaggcacaagccctatctcttttgagcactggtggatgtcagattcataacttgatatggagtttgcgcgtggcctttagcagtaaatgctagagggcattttaaggagaggcctttcctaggaaactgacatgcactgtttcagcttactgcgccatcaatcaaaggtggcataataaggttctctcatcatggtcgacagagtcccagagcccagcacagtacctggcacacattaggggtgacaaattctttatggagtaaaccaagcccatctttaaccaagttttagtcagaaaagccagcaagtccaggagacagatcgttttacatcatttcatcaacattgtctccctcggcttttgattagagactttttccattttaagccacccaatttgtcacctcttttaaagaaagtgacttatcttgccattttaccattgcgaaataatactaaaacttaaaaagacctaaacaatggcttttcagacagtataacagcagagacccaccacagccatagaatcgtatacagtttaccctcactctctgccacagtgaattagagaaagacttgaggaaggggagaggagtggatgatttttaagacttggggctttggaggcacagaaagccagagatatagacagtggagcagccagagacctgcagagaatccaggggatgaatgggtttgggggagggtctggttctattgcccaagactattttggttgcaaatgatagaaaagcaattcagaagtaatttgttggggaaaattcctagggtaggtcatagaattatagaatttgaaaaagataaaaccaaactttgggaagagaatctagggagcctggagaattaaaactgtggactagaataccactaggtttctctctcccttccttccttccctccctctttttcattctcatctctgcctctctctgaagactggattaattacctcttactgcatgctccatctttcacatatcctaggccatagtcacaggagtactgggctcatgtcttcccaattttgttaccggaagaaggggtcctagtttcttgacactcattttaaaatcccagggaatctctgataggcctggtttgagtcacgtgctcaccttgttgggtggaagggggaacaaagacccatagtccctaatcacatctcttgattagagtggggaacttgggaaactccctcaaaagaacagaatgcagttccagaaaaaggaaggagataggacgacaggagtgaaaattttggatgcacgattctgaggtaggagaggagaaaaacctgggaagtgcttcctcgattccgccctaggttctgcacctggaagtgttgggagatccagctctccctccttctctgtcatgtaatgtaactgactgcagtaagatttctgaatgtcccaacccacgtgagggcaactaggaaagatgtcacggcctggggagctccaatctctcagcccagcctgtcccatctaccctgggacctgcccaccactgagggcaaaaagaaagtaaagatagaggtggtggaggaagacaagatgtagttcctccttatggaaaagcagatcccagggcttctcactcccatgccccactttctttcatgcagggaggccttgcagacgtggaagtaattcggaaagtgctttgcaacaccaaataacactgcaattttttcttaaaacaatctaaaaatccatcttgagaacttctacagcctcaactgtgtgtggaaagagatataataaaatgttcacagtgatcatctgtgtgtgaagggattatcaatggtttgatttcctctagagttttctatttccccattttctattataagcacatgctgcatttttataatcaaacagaaatatgaaacagccatatattctcaacctattctggtagtccccagttataataacatatgataacaaaggcatttcaataatttcaaattaatatttatttatttatagtcaaagaacaaaaataaggctaatgcaaagatgaatggtagatcacagtgctgtggaatgatgtctttggaattaaggtgaatgttgatgcatttatacatgctcaaacatataatttagatgatcctcatcagtgtttatggtgtctttaaaagcaggtttactttcgtagctgggtttggctaaagctaacattaaattaatctgcattccctcagcacacaccctgtgaaacagcactgagcacttgagggaaactgaccttggatgaaacatttgctgccaaaagacaaagtacccagtctccacatagataacagggaactgactgtagtagttatcagacaccagcgtgaaccagaacccatggcatacctccagtggcatcatttgtgaaaactcacagtcgcatcagggagaatagcttaaggcttaatgccagtcaaaatataaacaaacaaggtgcagccagagagcacctgaaaaagtctggcatgcagtgaaaaattatgtcaattagcatgaatccaaaagcgaaacattctaatcaacaattccaaagccttgtgcaactaaccctttcttcttcctttccttccttccgtcttgccatccatgtttcttttccttcctattttttcctttctctcttcccaaccacattgcacaagggatctaagggggtttacagggagaatattaaatgaaatagagagttaatggaagtcacaaaaagtaagtccccaagatcgagaaaatagaacatgattatcaggtcacaaggtcttaccacttggataaatttgactgtgaacttctcggcagccagaagtatgcaacccataaggatgaactaagccagttcctcttgagaattgaaccttttgttattatatcatttttattttatttaattccatggattgtatttactgacatagaaaatgcccatagcatactccacttatacaacatcacatacacgataacagctcacatgtattggtgcttactgtgtccaaggcaacgtgctaagcactttagacacattttctcatttagtcatcacaaaaactttatgaagtatgtgccatcattattcccatctgatgtgttttggaatgtgtccctgtccaaatctcatgtcaaattataatccccaatgttgaaggaggagcttggtgggaggtgattggaccatgggggtggatttccccctagatgttcttgtgatagtgagtgagttctcatgaggtctggttgtttaaaagtgtgtagcacctcctgctttgccctcttcctccttctcaggccatgtaagacatgcctgctacccctttgtcttctactatgattgtaagtttcctgaggtctccccagccatgcttcctgtacagcctgtagaactgtgagtcaattaaacctcttttctttataaattacccagtctcaggtagttctttatagcagtgcaagaatggactaatataccatcttagagatgtggaaattaaagttcataaagtaagatgcaacctgcccaaagttagaaagcggtaaatggccacagcatagtcgaacccaggtccgtcatacttcaaagtgtacacaggctcttaaccttgcttaatagacagatgtctggaaggatgttcacaaaattttagaagcagatacctctggctggtaagaaattaagtgatgttactgttattaccataagatagttcaaaatatgcaaaaacacagagaataataaaccatatgctatgtacccaccattgaaacattacaaatttcgacattttgccctatttcttcagatttttttaaacacagcaacaattaagagtctgttgtcctcctggttacatagtgggccccaataaaagtcagagtcaatgccctcagcagcatttctgcaaatgtatttgttacaaggctgttagatgctgaagctccttgggaaagtaaagcttcccattttgaattcagcccaaacaagtctgtagagagtgaggtagagcaggatgatggacagatgaagaggccaaaggctgagatgatgcagctttctgaaattttgaactgatcctaggataaaactagctggaaaatgataatgaataaactacatgttctttgaataattatccatgacaatcacacatttttgggtttagatgtgagttagacaatagagagttcagggatatattctctggcacagatactcggaatccatattctctacaaatcaaatgaacagatggtaaggatgtatcattttggctttcatctaactagagggccatcttatctttgccaagaagaagctaacagattttctgcaagcaaaataaggcctttcttagaaaataattctaggtcctcaggaacaaatgatgattagatccccaagttcttacaccaaaaagaggatgactttgattattttcactgggaattttcaaaacaaatgttcaaaaatatcactgaattctgttctttaaaataatataagcacggtaatttcttacctgctactaatctgaatttcaaccaaattgtataaaaacaattgcatcaattgttaattgaactaggtcctgtatataaatcttaagaactgtcagagaagtgtcaaaaacattagcaacatgtagtgtgctaggtgctagaagtagaagaaaggatacaaatattaggatgatgccagttgctatacaaattagccctcaaatgtccatgttttaacccaataaaagtctgtcttacatcagatatattttcagaaaaggaaagttctctggtctccagcagtgatgaaattgtgctgggcaggcactctgaggacctgccactgccaccaacttccctgcttccccaaccctggattaggccaaattattgtccattattcttgaagccctcctgggctccatcctctgggaggctcttccttgtgtgtgttcagccatggcctcccctgaattatgtgccggataatgtgctccttacagctgtgcagcaattatttttttttttttttttttgagacggagtcttgctctgtcaccaggctggagtgcagcggcacgatcttggctcattgcaacttccacctcccgggttcaagtgaatctcctgtgtcagtctcccaagtagctgggagtacaggcgtgtgccaccacgcccagctaattttttgtaattttagtagagacagggtttcactgtgttagccaggatggtctcgatctcctgacctcgtgatccaccctccttggcctcccaaagtgctggaattacaggtgtgagccaccgcgcctggctacagctgtgcagctttaaggcccatttcctgcaggttcaaattacactaagggttttttacactcataagccttttgtggactagatctgtgctttcttttccaatacaattccctcaaaacccaaggtggcttctgatcaatttgcttctggtaagtttcatgtgctggtaaatgcaccctaagctcttccctagacatcaatcttagacttactcaatcatttgcctccaggcgcccatgcctctctctctcaaggtaatggcagctactttggggccagtggacacaaaaggcttgggtgggaagtaaagacccttaatttaaatgttacccgtgaggctaagtcagtttgctaaacagaaatcttactgccccattgttggtcaaagcggtttgcagtgttatttcttactctctagtgtaaggctctaaatatctagacttttttctattcttttcattgattattgggaactggtcaattctttcctgaactcatctgctccatgacatgaggagcaaaaagcaactgacacacacgaccattctgtctcttttgaagaactttccttaaagctacttaggcatttagtctgccttccaggttatgtgaggtgacagttttacaaaatattttattgcatactatattagtctgtcttgcactgctataaagaaatacctgagactgagtaattcataaagaaaaaaaaggtttagttggctcacagttctgcaggctgtacaagacgcatagcagcttctgcttctggggagacctcaggaagcttagatggcagacagcaaagggaaagtaggcttgtcttacatggcaggagcaggactgagagagagtgaaggtgctacgcactttcaaacaaccagatctcatgagaactcacatattatcaggagaacagcaccaagagggtggtgctaaaccgttcatagagctctgcttccatgatcccatcaactcccaccatgacctcattttggacactgggaattacaactcaacatgagatttgagcagggacacatatccaaaccatatcacataccattcttcctctgtctttcaagtccctaatattcattcctgcaccacctgccaccttaccacaaagccaatgctacatgtgttaggtttctgttatagcagcaccctgccttaagataccaatgtatgtattcgttagggttgtattcgctgctataacaaaaaatcagaggcttaatacaaataactttctttcccacataatagtaaaatgatttctagttggaaatcgtaagcaatatataaataggctgataaaaaaggtgtttgtactaatgtccaaaaataatagagtaaaagacattgtggttctatgctataactataaggctttgaaggaaggataagatgttaacctgtgaatggggggcaagagaggacatggaagaatatttattatggaagagggagaaggagagggaagatgtgtgttccaaaagagaacatgatgttaaacaaagatgctagcagagtgactatttcatagatttcatcctgtctctatctcatgaatagaaaagaccactggagaagactcagtaaaaagtcttacctggagaaattctcactctgaaatatgtaacatcaaatggtctgaagtcatttatgaatattgaatgctgtaaagtcagtagtctgaggcacatgcagagtggtgtcaaaaattgttggaagaattttatcagcagcaaaatgagagtaattcaattatggactcctagggcagcaccaaatgttaattgacgtgaaacattggtggccgggggagccctagttcaccactttctatatgtggaaaagtgtacaattgtaaggactttcacataacctcctcaagcccagagaaaaatctctgtagacttgagagggccttaatgatcatgttaggtagtgctcaaagccctttcttacatatcgaaatgcttgcccacattgccattctcagccttatgaactggaaatagctggtgctattagtcccattatatacatgagaaaacagagattaagaagtcccaggccaggcgcggtggctcacgcctgtaatcccagcacttcgggaggccgaggcgggtggatcatgatgtcaagagatcgagaccatcctgaccaacatggtgaaaccccatctctactaaaaatacaaaaattagctggacatgggggtgcacgcctgtagtcccagctactcagggggctgagacaggagaatcgcttgaacccgggaggcagaggttgcagtgagctgagatcgtgccactgcactccagcctggtgacagagcgaaactccatctcaaaaaaaaagaagtcccaatgatgaataaggtcccagtgctcacaagagacatgatcttctctagaacccagctaaccagaccccgtttccccacttagtttgctctttgttgtctttgcaagtgggcaagagaagcaagctcactcctgttcatttgccttataaacttttgaaattttttaaaaatgtttacgcaaaattaagtcttttgaggatttgtgttttctttggagtcactaaaagcaatgactttatagcgtttcgtagggggtcataaaaccctaatttttataatcaaagagaactacaaggtccaacgttaaggctagtgtttttacagcacacagtatcatacacccataaaaattccatctcattctttaagtaaatatgaacataacctcttgtctgtccattttaggatccttcttttctgtagaaacatggagcccagactgaaattagatactgaagctcaaataaattatttaaaaatgtgtgcctttattacccttgaactttctgccaataaagaacaatactaacaagcatatggatgtaaacactcctaaaaattttactatcagaagttgttcatgcctttattaaggaaaataacacagtttggaagcactaaattttttagggatgtcagaacaaataaagaaagttgacctagctagcctagggcactgctcttgaaattacatttactgtaactccttccctttggctaatttagtttttatctactctggatgataaactcacagcctgggttgtgcaatacaagcatgcttgacagaaggcaggcaattgcaagaataatgatgagccatttgaacactctggcttcttcccttccagaagaacttttacctattatagcactggctctctattgggattcttagcaagtgtattagcacttaactttccactttaatgaacgactgacatgtataattctatggagagcataggccaatattttattagtttctgatagtattacaatggtttgagtctattgaactgatatagaagatctatgggaagagaagagagagggctacatatattgggaagttgcccattaatttggtctgtatatgagtcagaattcattttttcttctatatttctatgtatccagagaagcctgttcatgattgagagacacatcaaaaacctcatgacctcattagcttttgtaatgtcgcctctggttttgggttgagctatggctcctcggcccctgagaaagtatttgagcacgttttcattatttggttcagaaagtagcagtatttgacaaaatgtttctgaaaagaggaaacaagatgcccaactaccagagcctcagattcctctccctcccagtaccttcaaaccagcttgaagttttaaactcaggccacctccacactgagaggtctggccagcccgtatgcaaggacatggttcctaggagtgtggtggaggcgtgtggtgaagatcctgctgaagaagacagaaggttctcaagatgtccaggactcttctgttatcaatgtacttctcttctacttaaagccacatggggtccctaagaatttaacatgatgatatctaattgacattctctcttacccctgcctaccactaaacccaccacatggtgagaaagttccaaacagcaatcgtttctgaagcctgatttggataaaaccagatggtcaccaaaaccattccattaggccatttactgatgtggaatgcaattaaaattgattccactttaatcaaaataactttgaggagaacaaatatgtgctgagtatctacaatataaaagaaatttggatagataatgatgagttggtggaacagtaggtgactcatacagggatgaataaaatgtatcttttacaactcaaggagtttatattctgggaggggagaaaagatgtgtccagtcactaggcattttgtcagataatagaaacctgttccacctacttctcctctagaagacagtttgacaagtctccttatcaacatgtaaataataaaaagggtatccagcaaaagagaatattagcagtttggggtggtgataaggacacagcacgtaacgagatttccccttgaggacaatgtcagtgtaaacagagaccccacggattacaaactgttgaattcagaggttattattaagacataaatttaaaagggtctttattgataggctaccttactatattagggctctctagcaggacagaactaataggatagatgcatatataaaggggagtgtattaaggaatattgactcacacgatcacaagctgagatcccacagtagaccgtctacaagctgaggaccaaggaagccagtcagattcctaaaacctcaaaagtagggaagccaacagtacagccttcagtctgtggtcgaaggtccaagagtaccaaagctgacgaatttggagtccaatgtttgagggcaggaagcatcccagcatgggagaaagatgaaggccagaagatgcagccagtccagtccttccacgttcccctacctgcttttatcctagctgcactggcagctgattagatggtgcccacccagattgagggtgggtctgcctttcccagtctactgactcaaatggtaatctcctctggcaacaccctcacagacacacccaggaacaatactttgcatccttcaattcaaccaagttgacagtcagtattaaccatcacacttacttaatagctctgtgttctctagcaagttaatgaaatctctgttgacttaatttctaaaattggagtaagtccatcttttctaatgcagtttgtgtatgttaaatggaaatacaaaaaaaaatctagcatagtctatgacccaataaaacggtagttttcttccttcattcccaattcccttctctttcttaaaagcaaaaaataaaatagcagatgtcaggatcagtaccaacaggctctttgggactatggtttctttccattgatttgtagttcaacccattaagcatattctcagcacctagtatattcccagcatgcagcatggctgttgcctccatgagcccagtccagtagaagaaagaccatcagtcatacagatatgaaccaagtgcccattgaagtataagcttgtgctgtgggagcacagaaaagtaggggaatgaataatcctgaggaggaaagagtggatcagagcagtctcacaaaggcatttgagctgttccttcaaggtttccatggtggaggggggaggatcacattagcttatttattttttactacagagattcaacatttgcccttcataaaaattatacagaaaatatgttaagaaaataagttctaagccatcaagcccatctgatctgaaacagaaaaagactcataatgaatatgtcaacacttccacatttttcatttgttttctaaagcaatttcatctgcaaatgaattatgcactccagggctagacagtacctccattcctacactccagaaaaatgtgtttacttcgttttacatttcatgcagctcagtgggaaggcagttgcaatgcaatttctgatccagtttagggtttgagatgtcagtcctctctttctttctccagaatacggctaaagcttgtaagaccaaggttgggagttcacttttttttcctccaagtgcattaaatacataaatcacctctcaagaaagaacataaggttcctggatttctattttgtctggcatgaaaactaaagtccaatctgcaaagcatcatactgttatatccatctgcagtgcactaaaatcactctcaaagattgtaactcttggagcaaatttttagcacaatgggcagagcgggttgtttcttgcccaggtaactgaagcaggttcttatctcacctaaattcatcttctgtctgaaaagtaagtgtatctcaacatgcggtttgaggttctgaagggttccacgctgcccttccactcaggcagggagaagtcagtcctgggattgagtctgaagattttgatggacatggtcctggagcgagttcggagctagtgttaaaatgccctctagtggtcattagctgtaaccagtgagcgtagggaagggaaaatcttgtgaaactggcttgggtgtggttttctataaacaccgaccaaaaccagagtcctaggttatagcgcgggttacttgcatctgtcgcggataccgcgatggcggtaggacttggtattacttatagaaatggaagcttgccgttgcattcaaagggtacaatccagggatttttcttacgctttcacatctcactgctctgtccctgagccctgggcacacacgagagtttcaagaagtgttgactgagtgactgaatacgtgaaggaatccagtttatgaatcatggattctgtgcacattcaatgagcttggctatttgaaagtgcacaaattcttcctgctttctgaagtattaaatatatttgatttgcatcctttccccagtggtcgcttggtgagctaataattgcctttcctcttatatctttgagctgaggaaatataatcaaaatgttaaggagaggggcaacaaaccccccctttgtgggtagaagagaaggtctgggctggcagctcaagagaaaagatgaagaaaggacatccaaaaagaagtggaagtcagagaatgaataaaacacatgagcgaatggctgccatcctatccgagcatccttcctgatattgtcacccagggccaccagcagaggttacatggtgagaacagacagtagaaatcagcccactccaccgatctgactcctggtctcctggggaaatggcattaggatctaggttaccaacatcatagcttctgccagggcttgtgtgcttaaccccaacagtggaacaccacaaatgcacaggggcagtagcctccaacatcctgaccatctctgagaacctgtcctgctagcagaggggacagaggctgtacaaatcagaaagttgacgtattagtccattttcacgctgctgataaagacgtacctgagactgcgtaatttacaaaagaaaagggtttaatggaaaagtcacggttccacatggctggggaagtctcacaatcatggtggaaggcaaggaggagcaagtcacatcttacgtggatggaggcaggcaagagagagagcgcttgtggaggggaatgcctctttttaaacccgtcagatctcgtgagacttattcactatcacaagaacagcatgagaaagactggcccccatgattcgattacttcccaccaggtctctcccacaacacttgggaattcaaaatgagatttgggtagagacacagccaaaccatatcaatggataaaaggaaatgtaatgtcaactaaagacaaaaaaaaaagaaaaaagaaaaaaaaaacttttgaagaattaaagttggttttatttagaagtcttattggggactgtagactgaggcctacaacccacaagcagtcttttacagaggttttatgagactgcgccagcacagtattttagcccactgtgtatatataggtgctaggggtttagcatgtgcaaagttatatgaaacttgtttagacattatattaaagtagaactacgttaaggtttgggtgtaagggtatatctggttctagattatagaagtgtcatcactaatctccccagatgttattttatgcgtaggagaaggtaaggactaggttcatttgtcttttaaggaatatagtgacttaggtaggagagatgggggccaggtgttctgttttattttgtcgttttggagagctgtatgtcatcacagagttggggctttgtgaaattatgttggcacagagacaagcaaacttagctgcttatgtatgtgattttgtctcacaagttctctctttaggtcacaaattaactctggccatatttataaaaacaatattgattgtgttatgtagctgagaaggctgttttttaggaaggttggtaatctttagttgtagttgtaaggaatgagtattgagcccagtgtgtatatttatttattcattggaaaatatgttttggattatatttatgttttaattactaggatttgttagggtttttgatgttgcctttttgggggttttgtgtgtgtgtgttttgggtttttttttttttcaatacagggtttcactctgtcccccaggctggagtgtagtggcatgatctcagctcactgcagcctccgcctcctgggctcaagcgatcctcctgcctcagcctcccgagtagctgggaccacaggcatgagccaccacacccggctaatttttgtattttttgtagagatggggtttcaccatgttgcctaggctggtctcaaactcctgagctcaggcaatctgcccacctcagcttcccaaagtgcaggggttacaggcatgagccaccatgccaggctgttgcctttttttttaatctaatataacattttaataggacattataaggatattatagattacatatagtagtctatatttaatagtaatatgatttatagattttgaaaaaataaaaccaataaaatcagaatatgcatttgtatttttttactaattgtaccttttgtatttatatttactagtattttttatgaaaagcaattttggactggagttgattgagaatacttttagagaagaatttggaataacaactgggttgtcttgtgcatttcctgtgggcatgatgccagccttgctcttctatggcaaaggatacaggttggcacatggaggagcttggcctctgcaagcccacagacctctgggctagctactcagcaactatgtgtcctctagacacagtaacttaatctctgtgcctcagtttcctcaactgtaacatggggcgaataagagtatgtgccgacagagttgtgtgcaattaaaaaaataatatgtgtaaagtacttatggtgggatcccacctgcagttcgcctccaggaaatgttagatgctgatgtggaggaggatgaaggggaggaccagatgtttttcctgctgctggcatattctgcgcgctgctcttccttctcccaaatcctttcagcagcattttctttcttcccgagattgccaagggaacccaggcagaatgccaggaactaaacctctctggaagattgacggaagaagagctgggatttgagcaagatagagcgggctcagggtcaccatgaggttcaaggtctgcagactcccccaagctttctctcgagtagatttgaacacacaatccaagtccaaatccaaatttaataggcttctgtactgagaattcagctcagccaattgtgttagagccttaatgcacatgggtacacacacacacacactcagtgcacacaatgagcactcgtacagggccgggtcacaaaagaagcgaatgtccatcatctcccttcacttcccctggtcttttctagtctccattcctcaccatttctactgaattctcccatccctctccaccttctacttctggaacgagctccaaacatagcattaaaaagcttcagtgtttccagggaacagagcattgctgctttccataaactggcagaactggtcgttaaatggaactttcaggcattcccccacattctgaagtcactctctatgtaatgatcttcctgatacacctttctgctctttcacctggaaaagaatttgaaggatgtggttatcagtcctctgatgatgccaatgtttcgactccatcctgaatattgttattgctgccaaaacctactggtaaagtaatatcaatagagccaccgtactaaaaaggatgtgtctgctacgttgttttctttaatatcaaggactttaactatattacagttaaaatcaatagaaatgtaaccttttcaaccacataaaatgagttcatttttattattattctttttctgctgttacagtgctgtgattgcaaaagcaaccgggtcaacttaagctttattgaaagaccattaaagaaacaaactcaaactcatttaaatactgaagctggtgcattaaaaagatcaataaagtaaaagcaactggggttgctttacttaaacaccccacatacgagaatcattccacaatcacaatttgagcaaacctataaaactaggagaccagccaataaagaagaaaacgctgtttcattactaggtttagacccataaagcccttaactttagtctgattagacatactgcatttaaattttctctcagtattttaaaacatcatccagcaaagacttattgatcaatgaatgtcatttacttaggaaagccattagctccctgagttaggggaatgactcagtggtagaaagtgcagtttcatttatttaaaaataaacacaagattaggctacagtgaagggaagttctagactcacagggagtcaggaaattttctttctatccttgctgagcgtggtatcttgaacatagttatttgtattcaattgaatgtttactaccaattctgtggccatggattagacacaaacctctttgtgtgtgcctcagtttccccagaggtagaacgcattaatatccttttctccctctttctctggataagaaaacaaaaatgattgacacaaacctcttcaagttcttccttaaaaactataatacaaactataaaccttagtggtaatatgtacttagaataattttagaatcagattggtccttattggccatgagtccaacccttgaccagtctctgcttatattactagttatggaaaacatgctatttttcttcttaaaataccatttattgtgtttttctaattatacatttaaatatatttattatagaaagtacagaagagaacacagaggaaaatcaggtttgcttgtgagtcccatttaaaatcagccctcgacccttctccaccaaacccgtcttgcttactccagggcattgctgagcagttctctgtcttcgttctctactgactcattcccatcagcaaataagcatgcagatatttctcttactttaaaacaaaaatttctcctgagaccactttccccacatctttgtttttctttgcaataaaacgcccggcaatagttatctatgcttgctgtttcgggtcagcttctcccattctctctctctctctctctctctctctctctatttatttatttatttatttatttatttatttatttatttttttggagatagagtcccactctgtcgcccaggctggagtgtagttgtgcaatctcagctcactgctacctccacctcccaggttcaagcgattctcctgcctcagcctccccagtagctggaattacaggtgtgtgccaccacgcctggctaatttttgtatttttagtagagatgaagtttcatcatgctggccaggctggtctcggacccctgacctcaagcaatctgcccacctcagcctcccaaagtgctgggattacaggtgtgaaccaccatgctcagcctctttcttcagtcaactttactgaaatgtaaattgcatgcaatgaaatttacacactttaaatgtacagactgatgagttttgacagacgtgcacacccatgtagccaccaccacactcaaaatttggaatatttctaatatcccagaaggttcccctgggcccctttcccacccaccattgcccccaagcatttactgatcaaatttctatttctataaagtcacagattagttttacctgttctataatttttttttttttgagacagagtcccgccctgtcatctaggctggagtgcaatggcacagtctcagttcactgcaacctccacctcccagattcaaatgattctcctgcctcagcctcccaagtagctgggactacaggcacatggcactacacccggctaatttttgtatttttagtagagatgaggtttcactatgttgaccaggctggtcttgaactcctgacctcatgatctgcctgcctcggccttccaaagtgctgggattacaggcgtgagctaccacgcccggcctacttgttctataattttaaacaaatgtccagctcctttcattctgcataatgattctgaggttccttcttcttgtcgtgtgtatctgtggttgtttttttaattgctgggtggtaatacacttatgaatatacccccatgcatttattcattcacctcttgatggatatgtggatcattttggggatattatgactacacctgttaggaacatttgcatacacatgtatagagcagacttttttttatttctttcaagtaaatatctaggaatgaaatcaatgagtttatggtaagtgtatctttaactgttttttgatgtaatattccctctaggaagacagcagaattccagtgactccacgtagtcactagcacttgatattgtcagtctttttaattatagccattcaactggtgtgtggtagtatctcattttgggtttaattttcatttccctgatgactgatgatgtttagcgacttttcaagtgcttattgaccactggtaaatcttctttcgtgaagtgtctgttcaagcctttggcccctttttaaaattggattgtttgccttattattatgttataaggattctttacgtattctggatacaactcctttgccagatgcatgtactgtgaatattttatcctcattttttcttattcccaatcccagctgggctgctgtccaccactgcttaaagctactcttatggatactatcaatgaccttctcaccaccaaacccactggctacttcacagttctcctgctgctccacttaaaggcagcatctgaaaccagggagcccttggcttttagggaacactgctcctgtcctccttctccctcatgggccccttttgctctgtctccttcactgtttctctccttcctgacctccttcagtgggcgtgcttccagtgctttaccatttgtattcactcctgtgatgatctcatccaatgtcgtgctcttaaattttatctctgtgcctcaaactccaaattattatctcaacccaaacctcgccatgaactgccgactcacacaccaaactgactcccagatatctaactgattcttgatgtctgataaacactccgaacacaatatctccaaatctgacctcctgatctgccccttcccacaacctgccctgcttatagcctttccaatttcagctgatggcaactccatccttccagctggtcaggattaaaaccttggaatatcactagaacatcactcactggttctcacagctcacatccggtttttcagaacctcatgctggttctaccctgaaaacatccaaattctgaccagcctcccaccttgcacatctgctgctcgggctccagactccatcctgttctgcagaggcctcctgacgggtctccaagcttcctcccttgcccttgcaggagcgtctctgacatcactaccccatctgtttaaagtacgagttctctgctcaacacccactgacagtcctcgtttctctgaggacaagccaaagtctttccagtgacctgcaggactccacaggaactagccccgtgaccctccccttttcatgctacttgagcctcactggcttcatgccgggaattctcccgccttggctgctctctctgcctgagtgttctttccctgggtttctgcagggctaacccctcgaatccctcaagtcttcattgaatctccttttctcagtgaggctaccctgaccgccttatttagggttgcagtctgacttttacaccaggcctcttattgggctctaatttgagggaaaagacttcgaatttatcccctcctaccatattacatcatttactttttctctgtgtctctctatactaggaaggaagcgatatgagggttaggatttggggctttttgttcactgatgtatcctaagtacctagaacagtcagttcaaggcaccttatgggcacttgacaaacgtttcttgaatgaataaacggacctgtgatgtgactacagattccttcccacacgatgcactcggaggcccctttcttcccacccagccagtgccaggcattctgcagcaacactgctccatcatcctcttttctctgcccctgcagattgacatcttcagctccctggccaccagattatggttgggttcagctagcagaacactgcaggaaaacacagggggaggcacgagagatcggggtctgtcctgtcctcacctctatcctgcttcttcccaaagtgctgggattacaggagtgaaccaccgtacccggcctcattttacttattatagccacaggttcaaatctattcatatttttgttttgctttgttttttctgctctgtttagagtcggagtctcactctgtcatgcagactggagtgcagtcacacaatcacagctcactgcaatcttgaactcctaggctcaagcaatcctcctgcctcagcctcccaaagtgctgagatgacaggtgtgcaccaccatgctcagcccatatttattttttaacccttgttctattattacctcactctctgcaaagacttctagaaccaactacttggagttaggccaaactttacagctccaagggcacagtcctccacaagactggtctcacgtcaaaccccagctgcaagcccaggggtctccaggtgaccctcatttacaagcagctggctacaaattcagaggttcccactactccctcaggtcaataatttgctagaatgatttgcagaactcgggaaagcactatacttatgatcaagttttactataaaggatacaatccagaccggccaaagggagagatgcaggtggcaagatttgtcccaaatgcaaagcttctttgtcctaaggacacactaccctccctgcacatcagtgtgtgacaatgcccagagtattacaaaccagggacatttactgagcttcggtgtccaaagttttttttagaggtttcattacacaggcttggttgattgaatcattggccacaaaggtgaactcaatctccagtccctctgccttatctggggtttgggctcaatgctcccaactctaattgcatgtttgatgaaaagaagggagaaggaaaacataaaaaccctcctccttacatgaatgcccttctctcctcagttctcatcactgctcttctagctagctttctcttggcccaaagtacacaaatggtggctccagcaggttccctattcctggacattttcaattctaagcagcagcctcaggcattggtgatcctattggatgatccagtcacatgttcttcctaaatgccaagggtatgattatgctacattgcttggaggagtgtgcagccttgcctcattctgcagaagttcccagccatgctgtagccccagttccatatacgtaccacagccaccaacacaggagcctgtagggcacagtcagaatccatcttctttacctcttgggttcagataaccaagcaaagttctcctccaggccattttcatgttctctctgtcttcaatacacattctcctatacatgcctcatagtcctgattaggttagcaggccctgtggttgagcagacttccaatttgggaattgaatgtcagtttcttcctacatttaggcccagaatcaccctactcttgcccaatgtctttgaactgtttcttcatccagatcttttcatcccttaatacattctttctctcaagaagaatatcagtttctcaaggagagagatcctggggtctctccagacacaccgacatgtgcttgagtcccaacgtagctacacatgaactaattcgtcagccccttagggtcttgatcaggtcaccttgagccacaattttcaccaacctttcctctctgatggaaatctgaagtcctccctgggatttccaagggttctttctgcttccaggtgctttcttctgtgggtgatctctctgatccagagaatatccacccagaatgaagctcagcacttcctttggttcacaaacacacaaccgcccaaagcattcactgagcagtagcctctattgactatttcagggtcggggagaggggtacacagcacattaacaaatcactgcaagtcatagagtagatattcatgccctcaatagttcctttacccatccttctatagaggcttctcatagcccttcacgccaggcagtgccagtctttctgctttcaccccaggcagtgccaggattttgatttctcctgattcatgctccctggctccccacctgcttcctcactcatctccaggtctcccccactattatatacaataacaagctgactcttcccaaaacagggtccaagcttgctggcccagagtagtcaggtgctcaacagatgcaaaaacttggatttgaccccctttaaaggagttgtggttacaaataacaacaacaatgagaatttgggggtgatcctatgccagaataacagagatagatagatacatagatagatagatagatagatagatagatagatagatagacagatgatagatagatagatagatattgattgatagatgaaaaactgtaaccccagttttgtatagatcaatccaaactttgcatcctagcattcaaagcccttcacaacgtatcttccatttaccttctattgtcttctaccattcttttccaaaacacatcctaaggaccagcatggctggtgtcgtctaccattttttttccaaaacacatcctaaagatcaatgaggctagtgacctcaacacccttagagaaatttggtttattattcctccttcaaaacgcctccactctgccaatctactgtaccatgatgacacttattctccatattacatattttagaattaggggtaacattttacatttaattttagtagattgtcttagaatattattccttcattgtttcatgtcatgttttccaaacaagaatctaaagcgccttgagcccagctgggaacatctgcacgtcatcagctggactccagtcccagtgctcaaggtggctggaccacaaaaccacatggaagcccttgcataatgttaggaggtgtcagcaagatgatttgagtcttacgccgaggcctctctcttcccacagggggtctgcaccacccccagcagccaagttaccctgtgacagtcattcatctgtgctctgggtggcccatgggatgagtgtactactgggcaggtgtaacttcaggggcacacacagcagacatccccagctgacatgacaacctactggcttctcaagatttgactaatcatatatagtcatcccacaatatcctcggggtatcggtttcaggacccccaagtacatcaaacctcatgcatactcaaatcttgtggtcagctctgaggaacctgcatctagcaagggccgactttgcatatacgcaggtcctgcatcccaagaatactgtatttttgatccgcatttggttgaaaaaaaaatccacttgtaagcagtgcagttcaagcccatgttgtttaagggtgaactacatttctgtgaggggatcatcttcaaataaagtccttgtttctgtaccagttacagcaaaggccctgctttgagaatttaacagtcagagtagccacccacttcaaaactgaccagtcccatccgtggcaagcagacgatgtgacatcaacggctcttaccgcaccaggctaatacagttatcctggtcgtagtttcattttactgaaggccttattaaagcgcccccacacaactcagccaggaattcaccaggaaccaaatttaaacaaatcaaaccccgaaaacgtgctcaacaattcaagattacagaagggaataaagacgaaaataagaaaagcctcaatcatatttgtcatatctccatcgtttctcataataattctcaaagttctttattcctttcatttatttaattaaaaacttaggccatgcacgttggctcatacctataatcccagcactttgggaggccgaggtgggcaaatcacgaggtcaggagatcgagaccatcctggctaacacggtgaaaccccgtctcaactaaaaatacaaaaaattagccaggcttggtggcgggcacctgtagtcccagctactcaggaggctgaggcaggagaatcgcttgaacccaggaggcggaagttgcagtgagtcaagatcgtgccactgcacttcagcctgggcaacagagcaagactccatctcaaaaaaaaaaaaaaaaaaaacttaaccataacattatacaatttaagcagcatcatatttgttaatatctattttcaaaagcgactcttcctaattttattgttttcttcctcccttttccacgcatttgtttgtttttcttcctcctagaaagtcatgttctaagttatcaaaatgtgtttttcctcgagctcttcagggaaaaaatgccatataaaattaattcatgattattttatgtaaattattatctaaagtactcactatgtgtaacggttaaagttgattgttactaaagtgattctaaatatgaaagtgtataaaaccatgaactattctcacactacatctcaaagaaatttgaaatttctagtaaatttcaaatttactagaagactagttcagatattgtttttaatgatttacaatcatcttctgaattttcatttgcaagtcaaagtcacaaaactaaaagtgctacatgttttctgaccagattctctgaaataattatatagtgcttgagccattgtgctataaatatctttgaaatcaatgctattaaagaaatgctatatcagctgtgaaatgagaatttctcctcctgtccgttgacatttacaaaaattatacgaacttattgatagaaaatccgtttgcttggtttctttttaaacatcttatgctttaaataatattcagtgtttttccagtaggtggagtattagtctagataaagtaaatcactgtgtgaaagctaattttttcttcctactattttgagaaatttttgatataaaacataaatcacctaatagtttcactaattcttttaattgcatcaatatggtatgatttcaattactctagaccttaagaggcagatatattttactgattacattaccataataacaatggcataatgacaatagcagtaagtacttattatacctctcattttaaaattgcttatcaagccattagagaaacctcctgacatctctgaaacagaaattacacaacaaagaaagatctgtctcttaaatcctttctctctcgagccttaagcatttctgggaaactgcgttccttgtgagttgaatattggttcaaggctgatgctaccacttccagtccaggaatctgagacgatcactacctctccctgggattctgcttccccttctaagtttgtgaaaagatggtgataaactacatctctgaggcccctccctacctgaaaatccccaaatgaacctgaaattgacaatcttatggctgaatgtcgggagccaagtctgccgagatgttttagtacatacggcaaagatggcacttgttatacggtctggatctcaaaatggaaagtgagagaatgatgcctttccagggcaggtggacgcttcctcccaccctccatccatcaccaaaaccggtcgaagttgaatagtgccctgaaaagacaccttcaagtggtaccctagagttgtatcttcacagatgattctgctcaaagcccccagagacatgggaaaatactattccttagggccatggtagcagaacatcttcaaagaaacctcacagaactggttcaacctcctcactttacaaatgaggaaactgaagtccaagaaggcttcctaacttgataaacatccatttaacacgtggcagagccagggcccatctcctggccccattctcatccccccaggccacctctcctctcttacactggaagtctagaagctggtttgcaaggggtccctgaatgaccttccatagaggacagtgccttaccgagaagaggaaacacatactgaaaccagccacttttctctttttgccttctcacagtcaggtgattcgggtttggagagagccccagctcccatgcgcaggggattttctgtcctagaaaggcttaggcacagtggattcacctggatctcttctagttttgcagccagtttttctttcttgctcttggaccggagagcccccagacccaggcgtaggcttaggtaaagggggctcaggagacaaatctgtctgctttggccctaggctaggccacctctggccttgccaacaattaattaatacattagttaattaattaattaagtcaaagtcctccaacgtggttgagcccagctggggactggtaataaagtgagtggtttagagaataattcccagaagaagcacaaattgattattgtatttggtgaaaggacagcagaagagcattctgggcaaaagatacagctggtctaaagccctgagcacacctgggagtgcacagtgcctccccaggtgtgagagtcaggtcacagcacaggggcaaggtctaggcgagggcactgcattctcgcctctccattctacgaagatgccccctacccctctgatctccccagggccatttaatctctcccaaagaggcaaaggctccctgacttatccatctgcagttacctgcaggattcggttaactttcccttcgtaaaggcatccgccgtgaaacacaccaggcacctccaggaccggcatgcatcgctaacccagtgacaaaagcatggctgttgctcgtttattccagagttctgttaggggagagtgtttcttggcctctttcttcttcttgagtatctctataagtcggcaggatttatgagtagctcaaccaaaaacaaattaaggtagacaacgtgacctctaaatgggtcagcctcccaaatggtgtcctctcatctgcacccatggctgttcttgggattggagggatggccgcagggcttggcaatgtaggttgggagggggctggcctgctgaccctcaccctgatgggcttgtggctctcagcaatgtggtcccaaaaacaagttgcactgaaatcaagactctcagagcagagcaggggcaagtgtctcttgcatgaaaattcggagtcccagattcacgatcagccagtctccccatcgatgtggtctgggaggatggagccaagctcactcactcaaactcgatgtcaataaaatgctatgagggcttcagtccactgagtcattcacagagattcctccctctacaaacagaagttctaatggaagtaaaagctaggaatccacaccttaaacacacacacacacacacacacacagacagatttacatacagatacatacacgaacatggctcagccagtgctgacccatttaacacatgttaaatgagcaccttgcatatcacaggcccttttcatgtggatcgtaaattaactggaaggtttattagataacactacagagaaagaaatagccgaaagtccagaggtgaggtgttagccacggagctctgacaaccaggtggatttccactgcacctgctgagcccactgatcagtgtttaacaagcgtgtgttatgccacgctcctggggcaggagtggtaactgaggcagcgtccttgaacccacagggttacggtctcaccaagggaggatcaggaacagagctgcaaccctggactagcaggagagtcacacctaatcctacttctttatctcccacacatctacatttgctccatgtcctctccattatcaggaacaaagtgattctagggttaggaaggggcagaaaacatttagatgaacgtatccttgatactggggtcaaggcctgcttgttcgtattttcaattgcaaatggccctaggcttgtgtatacccttcatagaatggagattccgatggggagaaagagatggtctccactcttcaaaccctctcttctttgaagtctgtgggaatttctagtttagaaggacgggtagacacagataaggggtgcgagttgagctgataattgtttctcctacctgaagtctatctgcatcagcctcttcttatcttcagccttgggcttcaacttggagtaaataaaacattcatcagatgatatgctctaggctgggcgtggtggcctacaatcccagcatgttgggaggttgaggtgggaggatcacttgagcccaggaatttgagacaagcctggacaacatagtgagaccccatctctcctaaaaataattttaaaaattagccaggcagccaggcacggtggctcacacctgtaatcccagcactttgggaggctgaggcaggcagatcacgaggtcaggagttcaagaccagcctggccaacatggtgaaaccccatctctactaaaaatacaaaaattagctgggcatggtggcatgtgcctgtaatcccagctacttgggagactgcagcagaactgcttgaaccagaacttgggaggcagaggttgcagtgagccaagatcacaccactgcacttcagcttgggcaacaaaagcaaaactccgtcttaaaaaaaaaaaaaaaaaaaaaaaaaaaaaagccaggcatggtggtatgcacctgtggtcccagctactcggtaggctaaggtggaaggatcacttgagcctgagaagtggagtctgcagtgagctgtgactgcgccactgcactctagcctggatgacagaataagaccctgcctcaaaaaaaaaaaaaagaaactccttagtcatacacctaaagccaatctctccataatcactttattgggaataaaatgatattttgaagaaaaaagatgatatattctaaattcaatatcgctgagctaattccaagtattccctaaaattaacgattaggaaaaacagcaagaaatcctaggcctttgtctaggccatggaaaaagcgggatctgccttgaaattgtgtccttcatctcaggagatggggcccggcccctccaccggtccaggagaacccacgccatttaggtatttcttctttagcttctccactgcatccccaaagcgtaaacggctgatgaaatcccttcaaactctgccaacgcaaactgtggcttaaaaatggaaatgaatggatattgcaaaataatacctgaatagacgttaaagctttaagctccacgtgtaagacacaaggtcctgcctaaatcagtatgcttctaatggcttcatggcaaatgttgaacaagttagtgttcactcaaggttgtcctggggtacatggagtcacagtctttaattttaatgagcctctattacacaatctcttatcgcctcttaactgccagtgaaatgaccaccagctaaatgtacagcaaaatacatttctacaaaagagctcacttggaccccaaagaaattaccttgaaattattacacttaaccgtggcaaatgcaccagggttcatttgaaaagaggtggccacctggcaatacgagtgaaatcatataatatgtcatttccttaggcttttcatgttaagcttttctcgctatatctgatttaaagtattttctcttttaaatgtaaatatttaaaatgtagctgatcctctccctctcctaattgaggtgactgggctagttcaagagactgtggcctgcagctcaccgttttgtctctggagtcagagtgccagccttggtacttactctgtgactggacactttataatatcaaagatacgagatcatacctatctaatatctattcaataagacaatacatattaaaagatcagcacaaagccttgtacacagcagttgctcaatatgtgcttcctcctttttcctactattgaatcccaccagccaagaccagaactatatctgcagttggacaaagttgggtttatcccttgttgcagtgagggcttagcagtttgagtcaaacgggagctggaaaccacagtcggttaaaatggggtgataaatagaagcattaactatggcaaacagcaactccaagatgtaaggaaatccgtgcagtttcctagtggccccctagggctgagggagcccatccagggacaacctcggtgggtgtctgaccgtaatggaggcaaagctgcccctgtctcctctgacagtctccagctgggcctgagagttaagttgacgtaggagagactaacagaggaaacgcaagccaatgtttacaggcatgtgagggccttcacaggacaccaagatccaaaagcagccaggcctaagtgcttatgcaacagggtgaacaaaaagtagtaattttgaaaaagtaactaactatatggagatactaaagacaagggttattttaacaagagctttttaactgtcaaaacactttttgtttgtaccgatttccctcggcctcaactccccgcctctggagagaagaatgttcttttcttcctggtagagagaagccatcttccatatgaaagtttcatctcctgctttcaggaagaaaaggggaggtcagagtgtcctttgtgcatctgttgtttttctttttttctttgagatggagtctcactctcacccaggctggagtgcagtggcaccatctcggctcactgcaacctctgcctcccgggttcaagcgagtctcctgcttcagcctctcaagtagctgggaccacaggcgtgcaccaccatgcccggctaatttttgtcttttagtagagatggggtttcaccatgttggccaggctggtctcgaactcctgaccacaggtgatccgcccactttgccccccaaagtgctgggattataggcgtgagccaccacgcccaacgcatctgttgtttttcaagtgcctttagctcaaaattgtccccatctcaagccagcatatctggaggtggcgtgttctgaagcccttcaggaccttgctggagaaggtgtgtctgcctggcagagagcagagacccctgcttagccaagctggagctggtccggaattgctgggggagcgacaggctggctgccctctggagtgcaggtgggggagcaggcaatagcaatggcggtgggggtgagagtgaggggctaccagggcggttcagacacacgtccagaggtctgtgggcaggttgccatggctgagacgctagggtcacagagggttctcttaaaaggcctgcgactcagacaggcttcacctcatgtcctcgcactctgggcagagcctctgctatccccctcctcgagcctgtgctggaaattgcagtaagccccttcctcttgcagtgtccctccagagcacgctactgagaaagcttgacattgtgctcaccttaaaagcaaaatctttaaggaattccattgtttatcatagagcttatattgaagggtgcattgggagccaggaagcaacgagttgattgataattgacgcaaagggacccatataccttagagaatgacggggtggctctaagagtcaggaagggcttattttaggaatcaggcttatggtggggagggttcaaggaagcaggtgtctctaatcaactgggtgctctcagaaaagcagggctaattcagttattgggcctcttaatgcatttcatctgggaggcaggaagaatggagaacactaacgttgttattgaagaaattgccgggagaaagagatgttttggttttgggttgtacaaggtctgttattttttaatttcttgtattagtttcccagtgttgctgtaacaaattgccacaaacttaaggacttaaaacaacatgcatttactatctcacagttccagaggccagaagtgcaaagtcagcgcaaacggctgaagtcaatcagaaaggctggtgccttccgcaggctctgagaggagaatctgtttccttgcctttctcagcttctaagagtctcctgcgttccttgggcccttcctcacgtcactctaacttctgcttccgttgtcacatcttctctccactgcgaccctcttgcctccctcctataaagaccctggtggggacctgagacccacccagggaatccaggagaattcccctattatcttaatcacatctgtaaagcccctcttgccaaggaaggtgacgcgctctcaggtcctgagaattaggatgttatctttgggaggcatgattccgcccaccatatctccatattcagacaaaattgcagaatggtctcgtgtcacatggtcaggtcctggagagccctgatccgatgctgctgttctgaattatgttcggcagggggacagcaccacctggtggtaacactcggcaaagcatccgccgtcagctgcagagctgcttttcctttggggtcctcttgctttaacccaccttccccacaatcccactcatcccttccggccacagcccgccttcttagacacaaggcaggcaggagtatgcgagagagaagacgtaaggacgccttgctcgtggtaagatcagagactgatcggagaacgctttcctccttccctcctttgagaatttcctcaggcactgcagcttcacctttgtgaatgttgaaggctttctggatatcctcgtcacttctcatattttcctaactgagcaggtaatttggattagaactgtacagcatgacccatttaggttcctgttcactgttttgaaattaatgacttcatcaatgagttaaggctaggagtgttcattatgttttttagaaaagtcaaaaccgagcaggatcaccgagaagcaagatgacacaatcaacaatcaaaaacctctgagtagaggctattactgtgtttcaaaacaaaatatataaaagtggccgggtgcggtggctcacgcctgtaatcccagcactttgggaggccgaggtgggcggaacacaaggtcaagagttcgagaccatcctggccaacatagtgaaaccccgtctctactaaaaatacaaaaattagccgggcgtggtggcgggcgcctggagtcccagctactagggaggctgaggcaggagaatggcgtgaacccgggaggcggagcttgcagtgaaccgagatggtgcctctgcactccagcctgggcgacagagcgagactcagtcccaaaaaaaaaaaaaagaaagaaagaaaagtttatataaataaatgtaaaatttagcatttttggttaaagccatcaaccacgcagacataggaagggaatacacttatagagatcaactaggaattttattttactgtagctcagcaaaaataatataaaatggctgccaaaaagccaaggccgtctagtctggatctgcagaaacaattcaggaaaaggaaggtacctccactgtgtgggtcatgccaaacctgaggacggatttcccttcggtgctcgcgactttaaaagttgcattaacaactgttaatgtcaattatcaagatcccaccatgtattgtattgggctgtattgggcctgaggacacagaaatgtaaaaacctaaacatggaaatttaatctttaaaactgtgtactatgtatccatagaacgaaatactagtcatccatgacaaatgatttttgttgtatatttattgagacagaagacattcataatatatcgtcaagttaaaaaatatacaaaacataatatgtgttagttgggttccatccctttttacttaaaaagttgaaagaatatacattaaaagttaacattgactatcagctggcagtttttttctgcaaatctatatcattttttctataacgaacgtatattacttgtatccatttttaaagctaagaaaatagaattttgttgtatttttatcgacacagagcgacattcataatatatcatcaagttaaaaaatatacaaaacaatgtgttacttgggttccatcccttttttatttaaaaagttgaaagaaaatacattagaaattaacatttattattagcaggcaactttttttccggcaaatctgtgtttttctataatgaacatatattatttgtatccatttttaaaattctttaagaaaatagaactttgttacaaatttagttttttgttttgttttttttgttctgagatggaatcttgctgtcaccaggctggagtgcagtggcgcgatctcggctcactggaacctccacctcccaggttcaagccattcccatgctacaatctcctgagtagctgggactataggggagtgccaccacacccagctactttttgtatttttagtagagacagggtttcatcatgttggccaggatggtctcgatctcttgatctcatgatccacccacctcggcctcccaaagtgttgggattacaggcgtaagccactgccctgatcacaaatttagtttttaaattgtaagaagtatgaggtggagattatcacctcctaaggcattgccaggtaggctattggttaacaatggcattttgcatttaaccatttaacaaaagagagtaagtaaacagaagtgcggtggcagttacccatgggtgtcattagatggcagcaaagcagctagctaatatttaagagcagaaactgaagagcttttgctccaaagaaacatatatatgagattttaaatatttaagattatctgaacggaataagtgtttttgtttgtttgtttgcttccagacagggtctcactctgtcacctaggctggagcacagtggcatgaccacagctcactgcaggcttgacctcctggcctcaagctatcctcccacctcagcctctcgagtagctgtgactaccggtgcacaccaccacacccagctactttttaaaatttttatagagataatggtctcactatattgcccaggctggtcttgtactcctggactcgagagatccacaagcttcagcctcccaaaatgctgggattacaggcatgagccaccacacctggtttgttttgttaatgatgcatttgacgttatagaaaacttttcaaaatgatagccaagcatgcaaatgtttactttaatagtttttgggggtggggtgcttttggatttttgtggcaatactactcatgcacaaaaacctactgtaccagttctgtgggtcaaaaatctaaaatgttcttgagatgtgaggaccctttgactcttaaccgtgactgtgcaatgatctctaagtttctaggaagcagtttcaagattctgctgcagacagtcattaataatgaatgactattcatcgtagtatgatgtggtgatgccatttgatcacttgcctgccctctttcttcactgccactctctccttcctcccaagagcacagctagcttccagcatctttgctcatctgaaggacagttttttgcctaatcaggcccagtttgagcaaggactctggatcgtatctgcttctgagtctgtgctgctgccttcaacaagttgctgcttgttctgtctccttcctctacacaattgacgtggcccccatgggaatgcccatgtcggaaagcaatgctgtgctttcttataacccgcacctctcgtcatgctgaccttagcacgtattaaactcacttcagaaaaatgaatgcttacaaaagaatgttttccaccggggtggggggcccaaaaaaggcccagaaagctctaagagctcacagttggagaaacacatctagactgtataggtggtaaaaagacagctgagaagataaggcaggaaaagccacacagggacacaaagggcaaggccagtgattctgacaccaccattggcactttgtccacgggcaacaggatcagaaacgtgcgtcgcttccgtggttactgtctgtgcaccgttcccaacagcttcatttctctccctctgctgccaactcgcccaaccacccctgcctgtggcaggagaaatcattctcattgggataaccgagaaaactacaactgtttaccccacttgaccctcagcatttgagtgtgtgtgtgtgtatgtgtgtgtgtgtgatcatgtcacaaaataaaatgtttccgcaaaacttcattgctgtagatgtggcatattccctatcagaggctgacactggagattggatcaagcagatgttactccattaaaaagaacatggatcttaatcctgtaggtaaatcatccacagaaaatgtacatcacctggagagccgttcataaaggatcttcacttaccatcctcagattttttcaaagaaccccagcaaaggaagacatgggtttccattttctcggggtggtgttttagagtcagtgctgatgaaataagatatcagaaaaccagggttcaaagagtgatgtcatccccacagggaagatttggttccacacagggtagagacgtgcttctaaaagtgtctcttgttttcctcctgcagctcgatcattatccttctgtgagttaccatctgccaagttcatccgacaccctcttcaattctcccaagtcgctctttctgggaaaagttataggtaagaatgtggttcgttaggtataaatgcgtgctacaaatacatttgggtaatgtgagtttggattttaaaactatcaggtaaatttctcttactggggccagtcacgaatatcttctctgtacaggaaagttacgtggttgttctcggtgttgcacaagcaaagcgtcaacaaattatctttgggggaaattgctcatgtaactcattctaaagctaattcgcctttgaaatacattgtgattaggctgggcatggtgggtcacgcctgtaatcccagcactttgggaggctaaggctggtggatcacttgaggtcaggagttcgagaccagcctggccaacatggcaaaaccccgtctctactaaaaatacaaaaattagccatgcatggtggcaggtgcctgtaatcccagctactcgggaggctgaggcaggagaattgcttgaaccccggaggtggaggttgcagtgagccaagatcgtgccaccacactccagcctgggtggcagagcgagactctgtctcaaaaaaaaaaaaaaaaaacaaccaaacaaacaaaaaacacattgtgattggtaatgggggcttctaagtcagcgatggtaatggaacaaacgttgtttggtgcgtggcataaactacaacccaagcgaaggcaaatctgctccaggcttctctatgtagaatttggtctattacagacctctacctactagcaatatgtaatttaacgtttcctttgtcaaagcatatcaacatgattctatcttcctctcactcgtaagaaagcaccttgatattatttgcagataagaaggccaataaggaatttgacagtgtgacagaacacccttccccatgtgcgactgtgaattccagagtctccttgtccctctcttcaccagaggagattagcactgtgcaaagctaaaaaatgtaccatgagccacagatatgtgaagattacaccctaaatttttaaaatatcgatatgattggtgaagtattttaaaatatttaatgtgaagccaatgaattttgttcatatgaggctgtgtactgtgaactgcaatgaaaacagtaagatggtggtgatgtacaggtgggagggaggtcactcggcggccagtgtgtagaagtgatcagaatagcattaatggtaaaaatgctcacttaaaaacatgcggcaggggtcacaaaatgaggagtgagtaggagactgaacctataataaaaataatagactgggcgtggcggctcatgtctgtaatcccagcactttgggaggctgaggcaggcagatcacgaggtcaggagatcaagaccatcctggctaacacggtgaaaccccgtctctacaaaaaaatttaaaaaaattagacgggcgtggtggtgggcgtctgtagtcccagctacttgggaggctgaggcaggagaatggcgtgaacccgggaggcggagcttacagtgagccgagatcacgccactgcaccccagcctgggcgacagagggagactctgtcttaataataataataataataataatgtgcacttatgtaagatttactgtaggccaggctccagtttaagcacttgacagatattagcccattcaatcttcgtcacaattgtatgaggtagttaagattatgatctccactttttagatgagaaaactgaaccatgaagagattaaataaccgggccacctggctaatcagtggcagaaccaaaatttgaactcaggcaatcagacaccaagggagctctttactgtgctgtaatccctgtggcagttaatctagaatgcaaagagaaagacagagaggaaagattgggcaggtgataaatgctgaggctgtccaggtaagggataaagcctatatcttgtgccaggaagtggtcaagaacaaaaaggattcctgggtttagaaccaggaacacaccagtccggctggagagggaggcatccagaagagagggggaaagcaggtgtgtgcatgaagcccaagaccacacacctggtgaacaagacagtggggagtggcaagtgataaatcaaagggtggaactggaaaacaaaagagggctaacatgtattgatcactgagccttagatattgtacgatatgaaagataattaaatagcttctgcttaatcctttgcatcctgaaaacagcactcaggcacagtctcaaatctagctttggattacctcaccctgatgtccttatctgaattttctccaacactttctatagttgatgtatttttacagatcttatcaccacttttatgttctgtgaacaagaagagactttgtgacatcacatgttacacgtgtaaatataagaaacaaacgtcacaacaatccaatgaaatgagatccctgattatgaacctcattttgcagatgagaaaactgaagcagaagaaggtcaatttgacaaaagttactcaactaatactggcaaagcagagtttggaagcgaggtctctctgaagacagtccagactcttaagtgggtcaaacaatcttgtcattcatggtgaagctccagaagagggatgtatttgaaagttgagcgatgccatcagttagcaacaaaaagtggctgtttagtggagtagggccttggcattcatgagtcatggatctgagactttggtgagtacccgctttctaccagaggtactcccacggttcagttgagaatactttaaaatgttaagtgctccttcagaaccatatgattccatcaaaacaaacgctacactatgatatggtgatgttcctaaagatactacactatgatattcgtaaagtaacatcaactataaacatacccgaaaataatagactttttattactttgtggaacctgcaaagtcaaattttgatgggaatgttggatgatttctaggttctgtcactatgagtaatattctctggttcctctgttttccaggtcatgtaactagttcacatttcagcacaattccaatatactgtatggcatggaccttcaaggtcgtgaacaaataacatcataaaggccacattttctacaactaagaatgtaccttgacatcaatctgtgcaaagctaaaagtgtaccatgagcctcagatacatgaaggttacaccctgtattttttgtacacccaagaaaaatgttgctgcatacacaaactaggtaactgtgcatgtggcagtgagttacagaaagtacacataaatacctgtaaggaggtccacaattccaagatggaaatggtgttatgcaggtgagagtagttagggctccagcaatgggtccttggtgcactgacttctagtggagattatctctcatccctacaagcctgtgacctccctgcagaccaagaaagcatctcatagttccaccatatactaacaaggagcaagtgctcaataaatatttgttgaattaataaagagtaaaaggggaaggaaacagaaagatatcattgtagacgtatactgcagggtgaaagggtatggatgatcatcctaacagaatcagtaagattcgcacagaggtgagagctgcaatcctcacatatctcacagcctaaaagtaggcatctgacgatcatgaagtagaaagaatgtggacttcggaatcaggcagagcttgttagactggaatccagttctacctctgttagcattgaaatcttgaccatgttgctttcttagttgaacctctcagagcctaggttctctcctttgcaaaatggggaacacaaatgcctacttgcaggttgttaactccctgagggcagaaggcagagactttttttgaaactaatctatttacagcaggctgatcagtgcctagtatacagaaagggctcaaaaaatacttgtggagtaaatgaactactcttttaatattaagctaataacgtcttaagacatacacaacacaatgcctaatacataaataattaccatttttgatgctagctacatgccggttattatgctatatgctgtaagtacaatactgtctgcgtttctcacaacaccacagaccattgttaccctcgttgtatagaataaggagctaaggctcaaaactattaagttttcttcttaaagtggggtttcccaacagcagaactattgacattttggatcagaaaattctttattatggggctgtcttgttcattgcagaatgtttagcattctccctggcctttacccactagatataagtagcaccccaagttgtgacaaccaaaaatgtcttctaacattgctaaatgttccccaggagggaaaaattaccaccccagttgaaaaccacaggcttcaagctactcagcgagtcagcggtgacgctgagatttgaaaagcgtgatttgtgacctaagacctatgctttgcttcctgatgacacctgcaccttccagaatggtgaggaagcaaggacgaggttcttgctactctgaagctaaaattctgttaataaaattgaaggagtctcagtgaagaccccaagaagacatgtaagtgcttgagaagctaatcactggccaccccttcaagccaatactcctttgatatttgatcatttcacaggggcaggaatatgcttaaatgtctctttgaaaacaacatatacttcagtgagagacaacccatttgcattccccagttgtgtaaaaatccatctgtacagacatacagtattgaacttgcaactgatatgtactccggccaggttttgaaaccccctggagtttcatgctccaaagttgttgctttacttttataggatcagtttctgctactcagaaactgattctataaaagaaagagaagaagatggctctaaatacctaaaatgacttcacactgagctctttgatgagcactcctcaaaaagggacacagaaaaaggatgaaagaaaggctacctaatcaaggacaagtgtgatctttataaaggggatggaggatatatattcaagaaatagtagtgtgatcactgccaaccaacagcaaacttttagaacggattcttacataattctgaatgcttctagaaggaattcagaatcactagcaatcagcaaaggttcacaaaggagaaatctcactagacatagttatgtccatctttcatccctcatatccatccatcttttaccagccgagtgatgtcatagactttatctttcagcaacaaatttaatggtctctcaagaaatcttcaaggaagagaaatataacttgaagccgaaagtggggtgttctgtttgctcatgtccttttcaacatctctattaatgccttggagaaagacacaagtagcatgtttattaagtttgcaaatgtcacgaagctgagagggatggtttaatatgatggattataaaaagcatttcaaaaccatcttgacaggctagaaagatgggataaaaataataagatgaaatgtaatagaaataaacttaattgcagcacttagataaaaaaaatatatacaatcacctaaatagaagatgggagacccccagcatcatgaaaaaacttaggaaattggtttgatggaaagtctggtacaagcaatgttacatggtgatggattcttaaatgaatgtgattctgagccacactagtatgagaatcatgtccagagcgagggtattagtcatctgaggagaaaaccagataaacacaagacccgtaaaggaaatgtcagaagacctgggaatgtctgatcagaaaaaaatatgatttgagagacgagagaatcaattttcagtctttggtaactgccacatgcagggtggattagacttagttgaggcttactcagcaagactgacatggaccaaaagcagaagatatgaagaggaaaatctcagctccatataagaaagaacttcctaacaattagagcttttcaaaagtgagtggtctctactttgaggtaatgaactctctattattgagaatattcaacaaaggctaaacggaaatgtgccctgtatattaaggagttgtctggattgagtaaaaccagattagatatagcctaaataaactttgaaactttaagatttgtggtgggagtaattttcttaattaaaaaggtgaaaatgcaatattatagtagagcagggtctcctgttccattggcaactagggggataacatttagggttccttgatataaaacactgttatgatgcatgatgatagatatgaatttagaagaatatcaatgtacagcgatcaccacatcactgtgagttgtgtaattacatacacgacctgtttccaaggtggcaatatgcattttaattttatttctgagccctctttaattaatcgtttttcaaattaactatttctgccatcgctgtaaatcagagtaatataaaaccgtaatgaagtagatctattctgaaataaaaagacggtagcttctctgtgtaaacttgagaagctgtgcttagaaagaagctgaatactaatgcagtgtcgttgttgcttggctgatcattgctgttgtcagtggcgatgtctggggtggtaaaaataaagcgaacttctatccatttgaactaactagagtttgtaagtcatattggtctcagatcctcatatttcccaaactaccattatccaaagcaattccaatagaagtggctagtagcccctatattatttctattataatctaaattgtgaatatcatgatcctacacgactttttattgattaaaaagtcttattctaaggctttctaaaactttctggagctttggcaaagcctcttcacacagaaggaactgacatacttagatcttcatttgttggtgaaatcatatactgtgataaccatgctgctcacagaatatttctggccagagttatgaatggaaaagatttgtgtgatttccaggctagaacatttaagtgctcatgcaagaccctctagagtccttttatccctttggcatggtgactgacaagcctaagacagtgattttttccgtaagcctgggtccctctgtgactacagtgaacagaaaactcttgacttgtgatgaacatatagcatgagataaaaaaaactccttgctttgttaagccaccgagactatagggctgtttgttactgtggcagagccttggcctgtcctgactgaggcataaggactgacttaagggcagactttgctctcgcacccttgggtttgatctctgatatagtttggatatttgtccccaccaaaatctcatgttgaaatgtaatccccagtgttggaggtggggcctggtgggaggtgtttggatcatggtggtggaagcctcatgaatggcttgggccatctccttggtgataagtgagctctcactctgagttcacacaaaacctggatgtttaagtatgtagcacctccccccaacactcttcctctggatcctgcttttgccatgtaccctgcctgctccaccttcaccttctgccataatcataagcttcctgaggcctccccagaagcagatgccagtgctgtgcctcctataaagcctgcagaactgtgagccaattaaacctctttccttataaattacccagtctcagatgtttctttatagcagtgcaagaacagcctaatacaatctcttactctaccatttgccgattgtatgactttgtcgggttacttaacattgtgtgtatctgttttgtcatgtgtaaaataggaatagtaatggtctctgtgtcacgggattcagcaaaataatacatgtttagcggttagcacagtctctgctgcatagtatgtgtgtaatacatattagttttttactttgcataatcagcaaatgtatactcatcatatgtcagatgccaggcattgtataagtccctggaacatcattagggtccaagacaggcacagtttctgcctttggaaactttatatattcaaatccagttctcagaggtttctcttgggagaacccaaagcaagataggggatcatacaatgtatcaatatgcactgggtcacatctttagagcttcagtttctggaaaagaaggtaatggaaagtcaattagaagtaaaaagacaagagggtgggataaatgaaaagaagtatagaattctttgggagcaagtagggagggcacttgagccagtccaggagtgagggaaggcatactagaggaagtaacacagaagctgggaccctaatgaagagttagaatgatctgggtaaagcaatgggctgaagtagaggccataagggcgggggaggtcagttctccattctgcacagcagtccacccaaaactgtgtggctcaaaacagtagtttattatttctggcaattctgtggattggcagggtggttgttctgcttcatgactccaggcagggtgtaagaatgactggatagcccgaaatagcctcattcatgtggctggcagcaagtgctggctgcccaggagctctttggggccacgagccaggggctgagttctcccccaagggttccaaatcatggctgcttgggctacctcatggcatggtggctgggctccaagaaggagctttccaaacagcaaatgtagaagctgaaggtctctaagagccaccattcttgccatatgctattgaccaaaatctgggttccagcccatgttccaagagagaggaagcagaccctacctcttggtggcatcgtagccaggtcacattgcaaagaaacatgccatgggagttacggttgtgacatctttggaaacacagtgtgctatgagagaaatttgaggaaccacaagttgcattcagaatggtggaaagtcggatgtgaagatgcaagtgataaaaatgctgcagcataagcagggttcagatcaaaggcggctttaccagcagggccacatgtcctgctttgcctgggacagacccaagctactcctgccaggacaagagtacattattagcagtgcccacttttactctaaaaataggactacgcagttgtatgatcacctatcttatttgggtgttcccaggagaaaccctgcagaattcgatttgaatataagaagtttacctgggagacaatcccataaaacaagcaggaaagtagagacatgaaacagggaaagggatggagcattatcaagccactcaccactgtgggcacctggaacataatcccaccaggacactctggaagacagtgcgagacatgcctccgagtgtcccaaccaaggcaggaggaagccagggcatctcgccacctcctcccatcctgcagtgatgagggctgcttcctgcggtactaactccccagcacttccagcttgtcccgtgtttacacccaacacactgctgaggccagaggaaagtgcagatgacagcgaatcgcagtcagtggttcctggagcaggactgaggtgaatgccgggcactgacagcatctgccatattacggatctatttataagccatgttaaggttttaatgttatcttaggggttaaaggaagtcaaggaaggatgttttttaatccatagaataacgtgatcagattgacactttagccagataataccatctgcagagtgcaaaatgcataacaggaagtgagaagctgcagggagaccaaattggaggttgccatggttatcacagaattgcacattgtaatgcacaaagcagctcacatatgtggagaaaatgcaatgtctttatctgtgtctgatgatgtcgtattccttctgggtagcaaaggcaaataagctaaacatccaggctggtttaaagctgattctgacttaatcatttcaaaattccttcctggttgtgctctgtccctcatgaataaaaatgttcagtttctcgaagagcctttcccgtcctctgcttctttctataaggtggggaccaggtgtacagaatataaaaggagacaggcagcaacatgtctagctttagcattctaatgataccgtgggcagggagagacctggatgcatgctggtccttgagtttgcatggccaggcatctgctggcctccagcccagtgtcctgtgtccctgagtgctcttctggccttggagcttaaatctgtggttgatgaacttagagtccctttctttgactcaggcagtgttcccagggagcacctgccatcctgccctttgcttacttgctgtgccctcaatctcccacttgagagacccctaagccctaagtctctttcgcatcctccgtctccccatggcaggttgtcgtcagctatcaagcagtgagggctttcatctaaggcttcatgctgcacgagaatgagatgatgcacgtgaggaccagagaccctgtcggcttactcttcttccctctctacatgaggcttggctgccccatgttagtacaggaccgccccccaccaccaccgaccccctacacagcaacctctccccagagccccagactgggaagcaaggcaagagccctaaacccttggtcccatccgtcatcctttagaaacccacttctgctctctgggccaaagcttagctctcgtctctcctgctgtatctcctccttttctcatagtcttctagggcattaagaaagaaaaaagaaaaaaagaaaaaaagctttgcttttacttcctacaaaaaaaaaaagcaccatctaacaaatagctccaaaactcaattgcttaaaacaacaattctatttttatcactaatctgcgggtcagctaagggccgaagtttctcttgtacacctctcgtcttcctcctgggaccagggagttagcatgggcatgtttttctctggcagagacacgagagaacaagccactcacacaagcactttccaggcctttggtcttgtcacatccactaacatctgattatctaaactaagtcatgtggccaaatccatagtcgaggagaagagaaacttgctttcccttcagtgaagaaaacagcaaagtcacatggcaaaggccacggatacagggaagggtaaagaattaggggccgccaatgccatcttccatacttaggaggtggatgcaggagaactctgtgacctcctcgatgtactaaaaagcctgagtaggcccggctcggtggctcacgcctgtaatcccagcactttggaaagccgaggcaggcagatcacgaggtcaggagattgtgaccatcctggctaacatggcgaaaccctgtcgctactaaaaaatacaaaaaaaaattagccgggcgtggtggtggtcacctgtagtcccagctactcgggaggctgaggcaggagaatggcgtgaacccaggaggtggagcttgcagtaagccgagatcgcgccactgcactccagcctgggcaacagagtgagactacatctcaaaaaaaaaaaaaaaaaaagcctgagcaaaggaacttggggaaatcattttattcactcaaaagtatgttcagtgctcacatgtaccaggtgctaggcacagaacaatggataaaacagaaatctcttatctttatgaaccatgtactctcatgagcatagacagaatgagaaaagagttgtgtaatataaatgttagcaataagtgctatgaagaaaagtaaaagaggcttagcaggaaagcatgttacaatggccaggaaagtcgtctttgagaaggcaatatttaagcagtggccttaacaaagtgagaaagctggctgtgtggacatctgctggaaaagccttccaggaagagagaatggcagtccaaaggctgtgaggtagggacacgcctggcttgttcaaggacaggaagaaaaccaacatggctggaatacagccatcaagggacagagtggcaggagacagatgaagtcagagggttagccagcagccaattgcacagatggagaccatcatggagagtctgcattttattctaaatgagatgagaaacagtagaaggttttgagcacataagtaacacaatccaatttacatattagaaaggtcattccagctgtgggatgctgtattaactgcagaaggggtgggctgatataggggcaggatggacactaagagaccatttcaaatacagttgtggagtccatgtgagagttagaggcacgtgcaccaacgcaacagcagtgatggtgatggagaaatctttggactaggaacacactgaagtcagagcccatagtatttggtgatcaaccggatgtggtgggtgagagaaagagaagtcaaagagcgtttcccaaggtattggcctgaatagctggcccagtggtggggctgcctactacaatgaggtaccctgggagagaagtagtttaggaactgtggaataaaaattaagacttccattctagccacattcaaggctattccatggatgcatagcactgaggtgcatatcagaaaccgaacaccacctgtaacacggccttttcctgtctttatctcccatctcctcctcaggcagatagatgtcttggcttgactaggacattgatcgttactgggaaaggcaaaaaagaaaaaagcctattgataaatgtcagaatatatctccattataaagtcattcaggtgttgcatatgaacgcaatgatgaagaagaacaaattactgatacacaaaacagcttggatgaatctctagagaatcgtgccaatggaaaaaaagccagtcccaaaaggttacatacccaatgatcccatttatgcaacatttttgaaatgacaaaattttacaattgaggacagattagtgagtgccaagggttagtgactaggacaggagggaaggggaaggaagagaggtgtggttagaaaaggaaaacaaggaggccgggcatggtggctgactcctgcaatctcagcactttgggaggctgaggcaggaagatcacttgaggtcaggagttcgagaccagcctggccaacatggtgaaatctgtctctactaaaaatataaaaattagccaggcatggtggcccatgcctgtagtcccagctactcgggaggctgaggcaggagaattgcttgagcccgggagacagagaagttgcagtgagccaagatcatgctactgtactgcatctaggtgacagagctagactccatctcaaaaatttaaaaataaaaaagagagattcttctgcagtgggaattattcattatcctgactatggtggtggatgcacagacctacacagatgataaaattgtgcagaatcacatttgcacacatacaagagtacaaaatctgaaataagatcattggatcatatcaatgttaatatcctgatggtgacactgtactcctgatttgcaaaatgtctccaatggggaaactgggcaaaatacacaggggatctctctgtacaatttcttacaactacatgtgattctacaatggactcaattaaagtttcaattagaaaaagcaataaaaagccgggcacggtggctcatgcttgtaatcccagcactttggaaggctgaggcaggtggatcgcctcaggtcaggagtttcagaccagcctagtcaacacggcaaaaccccgtctctactaaaaatacaaaaattagccaggcaagatggcgggagcctgtaatctcagctacttgggaggctgaggcaggagaatcgcttgaacctaggagacggaagttgcagtgagcagagatcacaccactggactccagcctgggcaacagagggagactccatctcaaaaaaaaaagaaaaaagaaaaggaaaagcaataaaagtaaaagaagaccaagtccaccttcttctgtggagccatttattcatgggatatttagtcagtgtctcctaggggctagtgccatccaccctgggggagcgtgagggacaggagagggacctgcagcgattaagccaccggttctacccattccctctttactttcctgcgctagccagtagagattaggaaatatgtgggaattattatttatttacagcttagaattttgtagttcttttagagtcattattgaagagaatgattaatataatacatttctttaaaaaggagctagagaaaatggggtagattaaactgcctgcaacttctctcaaggaaagtccccgatggcagcttatcgccttgtgatttatctctacctcctaagagtagaatgcagcaaaattgataaatgaacaaatggcaaatagttaattgaaatttctggtcagttgcctttgcgttttactataaggacagaagcagcaggaaagcactgatgagaaagctcattgaagtgataggtgagaaataatatttaaactgaagagaagaaattatgtcctgtttttcatatcctaaagaacatatagcgtagtcttaatgtccagaatcttctcaaggctgaaggaaatctattttaaaagaattcactcagggagttctagttcaaggctggcttctcattcttttttaattgcattgactttcattcttagacatttattgggctttattattattattgccttatagaatcataggaggccctaagaaataatttgttgaaactttgtcacattacagctgaggaaaatgaggcccagaaaggttaaatgaagccaaggtcacatagctggtacttcacaacgtttcctttttttttttttttttttgagacggagtctcactctgtcaccaggttggagtgcaatggcgtgatctcagctcactgcaacctccacctcccgggttcaagcaattctcctgtgagtagctgagactacaggctcacaccaccacacccggctaatttttgtatttttagtagagacagggttttaccacatgagccaggatggtctcgatctcctgacctcatgatccacccacctcggcctcctaaagttctgggattacagtcataagccaccacacccagccttcaacgatattttcaatataatatactgtcaatatcagaataatctttgcttatcacccaaatgtgtctttaacaaggacaataaataattaatacatcataacctgcaaacatactctcaatatctagataaaacagctgcaaaggcaaatcttgtcataagtgtaggctggaagaggatattttgaacattgagggtcaggctcaatacaggctctgtgtcagaacacctgcaattccagttgcctcacctgctcgaggagctttaacaggtttcttacaaatctcagcttcagttttcttaaccgtgaaatgagaatgatagtagtgccaatatcataagctttgttaggaagatgaaagatgctatcatgaatgtaaagggcttatcacacagcctggcacacagtgagtgtccagtacgtcttaggcagtatcattacatctaatctttgacttttagctaatacaaataaagaatggctgactccaatcctgggtcactcataaaaagaacactcaaacaatgaaaaactgaaaaaaacttttgattgaaaaccaattggtatcatcatctttccatggtttccaaaattaaattatttttaattaacaaaagcaacccccaccaaaaaaaatcatttattgttaaaatgtgatgagagatcagaagttctgttttaatcacatttttagtatttggttaaagaagattgtcaaaacacttatttctgtcccaaatcttcaactcacctgtctttgacacacaacatacttttgcatacccaattgttttgaaataaacaaacatttgaaagccaaaattctaggctgggctcggtagctcacacctgtaatcccagcactttgggaggccaaggcaggtggatcacctgaggtcaggagttcgagaccagcctggccaacatggtgaaatcccatctctactttaaaaaactacaaaaattagccaggtatggtggcaggcacctgtaagctcagctacttgggaggctgaggcaggagaattgcttaaacccaggaggtggagttgcagtgagccaccaagatcatgccattgcactccagcctgggcaacaaaagcaactctgtctcaaaaaaaaaaaaaaaaaaagaaagaaagaaagaaagaaagaaagaaagaaagaaagaaagaaagaaaggaaggaaggaaggaaagaaagaaagaattcttattattataacattccaaagtattccagaaggcatggaaaatttttgaatttcttatttatatacagttgatcattattattatacatttcatatttacaaattcacctactctctaaaatttatttagaacctcaaaagtagtattcttggtgcttttgtggttatttgcagacatgtgctgtgcagcaaacaatttgtcatcaatgtgtacattctcatttgaagtcaaacaaggtgatgcccttgccttctagtttcagctcttataccataaacaagtatcatttttgtagtctattcagtgccattttttttgcattcttgtgtttttattggtgattttactgtataaaatggcccctaagtggagtgctgaaatgctatctattgctcctaagcacaagacgctgcgatctgtcctgtggagaaaatacatctgttagatgagctgtctttaggcatgactgattgtgctggcagccatgagctcaatgttaataaatcaacaacatttatttcaaaactgaatattaaataagatacacacataaagcaaggtaatgtattggttggttgataaaatgttatgaccagatgcttgcaggaacctaaccctgtatttactttaggaacaatgttttagtattcactaattgagtgttagcagcaactgtatgaaacatagctactgcaaatagtgacaattgactgaattatttttaacctgcatcacatgaatatgatgatacattatgtttttatattattttgcagtttaaacagctcttccacagctattatcacacatgatgttcatggagcgttacagtttggctgtgtccccacccaaatctcatcttgaattgtagctcccataattcccacttgttgtgggagggacccgatgggagataattgaatcatgggggggtttcccccatactgttctcatggtagtgaagaagtctcatgagatctgatggttttataaggggtttccctttcagttggctctcattctctcttgcctgctgccatgtaagatgtgcctttcaccttctgccatgattatgaggcctccccagccatgtggaactgtgagtccattaaacctctttttctctgtaaattacccagtctcaggtacgtctttatcagcaaagtgaaaacagactaatacatggaggtaagaggagagtggttactgctcagcacactagattaacaagtccaactaaggctacccaggtagagcctggtcttctccttctggtttgtgaaatctcatggtgcttcctatagcataaagactggctgtcactcaacaccactgcatcttaaggtccgtggaaggggaacataacatgtttcgaagaaaaaggtctgggctacaaagaccctttatgtaatcttgctaacgacctggaatttaaactttggagagcttgaaggttaacaaattggaataaaaagaaatcaagtcactccttgtttgaatgctctgaagaacaaaacagaaaaacacaatgaaatggtaacagaagaagcagatttggcccaataagtctatgctttgaatgttcctccggcactaacatggccacatttgggaagactggcatccccacagacttttctgtagcactttgaaggaagaatagagcagttgtagaaaaacaaatgtttgcatgaaagaattattcacctcttaaaaatctatagggtgtgaataatcctgctataaaaagcattaaatgtttataacagatatttaatgggactgttatgttttttggcagcaagcatggctagattttgaatgtcacagctctgtgctctggtgataagacagactctgtggtctaagtaagaattattttcctgcttttaaatgtagctgttaaaaaacaataaagtgtatttatctaaggaagataatcttctaaaagaagtgtttaataatttttaattcacaatttatactacttctccaaggtaaattcattttccaactgttactccatctttattgactgggaggaattagcattcaaaatacaaactcagaggttaaagcaaagccatacacagaagtgagccttattccattgtcttttatcacgggtgccagatttatttaacagactgtctttcagtctcacttacagtaactagacaggtactatggaggacagtgtatgttgaatgccttccaagtgtgaaacacctgcctggcactacattatcactaattctaaccttgcaagtaagtgcctacttaaatctgcacttgacatgtgaggaaagaggctctgaagttttaaagtgacatgtgccaagtcatatagctagtaagtggtagaaccatgattccagggtgggtctttctgtgcttgttggtttatttactgtctgtgtttgttttatgaaagagaaaagaccctgagagataggcatagtacaggtgacccttgaacaacaggagaattaggggtgctgaccccctatgcagtcaaaattttgcatacaacttttggcttttcagaaacttactgccaatagcttactgttgaccagaagccttactgataacatgaacagttgataaagacatattttgtatatgtattatatactgtattcttataataaattaagctagagaaaagaaaacattattaggaaaatcataggaaagataaaatacatttattattccttaaatggaagtggaacatcataaaggtcttcatcctcatcttcttcacattgagtaggctgaggaggaggaagaggggttagtcttactgtctcagggttggcagaggcaggagaaaatctacatataagtagactcatgcagtttaaaaccatattgttcaagggtcaactgtgtatttatttgatgcttcagaaaggggaccatgtcaattcctgataaggttctctcctctttccttttcctccatctctctgtgtcgatcctagtgctctcatcggcttttaaccagtagaggtctccaaactgtcttgtggcagcctgggctccctatacacagaaagacctggcttcaaaattctggttaatatgggaagtgcattaggaagtagaaaggaaagaaaagtcaaacaataaggaaaggattaatataaatcataaattaattttgtgggcctaattactattttttaaaacactgtaagttttagtagattttcttactctaagttatagaagtcaaaccctaaaacacgttaaaaaaaatctttttgttatttcttaactattacggttattttatcaaaattaattaatatcaaattaatgataatacaaaggaagtcacattattaattaaacaaagtgacttagccttgcaaataaaacactatcgtgtggattaatagtttgaaggtttaactttacagccttttcaattgactgtaatttagagcatttttaggttcacagaaaaatggagcaaaaagtacagagagtttccatatactccctcacccctccccacgttatacatagtttctcttcttattaacatctttctacgtcatgtttttggtgttacatacttgccacacatagtaccctaataatctcttgggccgtacattctctgggtttggacaaatgtgtaatgacacagatccaccattacagtatcatagagagtggttcccctgccctaaaagtcctctgtctccacctgttcatccctccctcccctctgctccttgcccggtccccaggcaactactgatctttttcctgcctctatagctttgccttttccagaatgtcatataattggaatcatacaatatgtacccttttcagattagcttctttcactttgtaaaatacatctaagtttccttcaggtcatggcttgatagatcatttcttttgattgataaataatatttcagccttatttttgtaaggaaaaaatcaaatcaagaaactaaagtttgaacagccactatagaaaaaaaggcaaaagtcaataaacaaaaacaattgttcagcttcgctcataattgtatacacctcccagctcttggactaggtaacatcagtggccagcaagatgccaccgattgagtgattgtttttatttcatgccatgtgacccattggccctccttttcctgacacatttataatcatcttaatcccaaagcaactgtttttaacaaatatgcatatatcctctgattttctgttgctataacagaatacccaagagtgggtaatttataaagaaaatgactttatttcattcatgcttctggaggctgggaagtccaaggtccaggggccacttctggtgaggactttcttgctgtgtcatggcatggtggagggcatcacatggtgagaaggcaagaccaggtcaactcaggtctctcttcctctttctttctttctttttttctttttttttttttgaattggagtttcactcttgttgcccaggctggagtgcaatggcatgatgttggctcactgcaacctccacctcccgggttcaattgattctcctacttcagcctccggagtagctgggattacaggcacgtgccaccacgcccagctaatttttgtatttttactagagatggggtttcaccatgttggccaggatggtctcaatctcttgacttcgtgatcggcccgccttggccccccaaagtgcggggattacaggcgtgagccaccgcgcccaacctttttttttttcttttcttttttttttttaaagacagtctcacactgtcgcccgggctggagtgcaatggcacaatcttggctcactgcaagctccgcctcccagcttcaagtgattctcctgcctcagcctcccaagtagctgggattacaggcgcccaccaccatgcccagctacttttttgtatttttagtagaggcggggtttcactatgttggccaagctggtctcaaactcctgacttcgtgatctgcccgcctcatcctcccaaagtgctgggattaaaggcatgagccaccgcgccccgcctctcttcctctttctttaaagccaccagccccatcatagggacccaccgcgatgaccttatctaattctaattacctcccaaaggccccacctccaaataccatcaacatatgaatttagagattaagtgtccaacacatgaaatttgggggacacattcaaaccatagcatcttctttaagataatgtaaaactattaaattaaataatagagtagaaatcacactaataatttgtgggtctattcagattatatattacctaataatttttacctattttttgaaaattgttccaatcattccccctgcttccttttcaaaagagtcaaacatagccagttaatttaaggtatctgcaaaacctttccaccaagacttttatggtacagagaagtgactcataagccacaattcaattaaatttagcaaatatttcttggacaacaactacatgcttgaggttggcatggggacctgtttttaaacctcctgttcattctactttgactttttaattacaacagattaaaatatcttattcagcaaaaaaaaaaaaaaaaaaaaaaaaagagagaaaaacccactttgtatattgaatttttgaatacacaagagaagtgcaactcagggtggtgggattcctacctagcaggcctgtctccctttgattaccccaatattccaaaggtgcaggttttgtgcaccaggcactctaataggaccctatcagctcagcgctctcagaaatttcagttgtctcccagcccctagaaagtcacaatagctccagggttgtgcttaacgggccatagtgggaggatttggaaaggagaaggtgaatcttttctgtgaaaagcaggtggaggaaactgaagagtggggagaagagaggtggatgctgacctgaattgtgttttcaggagcaggaagagtgtgctctctgcttaagagatgacctgaatggcaagactacatgtcactcggatggtacacagatactgtcttgatgggagttttcggaacagatttgtcctcccagggtgaaatagcagagagatttgaggcagccctcaactagagtatgaccaataaacaccaacttacttggtttttttcattcctttttccctgtgtccaagaagcaaaatgataatgtaaatgaatacacacacactcacactcacacacacacacacacacaccccatgttggggaggcgggtaaaggaacagaattgctctcagcaaacactggtggcatcaaaatagccaatcatgctgatggctgccacacagctcatggaagccttccacaggccagctctcttgctgttggctggctggacttcccagctcagtccctcacctctttacaggacaaggcacaccagaaaccaaggctgttgggggaggcagcaacagagaccagacgttccctctgcacacacatgatgtcatcaatagaaactctgctgatgatgaacccactttcacacaaaccttttaaagcctgagttattttttgcaatgacaaaaataacaaaccacatttttttaaatagcttccttaataataatggaaattcaggtgacattaatgaaaattgtagcacatgttcaaatcagaatctatgttcagtgttatatgcagaatataaagggatttcttttctcaattgatagaaaagggaagtcatatttaagtagtcacggtatcctagatttttaatatagcaacataattgaataatattttgatgtatctggttttagtatttaaggtgataaaatattaaatttaagcttaaaattaaaaatagaggaaaaagaaaaacaaattgaactgaagtgaaaatgtttcttgttttttaaaaaatcattgtacataacagttttcaccttcacttttagaaatcaaagcacaaccctctatcacatggtaaagagagtcagccatacggaaaaccaagctgattgttctattcctgtgcaaattctaaccctaaaatatttctctataatgctttaagaaagaaagtaaatctggaaaacattttttatcattttgaaagctgcctttgttttgattctcattgtgaaggtcaaggataggagaatttccagagatgggaatttatcttcactttatgctatcatttcagaatgaatagtgatcaggttctaaataatgcattccacaggtgtgagcaaccaccctatcactttctatcttcatgtggctggtgcctacaacactaaatttctgcggcagattcattaaggtagttgttcattccctgtcgtaattagacctcccatttcagccttttatgtcaaatccatcactcaccctggcactcaggctcacctctttacaaagcccttccctggtgctattctggctctaaacacaggtgataaatgtgtcagcatggggcacattcctgtccctgaggaccatcaatcgttaagtacagagagctttttccagcagccttctaagatttatacccatgaggatattatttttgtggctgcatgaaggagaattattacttgaaatgggttttgtgaaaggatggttttggtgttgctttggcaccattttaagcttcttttcacaaaattgaccggcgcaagtcagaatttatacttctatgaatgtagatcttcaccatctgatggtgctgagtcctacagagaagaggatttgagactttccagtttttagagatctctacgatgtgcaagaatctagatattcagaggccgtactgacttcaatcacatggtaaattagtatatgagagttcgcagtaataaaagaagtatgtaagtgatcagcatgtgttttagtcagggttctctagagggacagaactaatggaatatatatataatatatatatatataaaatatggaatttattattaagtaataactcacacgatcacaaggtcccacaatagaccatctgcaggctgaagagcaaggagagacagtccgagttccaaaactgaagaacttggagtccaatgttccagggcaggaagcatccagcacaagagaaagatgtaggctgggaggctaggccaagtctccctcttcacatttttctgcctgcttgtattctagccgtgctggcagctgattagatggtgcccacccagattaagggtaggtctgcctttcccagcccactgactcaaatggtaatctcctttggcaacaccctcacagatacacccaggaccaatactttgcatccttcagtccaatcaagttgacagttagtattaaccctcacagcatgggaggtaatgcgtatgttaaatagtttcatttagccatttcacaaggtatacagattccaaaacgtcatgttgtataccacaaatatatgaaatttctacttgtcaatttttgaaaaaaaatgtttaaaagaagtgtgtaaataacttcttactttagatataaaatcttaagggccaggaaaagggcaccaaaatccagcctttgacatctcagaagaagcgatgattaatttcatttcattctgttggtttccatggagtggtgctgggtggtgaggcaaacacagcagcaggaatgttaacatttcatattttagccctaggagtaaagaaaaaaaacatgtcccagatcagcactagctagaaccaggaaaccccaaaagcaaaggtttttttgttttgttttgttttgttctgttttttgtaaaagacaggttttcacaaaggaagttttccaaattctatgtataagagagttgagaaggaagatttttctctcttcttgcccaggaggacaaagggaagagtaccacattaagccattcaggtaaagtgaagcttattgaacgctgtggattaggataaaactaatagagttttcatttttaagccagttcagatattcagattaattatggacgtaatgtagaaaataccaatttctgcaagttctacatttcatgtgaaatcccaaagaggttaaagctgatgggttttaactgatgaaaacacgtgcctctgattaaaaatgtttgtagtgatgaaaacaaagcatgctagagttacagtgtgtagcatgctgaagccaccagcagagcttaggggacaaaaacaactgtttcctaagagaaaaagaggctgagtatcttaagcctggggaagggaaaagacagtagttagcaagctcaggttagccactggtattactctacctttcatgagactcttcactggggaggttggggagattcggtctcacctaaaggagagatggctcgtgaacccaaggatgctgcagggaccctggccaccacttgcagcccaaacactagaatgaggaccagagaacacaatctagctgcttcccatccatcccctccaccccaacatctggtctcagcaacttcctctgccctacactgggatgccctccttagttgatctgaaccatgcagcagatgaaacatgttggcctgacaagtagcagatggctataattgcctgagccatctacaccggcaaatttttcttctttatttgcatatgagtaaaatttttcccagtgttaaattatggtgtgagtagagattttttgagggagcacagcgcagttgtatagacatcgtgattgacaaaaaataaataaaataaaataaaataaatgaccaaaatctgctaaatgaatttgaattaaattgttctaatgctttctttttctttgtaactcttcaccaccacctcaatacatgcattcctggacattcacgcatacactcacacaaacacaagcatggtattttttgtgtgtgagacactgaaggtagcatgaaatagcaaccaaaaaatctgcagtattaaagttagatatgacttggtttgacttgcaaatcaactgcctcactagtaagatgacttctggtatatggatatgtctctcagttttacaggcttgttttcggattaatggtaatagatgtaaagaattgggcacggtaagtcaatagtcaaagctattcaacaaattgaggacaaacaaggaaatgggttaggaattggtctgtagccagtctcagaaatgttgtattaacctttgggatataatcccccaaaattaaagtatagtgattcatccaaaagtacaaagtgttactagcaagatggatgaggatttccatctaacatttttcatcttcttatccctgacacattattaaaacacctagattttggtaaaagaggagaagtcatgtcttggacaggattgaaggttgtgtcaacattccctatgctttcaagtttcagctttagaatccaaaacccccgggcacagtggctcacatctgtaatcccagcactttgggaggtcgaggcaggcacatcacttgaggtcaggagttcaagacaagcctagccaacatggtgaaacctcatttctactaaaaatatggaaattagccagtcatggtggcgcattactataatcgcagctactcgggaggctgaggcaggagaaccgcttgaacccgggaggcagaggctgcaataagccgagattgcattgcaccactgcattccagcctgggcagcagagcgaggctccatctcaaaaaaaaaaaaaaaaaaaaaaaaaaaagaatctaaaccctttggttcacagatggaaggaaaaagcaggcggtgtttcctattctatgtgtatgccatgcctcgagccctgaacaggctactcatctgtggccaatattatattataacctctccattctcagaaggcacgctggcacccatctctgcaagaaaggcatcaaattgtctgtaagtcacagaaatgttattgtattgtcctttattcattcattcagaatatactctctaagcatctatgtaattaaacattactaagcttacatataattaacctcgaaataataactaagcattgttagttttatgtacggctaacttaagaaataaactcactttctagttatcagttttggaaaacaaaagagctctataacaattttgaattaatcaaaaattggagaattctgtgcaaacctataatccttccctctttagggtgaaggagcaacgctttgtgttacttaaagacacactttgccattgtgattaactataataacttttaaaataatcaaaaaatcagtccactttcttgtctatttgtgtattgatcactaaaattattgtacctagtatgatcaactttgtatattactgtatttcattaaagcagctaacttctcttgtccagacataagagaacactagaagacaaaaaacaaaaaacttttatgaatctcttttccttacgaacactaattttataccattttaacatacttgaggtggcaaaaataaacatatatatattatatcatccaaaagtatttgcatattttattaatctattgccattctaagaattcagggtaagttaaaattgtgttaccaaccagcatttattttgcatctgtttcactcttgaaattgtctaggtttcaaagattattaactaattaacttcaccatttgtctaaggtcttaaagttagttaaggatcgagaaatcacaatttttgcaaacataatgaatcctgacacccagcacttaaaaattttacaaaacttaattcttttaaaaatccattaccttttcatttaattgactataattatatgtatgtatgtgtatacattttaaacaagttataaaatttgtgatgatccacttataaaaacaatgtaggaaatttaggaacttaaatgataagaaatttatcattggtctcgtacaaaccaaagtattattctgatattatttttatatgataaatgaaattgtaaagaccctaagtcgtgctcaaggctcttcttctatcttgaactaaggttttcttcttatcttgtaactatagtaacaagggctacaaaagaagcacagcttaatatttttccttttagacatttttgactactaatatggtacagatattcctaatgtgcactcataatgatagagtgaatattttaatcaattttttttttttttgagacggagtctcgctctgtcgcccaggcgggagtgctgtggcgcagtctcggctcactgcaagctccgcctcccgggttcaccccattctcctgcctcagcctcccgagtagctgggactaccggtgcccgccaccgcgcctggctaattttttgtatttttagtagagacagggtttcaccgtgttagccaggatggtctccatctcctgacctcgtgatccatccgcctcggcctcccaaagtgctgggattccagacatgagccaacgcgcccggcctcaattaatttttaaagcttcccaaaagaggataaaagaggaggaaaggaatagaaaaaaaagcagtgatagggacccaccttcagacacttaagacattatcgctgtaaaaagcaagggtcttccctctgcaagaagaggcactaaatgtttagattcaggaaaacccactgtgacatatatacatgcaaaagataactcttacagctggtataaacaattatttgggccttgaaattcttatcaagtaacatgtttaaaagccagactttattaatcctcaaagaacagaaatgtagaaaacagcatttacaatgagccaaaaactctctctttttagattgcaagacaggtatctcttcatgaagctttctccaatttttgttctcaggcaccactcaaatgaacaatcttgttcatgtcaaaaaggtccccaaaatagccactgcagttcaaaattatcctgtgaaattggctaggcatggtagctcacatctgtaatcctagcactgaggtgggcagattgcctgagatcaggagtttgagaccagcctgggcaacacagtgagaccccccccgcccaccatctctactaaaatacaaaaaattatccaggcatagtggcatacgcctgtagtcccagctactcgggaggctgaggcatgagaattgcttgcacccgggggtggagttcgcagtgagccaagatcacgctgctgcacttcagcctgggaaacagagcaagactctgtctcaaaaaaaaaaaaaaaaaaaaaaattatcccgtgaaattctgccagttaaagacacaagcatgtcagttaaggtgatgtgagaaagcaggtatttgtttcatagaaaatgcccagttttaggatggatcagacactatgagcactgcaatagatcctcccacacgatggtgcccgtgcagcctactttcgtcaggacttggccaaagcccattccagggtcagacaatcccttctgatttcaagaagcctaatctaaacaaagcagctctcaggaaaagaacaagaccgacgaaaaagttcttctaagggttcgaaatcatgacccaagtcaaagtttattcaaagaatgttgattgtaggagaacttctgaactcctaggcccctgagccagctcaagaactgacttacctggcttatgctcattgtctccctagagaccttttgttttagagataaagaacactcaagacactgtacaagcagacagtccataggaacatatatctgtagactggtaaacagtatcaccaaagaacaataaaaatcagatcagataaccaaaaagtcactggtaaccttattcctaggggaagaaaaaaaaagagagggagatagagaaaaggaaggaaggaaggaaggaaggaaggaaggaaggaaggaaaaacacctaaagtggaaggacctcagcagaatatggaagctcagttcagcatgaacttctcctagcacgggcagtgtggttacatcagacagctagagacacaaagggtctcaaataagcacactaaaattggtgagtggagggttcccatccaagactgtagggctcacagatgaatattgatggatcttcaaatgcagagattaattacagccactgaccactaggagcccacctgtagtagaacaaatgtgggattcttcactcattgcatcatgggagattgctcattatggagaaccatagaggcatctcagtaagaggatgctggaaagagggtgctagaaagtgctattcggttttcagtaggtgatttggggagagttaaaaaaagtaggggtttgttctagattggatactgtcaggaagcaggtaattctgtgattgaatatcttaatttttttttatcttgaagacagtagagaaaaacagctgtagttggtaaagaagtagaaatgatgtgtattaggctgagaaggggtatgttggatcattttcgtgttctggccagttttcttttttcagtgctgagacatgtctcatggagtgacctcttctttgcctttccccatgaaggtcacggaatgaccttgtctgatgttgagttctgtgaaatggatcaccccaaacagaagcacacatggcctggctgtgagttcccaaacagctccccacgctcaagagctgcttttctttctcattctcaattaaggattgaaggaggacacaaaaacacgatcaccaaaggaaaatgaaacaaatttaaagtaaataaaactcagcaaaaagaaaaactacaggaaaagaaaagtaactgtaggaaacaataatgacttagccctaaatggcatttacgtggtcttaatcatatgtgaccttaatcctataaaaaccaaattgtgatctaactccaagtccaacctgcctattttagaagggtagttggatggtgctagtggatggtggggaggagagtagaagctaactcatcatcatccgtattggtaagtgaatagataatgcctaaaaacatgtcatgaaattgcaatgtcaccacatcatttggagatacgtttttaagtcagcctaaagggttgaaaatgcttctaggctggggcaacgggagggcagagcatagaagatggtaatgattcctgaccatccttcaagaactatctttctaattttttccatcttctcctccctgctttattctagccacactggcagctgattagatggtgcccacccagattgagggtgggtctgcctctcccagcccactgactcaaatgctaatttcctttggcaacaccctcacagacacacccaggaacaatactttacatccaaccaagttccaaggattggaacaatacaatcaagttgacactgaatattaaccatcacacacagacatatatacatatatatatattttttagacagggtctcactctgtcacccaggctggagtcgagtggtacaatcatggcttactgcagcctgaagcctcaacctcctcagctcaggtgatcctcccacctcagcctcccaagtaactgggactacaggcacacaccactacaccttgctaatttttgtattttttgtaaagatggggtctcactaagttgtctatggctggtctcgaactcctgggctcaagtgatccacccactgtggtctcctaaagtaagtcatggcacctggccaactttttttttttttctttttttttgagatggagtcttgctctgtcgcctaggctggagtgcagtggcacgatctcagctcaccacaatctctgcctcccaggttcacgcctttctcccacctcagcctcctgagtagctgggactacaggcgcccacgaccacgcctggctaatgttttgtatttttagtagagacagggcttcaccgtgttagccagaatggtctcaatctcccgaccttgtgatgtgccctcctcagcctcccaaaatgctggtattacagatgtgagccaccacacccggccccaactttttaaaaatattttttaaagaatgagtagaagtagccaggtgaagaaaagaaaaggaaacagagctgggaaaaggtgtgttgcatcagaaactagaggagggcatttcgcctggaccagagaaagttctgatgagccaggaaggctgggcagagccagctcaggccaggcaggcgcgattctgcacaggacaggatgcacctccaatgaccacgtgtttctaggttgtttccaagggcacacagataacagtcaacgatttttttctgactagccactgtagtgatcgctgctgtgtgaccctccacactttgcttccctcgggcctcagctccgcctcattccactggcctaataattaactcagccttattttcccaacctaattgtttcacagaccaaaagaaatattggatgtaaggtacaatttgaaaagtgtaatgtgctctagaaatgcataaaatgatgattagtctttgcccagtaggctttttagcttaataagctcctgataatacagaaatcactgtgagcaactggcagagaaagatttttccatttctcttaactaagaaaagagatttaaagtcactttggagagctaacactaaataataataactgccaaaggaattgatttgatgctgaatataggcttgtgtaaggaggtaaaaaactgtccactaaagttaatgctcatagtaagaggcctctgtccttgaattcaccttgagagagttgaacagggataacggattttcaaggacacacatctacagagaaagggcgtatggaaatggaaaagggaaagctgctcctagtgtttttgctgaattgttctctttctctaacccagcaggagagatgctaaaggagattttgtcaaagaaaatccttgacattggattcttaaaagccttatggtttcatgataggccctttaccaaggattcttaagggacaaccttatgttagagagaaacaaagtcctgaatcatatttcctcctctctggaatatatgtagaaatacaagtgagaagataaatacatgtgtaaaaagaaaattcatactttcatactcgttatatgttatgattaaatgttgattgcatttggagagcatcagcatatgaactatattacagaaaggatagtcttttgtttcatggcttaaatcttcttttctcaataagattaaggggctagctaagattataatcataacaattttttttttttcactgagtttccaccctgtgaggaacactaggctaagcaggaaaaaaaaaaaaaaaagtcactaaaagaccctaggctatttgtacaccaatgttcatagcagcattattcacaatagcaaaaaggtggaaagaaccaagtgtccatagatggacagataaacaaaatgtggtctatacgtacaacatgggtgaaccttaacattgtgttaagggaaataagccagttacaaaaggacaaatactgtatgattccatttctatgagatacttagaggagttgaaatcatagacacagaaagtcagatggtgactgccaggggctgggaggagggacaatggggagttgttgtttaatgggtatagagtttcaattttgcaagacaaagaatttccagagatgggtggtggtgatggtgcacaacaatgtgaatacacttaatgccactgacttgtacatttaaaagtaggttaaaatgggccaggcatggtggctcacacctgtaatcccagcactttgggaggccgaggtgggtggatcacgaggtcaggagtttgagaccagcctgactaacatggtgaaaccgcgtctgtactaaaaatacaaaaattggctgggcatggtggcatgcgcctgtaatcccagctactcaggaggctgaggcaggagaatcactggaacccgggatgcggaggttgtagttagccaagatcatgccacttcacttcagcctgggtgacaaggcgagactccgtctaaaaaaaaaaaaaaatatatatatatatataggttaaaatgtccattttatgttaggtacattttactgcataaaaaaaaaaaagactatgggcaagccatttccttcctctgtgcctcagtgacattatctgtgaaataaatgtgtagaaacagatggactccaaggatgcattcaactctgcaagtctgtgtgtctaaacatcccctctgtcctcatggggtttagcagcaagttggagagatgaaatgcagtaataaaatgtaaaatacttctagttaatgttttaagtacccaattagtgattttttaaaaaggaatatgtattcccttgagaagggatagagcagaaatctggaggacagctttgtggagatagaactggaccatgcccacttcaagaagtatgtagctcggatgtggatctgtgccagtgggatggccttaacaaaggtgagcaggcttcaccacaccagggggtccgtagaacagcaagaagatgagcctgttggtggtagaaggcttctgcgtcaaagtgaagcattgaggaggacccatgggtgactttgagggactctgaatggaagagagtggatggacgagacacctggcctatccacaaactggccctatagccttgaataatcactgggacctcagttcctgctgtatgacaccaaggctagctcctttacaagacggaagcacagcctagctgatcttgctcttcctgctggaaaactccatgattctctttgccttccaggcaacagacacataagattcctgctgccaggtcactgctggatgctggactccagcagtgacaggccccgaacctgcccttgtgaaggccactttcttagtggtggtggctcatctagcaggctgaggaatgtacaaaggatgtgtaagaaaatctacctagcagtagggtatataatgagttaaagaactgagcttctactggcaatgagaccagccagggtaatgttgcaaaagtttagatgtacattaagacccagaagggctgaacttggttaggggagaggaacatgaaatgaaaagtctaatgcatgaaccctagaaccacatgaatattaaagctcacactgaagtatctgtgcctccttctcccttgccctgccctttttcagcctcccaaagctgcacccattcctcctgtgtccccaatatcccctatgccatgtgatgtggtttgactctgtgtccccacccaaatctcatctcgaactgtaatccccatgtgtcaaggggggacctggtgggagatggttggatcatgagggtggtttgccccgcgctgttctcaggatagtgagtgagttctcacaagatctgatggttttataaggggctcttctcccttagctttcgcttctctcgcctgcctacttccccttccccatgattgtaagtttcatgagacctccccagccatgtggaactgtgaatcaattaaacctctttcctttataaattactcagtctcgattattctttttttttttttttttttttttgagattgagtctctctctgtcacccaggctggagtgcagtggcaggatctcggctcactgcaacctctgcctcccaggttcaagcaattctcctgcctcagcttcctgagtagcttggattacaggcgcctactactgtgtctggctaatttttgtatttttagtagaggcagagtttcacatgttggccatagttgatcctgatctctcaggagatctgcccaccttggcctcccaaagcacttggattacaggcatgagccttgggtatttctttatagcagtgtgaaaatggactaatacaccatggtaactgggtcccatacatcctgaaaatactaatagaacaaatattcccactcctgaaatttaacttgatcctgaagacgaaggatttccttgagctcataaatggaagtggttcatcttccaggtagagaatgcaaggtagattggttttgttcacaggggtcatgcagagctaagcacatagaaggtgctcagtaagcacctgctgaacatactgaagtgacatagccaggcagagacgggtaggtggacagccaacacgccatgagagctggaagggcgcatcctctcttaggagcttgggccctggccagctgactcagcttcaagctctgctagtacataagtccctcggggcctataagcttggccgtgttgcagctgaaatttctgctgaataaggtcatacatactaagctgagaatgcaatagtgagaatggctccttctttttcgcatcccagaccccagaatagaaatatttaccatcacgtctggatgataatatcaataaattatcagacattgcacgtattaagaaaagctcattttctggaaattgtccttattgtcctaattgggaattatcttgaagccgtggatagaaaatgacctttcagattgctgggacaaagcccaagtctaaattggaaacgtgtttaatggctaagacagcccacttccagattaattatggatgcttttccatttcaagattacattaggaaggaaagttgtcactgggtggaatgtgagtctccactgcatccttttaagataaataagttgaagtttgaagaaaatttgagattacttttggttaagtgaataaaatctgtttagcgaactctttgaagttgtggattgcctgggaatctacaaatctgcaacctccctccctctagatacattcagagggtagaagagaagtcatttaaaaccttatgcttgacttcttgcttcctgccttggtttttaaccaaaactaaaaataaaaaagccaaaagagaggaaacttgataggttcaaaacaggaaattagattgtaagcaaagaaattgtccaaacatcgaaaaaaggaacacatcaaagaagggaggtgctttgtttttatactttgttatcgtcctggaaaaaaatgtctgctgcctctgataatacatattaacacttcttttttacttagcttttatttttatcaaagtaataaaatcatcttgtttaaagtgtcaaatagttctatatggcttattaggataaacaaccatccaattttcaagatttttttttcctttggcatttgtctttaattctctaaatatattcacctgctacttgaggggtcagcagacttttcctgtaaagagcaaaacaatgagtattttaggctttgagagccatagagtctctgttgcagttactcacctctgctgttgtagcacaaaagcagctgtgggcaatatgtaaatgagtgggtgtagctgggtgctgaaaaaactttatctacaaacacaggtggctgcacagtgggctgtcctttaccgtctcctaggctactccttgagtttctgtttttagtcagtcactgttaggtgactcctgactatggaagatgaggattaggctctttcacagccaacaactctcctccatggcctcctcccctccatgtttttcctttaccttcacccttccaataggatggtttactggctttggatagatccgtatgcagtgtttacatcatcatgcttttcataactgaaccatataatagagctgtgtttccagccaggcatggtggttcattcctataatcccagtgctttgggaggcacaggtgagggattgcttgaggccaggagttcaagatcaacctgggcaacatagtgtgagatcctgtctctacaaaaaaaaaaaaaaaagacattaacttggtattatggtgcacacctgtagtcccagctacttgggaggctgaagtgggaggatcacttgagcccaggaattggagactgcagcgagctatgatagcaacactgcactccagcctgggtgaaagaccaaggccctgtctcaaaaaaaaaaaaaaaaaaaaaaaaaaaaaagtttcctttcctacacactattttgttttccttaatcattatattgttttcttcatttgcttaattttttgtgaactaattatgaattgaaactcaagctctctctcaattttaaaatcttccctcaacatattgcagccaatataagaggaactcaccatttcattttcttggaaacttctaccccagagcattctggctggataggccttgggcatctgtattagtctgtcttccttctgctataaagaactacatgagactgggtaatttatgaagaaaagaggtttaattgactcgcagttctgcagggttaacaggaagtctggctaagacgcctcaggaaacttataatcacagcagaaggtgaaggggaagtaagcatgtcttacctctgcaaagcaggagaaagcgagtgagctgggatctgccacatacttttaaaccatcagatctcttgagaacccactcacactatcatgagaacagcaagggagaaatccgcccccatgatccaatcatctcccaccaggaccctcccctgacacatgggattacaattcaaggtgagatttgcgggggggacacagagccaagccgtatcaccatccttgcatctctcttctccatcatcatagataacctgggcctccggatggcatgagatccccctcctacccggcttccatgactttctctttgttgatctagtcccttttttaaaaatggagccatccttctgtagcttcctgagaaagaatgaacgggaatcacattttctgaaacattgcaagtctgaaaatgtctttattctccctcatgcttaattgaaatcagactgaatacagaattctcatttagaaattatttcccttcacaagtttgaaggaatttgtctattgtcaatagtattgctctcaagaaattcaatgccattttcattctcaattctttatttgaactcggtgtttttctctctggaagattttaggttcttattcttctttgttttctgaaatctcatgaatattatttgatgtgggtctattttgactctttctgttggaacacacatggggccttttaatctggaaagccgttcttgaactctaggaatagattttgggggacaatttcttctttcatttcctgttctctcttcccagaatttgttattcagctatcagaccccatggactgatctgttattttcttatattttctttcatttgttcaatttctttggctgttgtttcccctattctctgaacaatgttctcaaatttacatttcataaactctcattgagtttttcacttctttttttatgttctgaatttccaagagctctattttttgttctttgaatgttcctttttttaaatcatctgttctcatttcatgaaagcaatatgttatctctcagaaggtattaatgacggttttctcccaagtgtttcttttcctactcagcctctttttccttcaagtagctttctttggttggttggttggtgtgtgtgtgtgtgtgtgtatatgtgtattttcgtttgtttttcttttttcttctcctgtgtttgagacatgtcctcaaatgcctggttcccctttagctgacacccacatttaagattgaggcactacaaatatgactgaaagttctgtgcacacaaatggggcctgtcacccgtgggcttcagtggctgagttgtttcatcgggaagcccctgatgttgcatcactgagatttttgtcttgggctgattgaaagctccagagaagaattttctgccctgttgcctggagggtagacacctggctgtcactgttctcacagctaagaaggaagaggactgcgaggttcaagattcagtgtgtaaatgttgactgaagatccctgttttcagtacagagcccctgccgtcctatgcctagagtcctccaactgagagtctctgtgtccttcccagagaatacatcgttcctcttctgccagagtgaggggaggacagatgcctggggtagggatctggggatataaatgttcttcacgagcttccagtgagttcttctgtttttagcttcacataaacacacatatccagtggaaactcttgccatcaactgcacaaataatgggcggctttgcagtgccaaccgggctacttctcagcactctccacctcagtgcaagcatctgtccttggatatgctgccacttaagatggttctgctgtttttcagctctaaaaaggttgttatcatcccctgcctcatgatttgttcttacaccttcgtatatcttaacacttcattccccttttcacgggctttatgaagaagcagtggtaaatgtaggtgctcaatccaccatctttaatgggaatccttcagcacttctattttagaaaaaatgtgaagaatatacatagagactgggcatggtagcgcatgccggtaatcccagcaatttgggaggcggaggtgggcagatcacctgagttccggagtttgagatcagcctgggcaacatgacaaaacccacccatctctacaaaaaaaacacaaaaattgcccaggcatcgtggcacacacctgtagtcccagctaatggggatgctgaggcaggagaattgcttgagcctgggagatggaggttgcagtgagctgagatcacaccactgcactctaacctgtttgacagagtgagaccctgtctcaaaaaaaagaatatactaaacactcatttcacaatattcttgacttattaaagctggagtcatggcataatttccaatttgcttttcaaaagaattaattgatcagctaagaaatttacaagtaatttttttcaaatagtgaggtcccttagtattaaaatgaatttcatgttttaatactaggtttttcctcccacgcagtgaattttcttcttgctttaagaagaaatgctctggagagaatataaaattatatatagttgtgtatgaattatatgtcataggattacatataattatatgtaaatataattacaattataacattaatacatgttcactgcagaaaacttggaaaaaaacaaagagtttaagagaaacttcataatcaactgtattctcaacaactacagaaagcttaaccaatgatttgtccgtatccatggctaagaacgaatgtacctacacatctgtgccatttttaaattggcattttttaaaaagtagatccaattttagaagtttgaaatctagtttaaaagcctagattttatttttttccattttaacctatttatgtatttatttatttatttatttatttatttatttatttattatactttaagttctggggtacatgtacggaacgtgcagttttgttacataggtatacacgtgccatggtggtttgctgtacccatcaacctgtcatctacattaggtatttctcctaatgctatccctcccctagccctcccaccccccaataggccccggtgtgtgatgtccccctccctatgtccatgtgttctcattgttcagctcccacctgtgagtgagaacatgcagtgtttggttttctgttcttgggttagtttgctgagaatgatggtttccagcttcatccaagtccctgcaaaggacgtgaactcatccttttttatggctgcatagtgttccatggtgtatatgtgccacattttctttatccattctatcattgatgggcatttgggttggttccaactctttgctattgtgaatagtgccgcaataaacatacatgtgcatgtgtctttatagtagaatgacttataatcctttgggtatatagccagtaatgggattgctgggtcaaatggtatttctggttctagattcttgaggaatctccacaaagcctagattttctagaggaattcttctctatacagggaaacattgcagtaatgagtttaagtgcattgattctttaagcacatttgtttgttgaatgataagactattgtatgtagttcacatccagccccctacacaactgtcacacacaatgaccttcacagtgattcatgcctgaacaacattgtttcctttgcctttaggcttgcaattgggaactcattttatttgaaccaaagccttcagtcgagatgaaaattttcactcacgtctgtgtgaagagaccaccaaacaggctttgtgtgagcaacaaggctgtttatttcacctgggtgcaggcgggctgagtccaaaaagagagtcagcaaagggagatggggtggggccattttataagattcgggtaagtaaaggaaaattacagtcaaaggggggttattcgctggtggcaggagtgggggtcacagggtgctcagtaggggagcttttgagccaggatgagccaggagaaggaatttcacacgataatgtcatcagttaaggcatgaacaggccattttcacttcttttgtggtggaatgtcatgagttaaggcaggaaccggccatctggatgtatacgtgcaggtcacaggggatatgatggcttagccttgggctcagaggcctgacattcctgtcttcttatattagtaagaaaaataaaatgaaatagtggtaaagtgttgggacggcaaaaattttggggggtggtatggagagataatgggcgatgtttcttagggctgcttcgagcgggattaggggcggcatgggaacctagagtgggagagattaagctgaaggaagattttgtggtaaggggtgatattgtggggttgttagaagaaacatttgtagtgtagaattattggtgatggcctggatacgattttgtataaattgaaaaactatacggaataagagaaggagaaaaacaggtattaaaagactaagaattgggaggacctaggacatctaactagagagtgtccaagggggttcagcataattacttacttggttggcaagtttttgggctctatccttgagttttttatgttgtcatacaccaggccagattgatttaggtaaaaacaacactcttcatttaagaatatacagagtcctcctttttcagcagtgagtaagtcaaggcctcagcggttttggaggacaactgcagctaaagagtcaacttgggcctggaggactgataaagtttgtgatatgtctgtgatgctagcagagaagtcattagagaggctacggaaggtcgtgacagaggttgaaatgcctgctattccagtaccgagagcaatagtagaggcagaaagtcctaaaccgacaagcaagggaattagtggaataactcttttttgtcgtgtcggtgtcatgaggggaacagggagctcttcggtcctatttgcaaattgaattttgggggtaaggaagactagtgtgcatgtgcctgtccaattagcaggtagacacatgtaggtagaggatccacagacgaagagaccttgtgcgaggcaaaactggagatgcaaagtaaagagaagcagtgctgaaaggggtgtcttgtacccagactcctaggtatccagctagggtggcagccgtcagaggttgtaatggggattgatgaagtaactgcgtagagggggaggttcgatttacatggtgtgtgagaaaacgttgagtatctacgagcaacctttcactgttattttcggggctgggtataagtaaacaagaagagggctttggagatgaagagtaaaggaacatcgagaaggtgaaagattacctaagggaattccagtaggtctttgctgagagatacataaaggagcggccacaggaatagtagtttgtgttgtgagaggtctaaatatggggggagtagagttgatataaggagaaaggtttttcaagtaagtgtggaggagggtggcagcttgctgatgtgaaatgtctggggaggtcttgctggacctgtctagaaagtaaatgagttcttcaggagggtaaaagtgagggctgttaaaggaagtctggaggtgtagggagacaggaggtgttgcctagtctgcatgtaaggtggggacaactgtgtaggccctggaagaaagggaaatgcaaagccagtggttgtttgctaaggagggattagaaacggctaggagagaatgagtaaggttgatagcgtggtggagatagctggggagaggtagagggtggcagaggaatgggaatgagaataaaagtgagtataaaagtaaagaatagaacttcgtcagggtgaaagtactggagggtcccctgccagcaaagatcatctatccactctaagagggagttaagagttgccagtcctgggcgggggcaaatcctcgagcttgatgtgtagggaagggagggggcctgaataatccctgaagagtagcagaatagcagatggaagaagttacttccttgaggatagatttccacgatggaaagaaaatgagaggttctaagaggcaggctagtggcttgtactatagcatagcctgcctttgctggtgtgtggcgattaggcctggtggaactgccatcaataaaccaagtgtgttcagggtgaggaacaggaaagaaggaaatacggggaaatggggtgaatgtcaagtggatcagagagatacagtcataggggtcaggtgtggtatctggaatactgtgtgaggccggattgaagtctgggccaggaacaatggtaattgtgggagattcaacaaagagtgagtacacctgaaggagccggggagcagaaagtatatgcatcaggtgggagaaagaaaatagatcttggaagttatgagaactgtagacagtgagtttaacacagtttgtgattttttgggcctctaaaagtattaaagcagtggcagcagctgcatgcagacatgagggctaggctaaaacagtaaggtcatagttgtttggacagaaaggctacagggtgctgtcccggctcttgtgtaagaattctgaccgcactaaccatgcctaggaaggaaaggaattgttgttttgtagaagggattggggtttgggagattagccagacacgatcagcagggaaagcacgtgtgtttttatgataattatgctgagacaggtaacagatgaggaagaaatttgggcttgactgaagtaatgggagctgtctgtgaagccttgcggcagtacagcccaggtaatttgctgagcctgatgggtgtgagggtcagtccaagtgaaagcaaagagaggctgggatgaagggtgcaaaggaatagtaaagaaagcatgtttgagatccagaacagaataatgggttgtggagggaagtattgaggataggagagtatatgggtttggcaccacagggtggataggcaaaacaatttggttgataaggcgcagatcctgaactaacctgtaagccttgtctggttttaggacaggtaaaatgggggaattgtaaggggagtttataggctttaaaaggccatgctgtaacaggcaagtgataacagactttaatccttttaaagcatgctgtgggatgggatattggcattgagggggtaagggtgattaggttttaatgggatggtaaggggtgcatgatcggtcgctaaggagggagtagtggtgtcctatacttgtgggttaaggtggggagatacaagtgggggggatgtgaaggaggcgttgaactgggggaaaaggtggcaatgaggtgtggctgtagcccaggaatagtcagggaagcagataatttagttaaagtgtctcggcctaataagggaactgggcaggttggggataactaaaaaggagtgcttaaaagagtattgtctaagttggcaccagagttggggagttttaagaggtttagaagcctggccatcaatacccacaacagttacggaggcaagggaaacaggcccttgaaaagaaggtaatgtggagtgggtagcctccatattgattaagaaggggacagacttgctctccactgtgagaattaccagaagatcggcatccgtgatagtctagggggcttccgaggtgatcgggcagcgtccgtcttcagccactaagccaagaagatctgggaaggagtcagagagccttaggccagagttccaggggctctgggagtggctgccaggtgagttgaacagtccgattttcagtggggtcccgcacagatgggacatggcttaggaggaatcctgggctgcgggcattccttggcccagtggccagatttccagcacttgtagcaagctcccgggggagaaggttctggaggaatccctggcagctgcagttcaggcgtttggagttcttgtgtgctggagatatggctggggtttgtctcacagtggaggcaaggaattgcaactcagaaatacattgctacttggctgcctctactctattattgtacaccttgaaggcaaggttaattaagtcctgttgtggggtctgagcaccggaatttaatttttggagtttatttaatgtcgggagcagattgggtaataaaatgtatattgagaataagacggccttttgaccttttagggtctagggctataaagcgtctcagggttgctgccaaacaagccatgaactggactgggtttttatatttgatgaaaaagagcctaaatgctatctgatttgggataaggaaaaggagcattaaccttgactatgcctttagctccagccacctttttaagaggaaattgctgggcaggttggggagagcttgtcactgaacgaaactgtaagccggactgggtgtgaggaggggagatgataaaaggattgtagggtggaggagtggaggctgaggaagaattggaacctagctcgacctggcaaggaggggagaggtcagatgggtctgtagaaaaggaagattagaaagactcagcgacacttggggttgggactaaggggacaggtgggagggaaagaaggaagatttgggacaagttgcattgggaacagagactagggagggaccgatgtgtaaaagagtgcctggatgtcaggcacctcagaccatttgcctattttatgacaagaattatttagatcttgtaggatggaaaaattgaaagtgccattttctggctatttggaaccactgtcaagtttgtactggggtcaagcggcattgcagaagaaaataaggcatttaggttttaggtcaggtgtgagttgaagaggttttaggtttttaagaacacaggctaagggagaagaagggggaatggagggtggaagcttgcccatagtgaaggaggcaagcccagagaaaagagcaagtagagacatggagagaaggggtcggggggttcttgccccctagaaaagcggtacttgccgctgagggtgaaggagaaggagttggggggttcttgccccccagaaaagcagagaaggggtagagacatggagagaaggggttagggggttcttgccctccagaaaagcggtacttgccactaagggtgaaggaccaaggcaggcgtccccgtgtggtcagatgcctctgaaatgtgggtgaataatcaggcaggcgtccccatgtgattaaacaccaagggaagactgtcttccccagtccgtgaccggtgccggagttttgggtccacagataaaacgtgtctccttcgtctctaccagaaaaggaaaggaactgaaattaagagaagggagagattgaagtgtggcaccaagattgaaaggagaaagaggttgagggatagtgagagaggttggagaagagagtaaaaagaggccgcttactggatttaaaattggtgagatgttccttgggctggttggtctgaggaccagaggtcgtaggtggatctttctcacagaccaaagagcaggaggacaggggattgatctcctaaggaagatcccctgattcgagtcacagcaccaaatttcacttgcgtccatgtgaagagaccaccaaacaggctttgtgtgagcaacaaggctgtttatttcacctgggtgcaggcaggctgagtccaaaaagagagtcagcaaagggagataggggtgaggccgttttataagatttgggtaggtaaaggaaaattacagtcaaaggggggttgttctctggcgggcaggagtgggggtcacagggtgctcagtaggggagcttttgagccaggatgagccaggagaaggaatttcacaagataatgtcatcagttaaggcaggaacaggccattttcacttcttttgtagtggaatgtcatgagttaaggcaggaaccggccatctggatgtgtacatgcaggtcacaggaaatgatggcttagcttgggctcagaggcctgacaaaaatgttgttaattgctctggttatagacagaatagtagcaggaataaataatcagaaacatttatggattatatctttgttgatattttaaacctatcagttacctttctagcctaatgagaatgccttgataaagccacattcttggaaattttggttttcataaatgtgcttgggttttataagtcctgctttgcctaccacttgaccaaattccctacagacttttttatataaacacctatggttaagacaaaatgtgttctttcaacaatgtacagcttctgagagtaatgtctaggctggagtatattcatatatattatttatgctttcatttaacaaacacatgctgagatcctactttttgccggacttagtactgattgctctctcctgagcatccttcttaagtcaaagagaatattcattgttagggaaggaaaaaaagatagagggaaaaaaaatagatggcaagaacatggcaggaacccagtcctgaacacccaggggttttcagaataagggagaggttaacaatctacatagagcaactgggattaaaaatgggaagctggcttcatggggggaggaatagcattaggagatatacctaatgtaaatgacaagttaatgggtgcagcacaccaacatagcacatgtatacatatgtaacaaacctgcacgttgtgcacatgtaccttagaacttaaagtataataaaaatatattaaaaaaaaaagaaatgggaagctggctgccaagactgcaggaagactgtgtcagattcagagcatgaccatcagcaaggtaaatccctactgcccacagtcataattggcaccagactctaggaaggaattatatatttacgtggtgcctaatggggatgtgaggatctcagagggagaaaactaggtaggcacaaataatacccgcacaggccttatttacacctattttatgcaaagttctaatagaaatcattaactggtttcctagcccttgcaagatccaacacaaattagtagaatgttctagaaggaatagaagtaaaaatatcaatcacagtaagaacaggcagctagatgcatattggcaagagggcagataaatagaaagatgtgagaagtcaaaaatcctattgcgatctcattttgcagggaaccaaagatcccaaatagctctctctggaggcaccagtgtatatattattaaagactcagcgagaaaagacaattcactttaagacagcaaataaacaaataaacaatgtggagctgccattcccaatccatttatctggaatagttcagcctcatttggcaatctgtattttttctgaagccccacggggtcattaaaaactccataggtcccaaatgtatttgcataatgatagatgccatccccctgcctgacagtaaagaagcagcaatttaaaaagtatgatgccagccaggcacagtggctctcgcctgtaatcccagcactttgggaggccgaggtgggcagatcacctgaggtcaggagtttgagaccatcctgaccaacatggtgaaactctgtctctacaaaaaatacagaattagccaggcgtggtggcacatgccagtaatcccagctactcgggagactgaggcaggagaattacttgaacccaggaggcagagtttgcaatgggctgagatcatgccattgcacttcagcctgggcaacaagaatgaaactccatctcaaaaaaaaaaaattcatggtattattcttttgaggaagcatactagaaatcaagaatcaggccaagtgctgaggctcatgcctgtaatcctaatgctttggaaggctgagatgggagggctacttgaggccaggagttcaagatcagcctgggcaggacagcaagactccagtctccaaaaaaatatttttaattaaaaaaggaccagtcttattaaagtaaactgcagtcctgttactgatcttagtatcaaagcaatgttagagcccacgtgggattcacacctcctagagttcacagcacaagtttgctgtaacagtagataaggtcttggttgccctgagctcatttcttttttttttttagacggagtcttgctctttcgcccaggctgaagtgcagtggtgcgatctcggctcactgcaagctccgcctcccgggttcatgccattgtcctgcctcagcctcctgagtagctggaactacaggcaccacgcccggctaattttttgtatttttagtagagacggggattcaccatggtctcaatctcctgacctcgtgatccgcctaactcggcctcccaaagtgctgggattacaggcgtgagcctccgtgcccggccctgccctgagctcatttctaaatccatcttcctccaaggtggtggcaagcatgcttctttatcccggagagatggccctttcatcaaagtctcattcagacccttctccttttggaatgcttttcttgggaggttggctgggatgcctactactcttgaggatctgcctctgatagagcctagatcttagaatcaggagagtttcttgcaggcccatcagttactgtgaaagatacctgagctagttggctcacaatccacatccatcaaaccgccccctgcagagaagtcacccggctgtcgcctgcttggcttgccctgcctctcgccattctcatttcattagcaatgcgaatgttcacacccttcaatgtgcatatgatgggtgttaatgagcataacacatctgtgaagcgtgtgtgatttttttgcctaataaataggcagtaaacaagaggaagggaagagctactatctgggggcatctgagaaaacaaaaagcaagcaaggtatgagtcagattgattgttcagtgaatcccaaagggccaaaaacttcctaaactggttttggtgtttctcactaggtgtttggacagcttggaacctggatagtcccacctacccaaaagcattcaaattaggcatgcttttaacaaagcaggtggcatggcatgtaaattgtaggaacactgttaacctttgcaaatgagtttcgtggtccgaatggataattacatatttccctccattaggagctacaaactcatcaagattctacaaccaaccggctcttgagtttcaatctccatgtgacaaggggatttattatgagagggcagagagaaaagaggaacaccgctctctttctctgcaatggaatgatggtcagaaaagaacagatcaaaggaataaacctgctctcctattaactcagcttaccaattctggcctacattttcaaagttatcagtaatcaaaacattgggaaaggaattacaacctcttctcctgaaagtttaacaacttccccatgaagcactgcttttgattgcattacaagctattcctgaagaatttatgacctaagatactctttgtcaatgtaggccatttgtccatgagtggagtgactgataaatcagctattaacatagataagaaagcatatcgattgagtcaactttgtgtttaataatatgctagacagtaatgatgcctggaaaatacactctgtaattaagtacttttccctttatatttcatgaagactcttgtatattttattctggcaaaatagattgtgactaacatctcatagaaaagatcatcatattgtgatcctatatctttatcataaaagtgaatttgagggaaatttttataatttttcaatataaaaattattaagatatcaaaactctttgttttttcactactccaaggtttatttcatcatcttaaaaaccttgtgaatacaatcagtctgctaggtcaggggtcaccaacctagggccatggacacctaccgtggcctgttaggaaccaggccacacagcaggaggtgaatggcagacacgcaattgaagcttcatatgtgtttacaactgctccccatggctcgcattaccacctgagctccaccttctgtcagctcggcagcaacactagattctcataggagcacaaacccgattgtgtactgtgcatgcgagggatctaggttgcacactccttatgagaatctaatgcttgatgatctgtcagtatctcccatcacccctgagatgggaccatctagttgcaggataacaagctcagggctccccttgattctgcattatagtaagttgtatagttatttcattatatattacaatgtaataataataatagaaataaagtgcataataaatgcaatgtgcttgaatcatcccaaaaccatcccctactcccctagtccacggaaaagctgtcttctgcaagactggtccctggtgccaaaaagattgcagaccactctgctaggtagaactgcattcttgtgattatgtattttaatgagcgcatttccttttcatatggagaagggaaccacattgccttaattccccaacttctgccccaaagctttctaggccaatatggctgcattcgagttgctgatggctgtgctaccctcccagggctgatgtacagtttcctgcctgggccgtgtcaccaatcactagggtttaggaggctatagtcagatcttgcagaatatgtcagtctcattctctgtagaattttttgtttgcctgtttttttcttctctttggcactggactatgggcagtggcagttagtggtagatccagggtggagagctgagacctaacaaagaatttttttttctttttttttttttttttttttttttgagatggggtctccataggtcacccaggttggagtgcagtggctcaatctccactcatggcaccctccgcctcctgggttcaagtgattctcatgcctcagccacccaagtagctgggattacaagcatgcaccaccatacccggctaatttttgtatttttagtagagatggggtttcatcatgttggccaggctggtctcaaactcctgacctcaggtgatccgcccgcctccgccttccaaagtgctgggattacaggcgtgagccaccacacccagccaacaaagaatttttaggttcccactattccaccccacctgtgctagaccctgtggtgacaacaaaggtgaaacagacatgctgactgtcattaaaacactgacaatctaaactaagaaagatgaaaaaaattaattgaatacccagtggaaagtaagaaggaatagttttaacctccttaaaatgcttttgattgcattataaactattcctgaagacttaatgatccaagatactacttgtcaatgtaggctattcgtcaatgagtggagagactggtaaattggcagttcatgtgatacatacgctttcagagtaaagagaggtttcttctaataatgagaggagcgcctggccagagagacccaggaaacatatgcaaatactagaaatagccccaagtagcaagtgtggctatagatggtacacgtgaaggagagtagtggggttagaccgtgaagccacgaagaaccaggttaaggaatttagacttttatttggtaggcagtggagagatgttgaatttttttttcaaacagtggagtacagtgaggaaggcaggagactttgcagaaggaaatcaggaattccaaccaatgtgttgagtgtaggattctaaatccagcacaaaaaaaccttcaaagcagcagggaaagggtttggctctgattcagcctcagtggttatactgttgccatcagggagctgggcttgggggtggacagaggctggtggcagagggagggatggagggacagagctgagtttttccaaagcagaagaagacggttttgcaacctagcacaccatctgggtcagatttatcaaacaagattatttgttgacagaccatggttatttcccatttaaaggaagcaatacatatattgtatccaaaatggctccccaaaagcagcgttgagctgatgcaaaagatcagtccattctcccagcaaaagagcagtctcttgacatcccaggtaggagggattcatgtatttcacaaaatgtgtccaatgcaatcatcaggcaaataatattttaatgttttcttgacatgctgagagtaaacttgcttcgatgcactgtctccttctaggcacattactctggagtaaaagaagagaggaaagagacagaggaaagaaaaaatatgtaatcacatatgaactgcaaaagaattctagctgaggttcttagaactataaattcttctttttttttttttttctgagacggattctcgctctgtcacccaggctagagtgtggagtgcaatggcgtgatctcagctcactgcaacctccacctcccaggttcaagagattctcatgcctcagcacccgtccccctcccccaccccaactagctgggattacaggcgcacaccactgcgtctggctaattttttgtatttttagtagaaatggaggtttcaccatgtcggccaggctgctctcgaactcctaacctcaggggatccgcccaccttggcctcccaaagtgctagtattataggcgtgagccaccgcacccagccaagaactgtaaattcttaaaatttgggaggaaccatcaagaaagaaagcctaagccttgtaaccatatgccaacctacattggtctactccctctgccacgctaggcatttcacactctcgtacactctgagggaaactcgagaaacaagtgtaataagaaatattcccgctagagcatggcagccataagctaccaaatttttgttataaaatagaaatatacttctagatgtaaacatgtatatgcttatatctaacctctctaggataacttttgtaagtggattttaatataactaaaactggatgctaaagaaatagccctctcttaaagttgtacttgggcacgtctaggatcaaaaagttaatagttttgtctgtgatcaaggagttaattttttgctgcaatatgtttacatctaacattcttttgagctatccacaatctggttatatatcagtttatccaaccttatttctcctttcctacttcaaagacctccattcaagccgttctccaagctcttgcctaaataagtagttttgttttgttttgttttgttgttttttggggttttttttttttttcaaattttttcctcacttctaagtttcattcagggactacctttccccacttcccctcatcattctctttttctaaaatctatccatccttcaaagcccaggttgaaatttgtcctcttcctgaaatcgccccaaaaatgtgccaaatcattcagatctctgccatctctgagtcttataaatcaaattcttagtggcattcatttgactaagaataataaatacatcactattgttataatcaccataatacctggtgctgttgttagatgctttacctatgttacctcttatccagacaatcctgtcctatcacccccattttacgtgagaagaaaccgaggttcataaaggttaaataactagtccaagttcacatagctagcaagtgacagtcataatagtggttcagacccagaaccgactggcttaaaaatccatggtccttcttctgtgccatatggcttcccaattatggatttcttttttttttttttttttttttttttttcagattgtgatttaggtttattcttttttttttatacttaaagttttaggatttcttacattactttttaacaaacgtattttgtgcatgattctaagaggtagtacactttttttttttaattgtttgcctcattttcccaccatgcctacttttcactttgctgaacccgtatagagtgtctggttaatgttagagaaattgaattgaattcctgacatttgggcccttttcttgagttcctcttctttgtccatagatgaatcatcccattacatctaactccgttggacagcttgcttcttcctcaattgtatgtgaatagttttcaatccactttactaaaatctaatagtcaccatctgtgtctgctatataaatgtgaactcttgaaaacactaacatttgtgggtcagaaattagaggacagtaaaataaaccactggaactgtgaagagggaggaggcgtgaagaggcactcccctctctgctgtctgtgggtcaacctttccggcctgcctgtttctcaaactgagtgagacttgtctctgaagccccattttttttttttttttttttttgagacggagtttcactcttgcccaggctggagtgcagtggtacaatctcggctcactgcaacctccacctcctgggttcaagtgattctcctgcctcagcctcccgagtagctgggattataggtgcacaccaccacactccactaattttttgtatttttagtaaagacggggttttgccatgttggccaggctggtctcgaactcctgacctcaggtgatccacccacttcggccccccaaagtgctaggattacagacatgagccaccacacctggcctctgaaaccccatttaattttccaaatgaaggtgatgtgtcccaggcatcatacataggcaagaacccacaaagtggcagaggagcaggagcaaaggggcctgggcaccccctggaaagtcatcatacagctttactcaactgtcaccttctcctggccttccttgaccactgtttttaattgcaaatcccactgcatgatgccctatccctcttccctgacttattcttctccataactcacattttcaaagcattctatgcatttcaccaaattgtttgtggcccttctcctcccaccagaatgtaatttcaagagagtagggatctgaggtcgggcgcagcggctcatgcctgtaatctcaacactttaggaggccaaggcggttgggtcatttgaggtcaggagttcgagaccagcctggccaacatggcaaaaccccatctctattaaaaatacaaaaattagctgggcatggtggcgggtgcctgtaatcccagctacccaggaggctgaggcaggagaatcacttgaacctgggatgtggttgcaatgagccaagatcgtgccactgcactccagcttgggtgacagagtaagactccatctcaaaaaaaaaaaaagagtagggatttgggtctgttttgtactatgctagatacccagcacccataacagtgtcagacacataggacatgtattgaatgaatgaactgatttataagcagaatatttaagactgttgagaagccatacccattctaatcaggcagagcagaaggttaaaaatccacaacgcttacttttgagttgtgttgaaaccattgaaaatatctgtgtcaaactgattaattacctcggtttacagaatcagctttttaacatacatagcaaattctatatgctagccaatggcaagccagatctcaagcaaggccattcttgtaaaataaatggacagatttttgtcttttctattgtataagattctaaagccttgaaagcagtaatatagaatctccttaaatacaaatttaagcatcttttcacgtttatggcctcagtgcctgtttataaaagtagttttgtaagaaaaacagtgtaagaaaaacatctaagagtagatgataaagacctatccttgtgtgaccttcagatggaaaagcatagatttaatctgagattccagaacccacctagtttttaacttcatttgtttgtctaacttaagaacgtgagtcacaactaacaaagaccatctggtgctgttcttccctcctaggagaatgtctccagaagtaaataaaggagaatcttgtccatgcaagctactctcagttccaatagaaaaccatttcagcatctaattcagagagttgcacaggagatggccaaaggcactatctgccatatgtctgcgtctccagcccagccatgaccccaaaccaatagatttatttttaggtagtatcatgtaaacatagaactttttaaactagcaagttggggaaacttcatgattagtcaatctgctagcacatagcagaagctggtgggtgccttcccagcagccagctcctctttctcctacctcatagcaccccagttattttcaggcatctaccctcctccacacagccaagaacttcagggaggctatttccttccccaggcccaaggagcacagcgtggaaggggaaagagagaggttcatggacggctctaccatgatgccatgtgtctgctagtaaacttctactgactgactgagcatgccccaggtgaaataccctccagtacctccttctgtttttggacttacctgttgtctttctccaacctggagactctcaacccttactgcaaattactgccacgtggggagcttttaaaaacctgcagacacccaagtgcacccaagagagcctgtttcaatggacctatgcaaacaggtttttttttttcattaagttctctgggtgattgtaatgtacagccaacaatgagaaatgttatactaattccattactttgaccctgtctttgagatgctttgggagagcttggcgctcaggaccatctttggggatcttttccatcatccagagggaagctggatcttagagtctggcctctcggttatgggtcctgatgttttttcattgtgtatggtttccatgatctgtcctctgcaataaaacagacattgctttctatatgtaattctactcatccttttggggtctctcttcgttaccatctgcccttccatcttgccatctcactcctcactcccatgattctggaccaaactaaccagcattcctaatctagtctcttcttgaaaggatttgaaacggggaagcagctcttcaggaaagaaaataaatagagcaaatgggccgggcatggtggctcacgcctgtaatcccagcactttcggaggccaaggcgggcggatcatgaggtcaggagatcgagaccatcttggccaacacggtgaaaccccgtctctactaaaaatacaaaaattagccgggcatggtggtgggcacctgtagtcccagctactcgggaggctgaggcaggagaatggcgtgaatcagggagatggagcttgcagtgagccgagatcgtgccactgctctccagcctgagcgacagagcgagaccccgtctcaaaaaaaaaaaaaaaatagagcaaatggaatgaagaacctctgtagggctgtgttgatttaaggcagatgtgggccacagttttggtgttcacacccaggtaaacaaggcagcttccttctgctcatacacgtgctcccctctggaagagccaggtttgcaacgggctcgcagtggctttctcatcctggcagcatccagtttcttgtggacgttgctgcatcccaaccacctagcagattacacgaaggagtgaaatacctaccactgaaaagaatgaacccacagagaagggtggcctcactgctcccaggggctgctgcagtggcccgtgggcagctagactggcctgcaggggactgaccctggtggacgcctgagtctatgtgccaccatctaccctgtgataagtgtagctccgacatgatgtacctttgcctgttgatttccaaggacaattattttagcatttcaaaattcagctcaagtgctggacgacttctccctgagttttgctgtttgccagcagcctcctcttggcatgctccctttccaacatcctcactgaacttgttactattaccaccatgtacttagagaatgcaactatcaagtgctattgaacacaccttgttttgtaaaaaccctgttgtaaattgcctccttattcctctgttccatggccagtcaaatcacaccctcatgtaaatagtgacaaagacatattacccaacttcaaattccagacacctgagtcacaggtgttgttaccactaccccaaaccacaaagtgggattatgtgtctcctagaaccgtattataatagacactcactgtcttgcaaattgctcctaacttgggtagaatattttgtatttattacttttgaaaatctatgggtttctattgcctggaaactcaaggattacagcagaattagagaatctggtctctggatcacagatccccccactgccctgcaccgcccccacccctttctcatggagacctaatcatctccacactggatccactcacatggatcttctgaccttgatccagagtttacaggtaaaatgtccacctgaggacactggtttctgttttgacaaaggtagttagggccttggaaagttgtgaaggaatggcatatctcccagaaccctgacttccatcagcatcttattccaggagctctgaggaaacctctaaggcacaagtgtggaaataaagaccacccagatgagaacacgcagaggctatttattcagagcttgctgtagcaagagagtcagccatcgtcacttgtgcctggcagagactctgaggcaagcggggagtgggaaagctttcaggtggagagaggggaaggctggggtgtgccggggctggagcttgttggcccgggaaagctggaggagggctgcctgacacaggaggcatcctgtgtgattggtgaggggattatatttggctccctctggttggcctaaagttggcagcagggacaaaattagggaatctggtatcaattgatcatttggggccagcttcctggaatgtctgctgcagattgtgggtcagcgtgctgttgtcgcatatggccaagctgttgtctgtctgtagattccatctcttggtgttcaataggccttggggccatgaacttgtagggagggttttctcaagacctgggttatggaaccagcattgaggttcacagaactcacatccaccctcaaatcagggctgggtcacagacagtttattcaagtgctccaggcacctgtcccagggtcattctccctagaaagacccaaacaagctgggcgcggtggctcacacctgtaatcccagcactgtgggaggccgaggcgggtggatcacaagttcaggagtttgagaccagcctgaccaacatggtgaaatggtgaaaccccatctctactaaaaatacaaaaattagccgggcatggtggcgcacacctgtaatcccagctactcaggaggttgaggcaggagaattgcttgaatctgggaggcggagcttgcagtgagccgagattgtgccactgtactccagcctaagcgacagagcaagactctgtctggaaaaaaaaaaaaaaaaaaaaaaaaggcccaaaccatcccagggaattcagttcaagccacttctccctcactgtgttctccatgctgctgcctggggctgctggccccctccctgtctgcaacggactctgacccctggaccaggacacccagcaggctccccaggaccacagattctgtctgaccttggggattctctggtgtttctgaaaattgctgaaagcttccagtggccattgctatgttatttgctagtcggctaaaaagttaaactccatttttatatggtctagattagaagagaggaagaaacactccagaggcatcagaggctcaagaaaatgcctagaatgaagttcagaccatcaagaagtccccggtggctcaggcacattcactgtttgttcattcctctgacagtcacggacagccccctgtggacaaggcatggtggcgggctggggacagtcttctactaggaggatggggaagacctgagaacagtgcaggaacagaaggaacaaatgtgcgggctgtgggtcacagtataataggaacacaggacagaggctgaagatggccccaggatttgagttacgaggccagtgctgtgctattagcaaccaaggggacctggaaaggattggaaggggaaggtcttgaggagaggctcctggtaggttttttctgatcaatagtcccaagggtcaaaaatatcaacagtgacagtcagtgctgggatcattctccctcacagatctgaacccttgagtatgttgattttaatgacagggacgttctttatccagccttatgcctgaccaactctgattcatccttcaagtgaggagatatctcttcaccctcgaagctttccctgatgcacaccccccgggccagggcctgccccagagctccccactgccaccatcacttccccagtgcaggcccttacccccgtctggcctgttgggcttattgactgaggcccccaccctccccagccagcagcatgcctgccccacaaagctatccagcaaatacagattgagacacaaatggatgaaagacatggaaggaatgtatggatggaatggagggatggagtggacacatggaatggatggatagatggagtggatggatggagtggatgggtagaatggatggatggagtggatggatggagtggacggatggagtggacagatggaatgggtggatggagtggatggatggaatggatggatggaatggatggatggaatggatcgatggagtggacggatggatgtaatggatcaatggagtggatggatggagcagacagatggagcagatggatagagtgaacagatggaatggatggatggagtggacagatggaatggatggatagatggagtggacggatagagtggagggatggagtggacagatggatggagtggacggatggagcagacgggtggagcagagggatggagtggatggatgaagtggacggatggagtggatggatggatggagtggatggatggagtggatggatggaatggatagatggagtgcacggatggatagagtggatggatggagtggatggatggagtggacggatgaagtggacggatggaatggacacatggagtggacggacggagtggacggatggaatggatggatggatggatggagtagatggagtggatggagtggacggatggagtgggtgaagtggatggagggaatggatggatggatggatggatggagtggacggatggaatggacagatggagttgatggatggaatggatggatggatggatggagtggagtggacagatggaatggacggatagaatggatggatggaatggatggacggatggagtggctggatggaatggatggatggaatggacggatggagtggatggatggaatggacggatggaattggatggagtggatggatagagtggatggatagagtagatggatggaatgaacgcatggaatgaatggatggaatggacagatggatggagtggatggatggaatggacggatgggatggatggagtggatggatggatagatggagtggacggatggaatggacagatggagtcaatggatgggatgggtggatggatggatggagtggacagatggaatggacggatggaatggatggatggaatggatggacggatggagtggatggatggaatggatggatggagtggatggatggaacagatggatggaatggatggatggatggagtggacggatggagtggatggatggagtggatggatggagtggacgcatggaatggacggatggaatggacggatggaatggatggatggagtggagggatggagtggatggagtggacggatggagtggatggatggaatggatggatgggatggatggagtggacgtatggaatggatggatggatggatggatagatggagtggacggatggaatggacagatggagttgatggatggatggatggatggaatggatggacggatggagtggatggatggaatggacggatggagtggatggatggaatggatggatggaatggatggatggaatggacggatggagtcgatggatggagtggatggatggaatggacggatggagtggatggatggagtggatggatggaatggacggatggagtggatggatggagtggacggatggattggatggatggagtggatggatggaacggacggatggattggatggatggaatggacagatggagtggatggatagaatggcctcctctttgtctaaaacccccagtagctacgaattcccccaacaactactacacactgccctgcacatgatcacgttcggtaagttgtgtgagagggcaggagggagaaaatggagctgcctgcctgcctcacgagcacctttcaccattttgatcacatttccagatgcagcaccaccctctgctctcacttctttcctcccagaccagggaagcattggatggtggttcatgaggtgctggaggagctaaagaaattgctgtcatcgttttgtcaaatccagggcctttatgttttaaaatagatatacaaagagatcacattttacctggtaaaatcatgacaaactgagcggacaaaaaaaaaaaaaaaacctataaacatttggcacaacagagcaaaaatcataattcctataattatttttaaactgtgaaactattgtagagcattgaatagatgtatattaaagccatgtatgctttatttgcttatgacatgaaattctggtttctgtgtgttccaccttcctattttattcttaggataataggatatgatgtgatgctttactcatagttagagggagaattgactgtgaatgagcagttcagagagaaaggatcttgggcttggcaagggcaggggcctccagcgttttgagaaaaatgaattgagcctcagcttattttataaaaatcttgacccagagcgtggcccttctgaactcccaccatgtttatgcatggtaatatattaaaaattggacttagctagtagccaaatacagtgctgtgttctggatactaaaacaaactaattctccctgctaagtaagaaaaatttcacacattatcgtcagtcagacatggaaagaggttctccaggggaagagagagaagcaacatcattcatgtgatttaaaattacaccaggccatccatttatctgcctctcaggctgtttgtccttttttgaacgatgcttcagggctccacgctggaaacggggagggtggatgtagaacagcttgtcaatgtaatcattttactataaatctgcaaaaaaagaaacagagcctaaaccaagtataaaataggatcacagaacctcctatgagcaactttgtaagattatcctttctagtgtgagtactaccacaataaacatgatgacatatcctttatcactatgttgcccaaagattttttttcagatttcagtggactcctcccctgccactcttaacagccctgctcctccaaacatagctgtatggagagagatgtccatcacagggatgtttatacaaaaacatcaaaacactcattttttcaggctggaaacggtggctcacccccgtaatcccaacactttgggaggacaaggtaggtggatcacctgaggtcaggagttcgagaccagcctggccgacatggcaaaaccccgtctctactaaaaatacaaaaattagccaggcatggtggcacacgcctgtaatcccagctactcgggaggctgaggtgggagaatcacttgaacctgggaggcagaggttgcggtgagccgagattgcgcgactgtgctccatcctgggtgacagatcagattccatctcaggaaaggaaaaaaaaaacactcattttttaggtgaagttaattgactgggaggactttatggaacattttggttcttttcctactgctgaaatttgaatagaaaggcatgaggtaacctcatgccatcactacgaaaggctaccagaaatgatagaaaacctcacacagtatcagctacattggtggagtccacctgaatcccagaaattcagttcaacaatgtcactgagttcaccagactactgggaaagggattcatgtagagacagttgtaaaaatattgaccctaacagagaaagattcactgcagtcagaagagatgccacgaagtcaggtctcaactcctggagaggctctttctgtgctgtgcaaaaatgtatgtttatccgacttcccaggccttgaggtacagcaaggaatgccagtgttggatgttctacaagtgaggacactggagcctcaagaaataatctgacttgcacaactcctgtcactgattagtggctaaggacatcctgatttctgctccagaactttccccatgacatcagtcttcccatccttgaagagttttcagttattcttagcgtgacaagtgattgctagagtttgtgtaattttcatcataatgggactaatgacccacaacagcagttctagtgacttccagaagatgttgtacatccccatcctaatgaatggcagcagcatgacttacgttcttttatcagagagtctagtttgatctgagttgtgtctgacctggaattcaggcatgtctggggctaggaaggttttgggttcgaggaggctgttttcatgagggatcccagggtctcttgggaaggaattcactcaagggaggacagaggcaagagaagcacagttcactctcggggctgaaggcagcatgggttttaggtgcagcctggtgacagtcaatcgggtggcctaccatgtagtgattaagactttggaaaagcaggctataagcaaaaatctaaatttgctacacaataacttggcaagacaatggagcagtggctggcaccatggaccttggtaagaaacactagaaaagttaggaaaaggggtttttccaggtcagagagagccagtgcatgctggtggacccacagttctgtagctatgagaaatagccccatctggttgtgcaggaaccacaggctgcactagctgctttagttgtgaccgcagaaagcaccctgccccagcatggagcaccagggcctgcacacctttgccaggccccagaagcactgccactgccatgatacccaagaagagagagattagcaagtgctttgtaccagaggggagggctgcccatgcaaaggcctgcctgggggaactccagcaatcattgggggagactttgggagagtggagagaaggggcctcctgaaaagacacagccaggggaaacctactttcatgatatcaagactctaattttagagggcagtgtttgcagatcctaccaatgactctttgtccttgagtctgtgtttgaggtggaaccactcaaagacggggaagatgaggcacctggagccaggcgcctggtctttgtgtctgcacttagccaaattccctctcagctgtattgtgtctggaggaaatagaagcatgactaagctgatttgtattctgccaaccaagggaaaatataattaacacggcagcaagactcagcaaaccccatgggaaagtccaagaaggaaagagctcccgtggctcaagatgatgtcagaggcaaagagaggccaacccactctaatcccacagcaggtctcctctctaatacctcaactcataaagggaaaagacaatgaaatccaggcctgccatgcctttgaaaagaacacacagcctctaggagtgattgcagggattgagcagactgtgatgggggttttctcatgatgggagtctcctgctgttgctgagtgctgccaatcactgcccacacctccagcagggaggtgacttcctcaggctctgctactccacatcaactgattaacgcagctgtgatagcacacctagcagagacaagagactcccagacactaggcaggagtgagaccaactgctgtatcagatatacacctagcttataattacgtgtcaagagaaggaagattaggcagacatcagtaaccgcaagaactgaaatgtgatggctggtatccatcttcagcctgctccccagctaatcatcccctaaaagaaatgcgggagaaagctgcctcctaatacatttcattggcccttcatctccgtctgctgactcacatttgaatttagagacaatttgctaaactttctagatttttatttacttaacattgccttagcctttttgatatattcaactatagtattctccaggtttaaatattgtacgttttttttcacaactttaacaaattagtgctcagttctcctggcttgaaattcccatatctttcatgaagctgttgaaactaaaaggcttaggaggaaggtcacccacctccctcattctccttcccttcttgcccagaggaatttatgtctgtcttcctgccccaatatctacatatccagccatgactacattgtttggtttaagtaactgcctctcattacagaactagattcatttattcattcattctacaaaaacttgaagaacatttatgctggatttgaatccagtgtcagaattgtctttgattggttctatcttatttcatagatttggggtttgaatttaatagctaagcatataaatataattttatgcaagatagcaccttaattctagtccttatttaatacaaatagtgatataatgaaatgatatagttttatctagtttcatctagagaaatatggaaggaaaaatacaaatagttaaaaaaaggaggaaggctgaaaatatatagcagttgatatgcttctcagagtcatcttttactaatcagtagcagtggtgatggtcttttaaaaaaaaaaagtttcggttgcttttaaaaagagatttccagtgggaagcctgtgagtactgactggctcctgtctaacctacacttcctgtttggttgatgaaaaagaaaaaaaaaaaagccaaaactaaaaggtacattccagaacaagtagtcattttaacaactggcggagccaagaaaatgcgatctagtttccctctgtcccccagtctagagccattattaaataatttaatgccatagaacttatatcaaaaatagacacattccttaggaaacatttgaaacttactggttttgaccttaaaatgtaatcattcatgaagagatcaatctttcatatgttttcaaatatgaaacactcaagtccattgtcagaatcccaatagtgtggaaagaaacctaccagggcaggcttatctctgctcattctttgctaaaatatccattgcatttgctaactgtgaaacgatgggtaggttacttcacttctctgagcattgaagatgccctgtctacaaaggataacagtctctctcccaggggtagctgtaattgtgaaattaggcaacatatataggaaggtgcctaatggagtggcaatcatttattcattcattcccgaaatatttatcgattggccacaatgcccaggcacagagcaaggtgctagtgatatcaacacgggggacacttcacatttccccccattcctccctaacggtgcagcagacaccccactaaagctgaggaggcccctgctgctccccctccctctctgctccctgagtctgtgagaggcatcgctccagcctcccaagaaagccctccccctgcacatccaagcagctccctcttatcctgatgccctgacccgcctgcccacaaggagcctcctccctgagccgggaggactttccttctctcctatgacaagccctggccctaggcagctgaaaacaatcacccaggaagctccttcaccgtcagattccctgacagccctggatctagcgagaatcaggtgatttcgatgtgaaacgaggtttgggaaccactgctttcagtcacattctttttgtttgatcttctcagaatcagcaggcatttccctctgctactttgtccaagatccaacccttctcatctgcgtcttgccagtctctccactttagagctttgttaccagctacttctaacctcttgcacagaaatctctactcaccactgtggagagtgaaaaaggaatgggtttttatgtatttctagccagctcttggccctgcgccatgcagagtatatgctgtacattggactttcgggacacttctctgttaaattctaagccttatgtctgtggtgtctccacagtgagtaagctcttaatcacattccctattgtaccttcttagatgaaagagcaatgggtcagggggactttttaaatgtccttaaacttgattagtttaatctttattatggctacagaatgtttcttaaatttacatacgataaaatccactattttatattaagtagagttatgagttttgacaaacaaatatattcaggtagccaccaccataatcaacacacaaagcaatccattacccccagatttcccttacatcctttgttgtccccctcatcctgtacttccagcccctgagagccacttatctgatttctgtcccgacagtttgccttttccacaatgtcatgttatataaatggagacatacaatatgctgatgtgagcatttagaaagatcatgtatttaaacaattattagagtaagggctggctatggtgacttaattttttggtttctgacacctataatctgatttgaagtgtgtcattctgtgcatcatgatcctttttgcagaacctgtgtctattagaaaatccagatgaagcaggctcttcctgttgtccttcatttggaaaagacagaagaacagagcgctttacgaaagtcaagttacagcttcctaattttctctcccatggacaaactcttccctccccccaccccgacctagcctcttacccactatcctttgcaaattcctatctcttatattgcccagtaattggggcgtgggggggtgaggggggggtgagttactgctgatgaaccaggaggcagagcaaggtttattttgctaaaggcttcagctgctactgcctggacctcaataagcattttctgctctttcctatcactactgtcttccctttctttgagaagcaacataaagataaaaagaaaaatacttgattttgtagcatgccagaatattaagatgctcctgaaaagtgtgggatttaaggcttctcaaaaaagagcagaggagggagtgagagaagaagacggagaaggaggagaaggggaagagaaaggggaggtggaagaagaaaaaaccaccatcagaaactgagtattacacaggacgtaacctgtgctctgagagtgaaggaggccacacagcagtagaaccccgacaggaaaatcagaaaacattatattttttcccagatcccagagtatcagatgttccattcagaaataatccctattgacccagtctctgtgtctctctctctgccaatagcatcaagcacagtaaccctttccatgctaatcccgttattaatgccatccacaacaagcgtagtgtaagtaagacacgaagtgtaaaaaaactttcttccccgcagtccgggctctcagagccctccttgtaggtcaacagtatcaaaggtgcttaacgcagatacaccaggaggctcaaagcccaaacatcgaaaaaaaaaaaaagacccactcttgtgctgtgtgtattgcccacgggtgggaggatgcaagtacaattacgttttttaaaactccagtccagatattggcttttccttggatacttttgtgtggctctcccagtacagtcagatccgccgccgcagcctagcgctccaccccgggttttgcgtcctcccctcacctgcctttcagtggtgcggggtttgatcccgagagcggtggactcaaagctgcccgccgggactcgggctgccggccgacaaaggacggtcctcgggggttctgaagtctgacccggccagtgggaaagccacctgcatcacaaagcgaggggcacacctgaaccggggctggcgggaagaggcaagtattgcgcgcgggctggctcccacatggagctgcctcccggtgcaagtgttgcaagggtgcgctgctccagcccggggagcgcgggaggcggcggagagagcgtccgggtgatgagcggggcactgtaactggattttaacacctctgcaagcagcgcttttggtcaaaaaatttccgattcttgatcttctctctgcaaggtcgggggttctttggggagtaaatcacagcgtttgggtttgcattcgaagcactaccaagtctactccacagggtcactgcacggggagcaagtaaaggaaaacgaggagaatctgagagtgctccttcgtgcagtgtgtgtgtgtgtgtgtgtgtgtgtgtgtgtgtgtaggcaaagctgagatttacatggtgtgaactgttaaatgttaacagttaaatcccacacttttcaggagcatcttaatattctggcatgctataaaatttttgagacttgtttaaagaaggggacttcctttttaatttagaacaaattagtagttgttataacattatagatactaatcagtaacaatactagtaggtaatgctttctgtaagtagacacaccccaaaagtatctgaaaagtatcaccaaaacggagcgtgctttcacactcctgcaaaacaaattagcccttaaacagaataattaacatcccgagggaagataaagcatataggttccttgaatcattacgttacatttaaagtcggtcctgttcagtttgcctttgtccctaaggagtaaaaatagcatcaaattgcttgtttggttttccccttttgaaactcagcatagtgtttggttatccatgaaggtggctttaatatttcaccctcatatttggcagacagttctggacttgctcctctccccgtagggactgagtcccactggcagtgtgtggagaatagaattgattctcgctttttctttgcataatacctaatcatcaccattagcacttcagacgttcacagctttctgaataggtgtcatttcttccacataccctattgatttgcatcattaacaattgaaaggaagctcttcttttgattaagaagccaaacaattaggaaagcgtggattctttcatagtatttattgagaggcgtctccacctgatctaggctgtgtttaatgggatgagagagactaagagagaacagaaagtgtaattaccgcctctccaggcccgtctttactttttccagaaacagagaattatgaaattatttgtaatgttacaaggacccttggagctcttctagtgcaagtcaagtttatttcacaaacgggaggtctagacagcctttgtttcttctgaacgggtctgcaaggccaagatctggattctgacccacagcgactgctgatccaggaattccatgcacatatgctatgcacttagcgctgattgtgaagaaacaccaaggtggcccgtcaagacctgaactaccacaggtctaacttgggaaagcctcattcctcacgttctttccgcttctactgtaatggtactgtgcctcttgccagcccacacttattcatttgaaatgtgcactttggaagttcactgcatttaatcgattcagaggatttcttttttttttaattttttttttaatcagtagctgagctatactacctagttctaatccgtaatagtgtgttaaaagactgttttctgtgtagttgctggctgttatttaaatcccaaggctgctgaaagttggtaatagaaccaataatagcaaccattactcaaaagtctattgcttactattaactataataattaactattaagtattgatattgtccccatcaatttttaggcgttacctaacattatccccattttacagatcagaaaacggaggcttcagaaaggtgaagttactagcccaatgtcactcaccttctaaggtggggagcagaagccaggttggtctgacccctaagctcatggtctttctatactaccttagtagtatagaaatgttctaactttcacattcccggatgtctgagctcaagacaaattttaaataaattagcgtggctttgatgttctctcactagtgaaagggtctataacactttaggcaaaatgcattgaaattatgttaaaccttcatacactgccaataagcaatgacttcccagaaaccatactccacatttgacccagtctctaatttagtgagaaggtgagatgcatggaaagaaggcaaaggagagtgactagtgacccccagaaaagggaatctcttcccgaggtttgtgttgtgccctgtggagctgagaggagagtagggaattgatggagcagaggcttagccaacgcatctgaaagagaagagtgttttatgtctttaatttcttcttgtcagaatcaaccaagcccagagctatttacgtgttgagaagggtctcccatggagaggccttcccagtggcccttctactctctgctgcggtggtttatcatgtcttcaaaacagactcgccaccaggcttccaacaggataatacaaatgtgaaatttttgtcctcaataaagagtcagaaatgatgaccattctgccactttcatcattttaaaatctgtattcctgaaaactggcctcgaatttatttctgtatagtccaaggtattgatttgaaagtgagaggctagcatgaaagccaacacttctcaactttaaaaaaaaatgccttaatatttagtattttctcattctaatgtatcctgtaagtgttctttctgtacttcttgttaaggcatggctgtgtaaacttcagagggttttgggaacagcctccattgtcatccacttttcattctaaaatcttggtatatctgtgcatacatgcacaaggcctcccatgattgcactgcttttacgaataatcatagtcaaaattcattttttaatactgctagctcaatttttatttcttattcctttgaaattgatcatcatttggacagggactgcattaaagctcaacactgaccttcattgtggccacaggaagaaaagatctgctaaatgaacaaatactgtgatcgatattgtgcaatggcttgagggaaaaaggaggttttaaccacttaaagtaagcccttttagaaacaaaaactatttcagtgaaaatgctaatcctacacctctccaaagtaaatgtgcttagaggacaccagccagagtttctttacaatgggaagttgccttccaacaagaaagggttttcaaagtgcagaagaaaactttatctggaaaaggtgagaagcagagagcctccaggctccagccccacacactctcatcttcaattaatactccacaaagggaaagttccattgtgggccacagcactccctgcttgagaacctgtagggacttaaccgctgggtttatccaatgaagtgtctgaggtccccgctgtttagcttggccctccactctctgttcccaatttcgtaaccactacctcagccagtctccccagcagagcacttttatcttatagccatgaggcatctgtgacatgtcccacaacacatcacaaactctatttgtcctccaatgctcagtgaccttattttcccaggcaaaagtggctcccgtcccggtgcccactaagccttgataccagcccacagtacagtgcttctcagactaggtcgtctcagcatttgtcaatgtattttatttatgtttcgacgtccagtctgttcatcttcagtacaggactgggtcatactcatctttccatcctttcccttgtccaccttcctttcttcgatttgaatattttctgtagttgctccattaatcagtaattaattaattgcagaaatgtatttcccaagatgtagataagtcacacctcagaatgctacaaacatttgtagatgtgactgatcagtaattgtcaggagactttgtcaatctggagaggtgctgaaaaacagagacaagaaaatgtcaactttcaaaaatactcatttaaaaaagtagtttccaagaaaagcgtagactggcaaaaggatgattgacaaaattctggactagattactaaataggtgatatgtgagaatttagaggagaatcgtgtgatttgcataatccaacatgagttccccggaatcaagccatcccatgtgaaccatatatctcttttatatataggttctgaaactggtgaaatggggaccacttgaggttagagattcgtaattcagtgttgcctctgatcagcctggaattgtagtttatatgccagcaactgcatgtagcctgagggctcccatgactgggctacagccaattgatcacaatctaatgatacccctaggagtgccttgggtgagagcgttgtccggggcaaaccttatgaaactttgtcagatggtcttcacacagcatttcttgattttagcagagcctttgactcagtctctcctagcagattttttcacttactccacagatatttatttaggtgtttattcagtgtcaagcattgtattaggtgttcagtgtttgtggctcagaagcaaattctgacttagttgataatatggagagcaaaaccgagtcaaaaattgattgcctgaaattatctttggaactgcaggaagtcaatcgattgatgaattcatgtgtgtccgggtctctggggtacactgtgtgctcccccattcactccagtccctgctcagagtccttctccaatcacctcctctataaaagcaccttgccccatcatttcctattccctcatgctgttttatttttcatctttgcacattttattctctgcaatgatcttattcacacaagcagtcctgtagttgcctgctctctgcccccttgcttggaatgtggtatgaatctagggaggcatttcacagggctgggtcttttgttccttgccgtccattcaatatgtctatcagtgacaattgttgtcattcctgctaatctaatttgcagatgatagaaagtgaggaggcagagctggcatggtaaataaggggatcaaaatgtacatcagcagcatatgtgaaagcactttgataattgaagaattataattaaatgcaagttatcattttttaagtgcgtataaatctaagccaaaaccaataaaatgaaagtatcaaggttaaatataagctcatgcatttaggttcaaaaaatcaattacacaaattcaaaataaaggagacctaagagggcagcacagtccatgccgcgatttagccatgagctgggcgactctagggctgcaacacagtccccgagtggtggagccatggctggaaattcttcgaatgttatcagttaggagggccacatggtgaggtggacattaccaagcccgagtgtggccagtggagggtcactcagaacagcagcaggaattgggacgtttagcctgaaggagaggggacttagggaggtggggacccatctttaactctctgcggggttcacatggaggagacgggcatgtgtgtgctgagtgctaagttagaacctctgggtcctggggggcagactttcattcaaggtacggagaatgatgggagcccagggccagaagcctataacccacagcatctggacgaatactgagcgctgtcactagattctatttttatttgtttgtttgtttgtttgtttattttttgagacagagccttgctctgtcacccaggctggagtacagtgacgcaatctcagctcactgcaacctctgcctcccaggttcaagcaattctcctgcctcagcctcctgagtagctgggactacaggcacccgccaccatgcccgactcattttttgtatttttactattttactctactattttagaagagatggggtttcgctatgttggccaggctggtctcgaacccctgacctcgtgattcgcccatctcggcctcccaaagtgctgggattacaggcgtgagccaccgtgcccggccgtcactagatatttaaagagaaactggacaactgtggggcagaggccagctcttaagagggatcctggctttgggttggatcttcaattgtctttgttctttgtctttccaagtctaacattcttatctgttctaaacttccgtatttttatttgttctgactgatttttttttcttggtgtgacatttgatgtaaatagtacttagcaggcttagcaactcctatatgaaagtgctttgaaatttgctgggctttggaatctctgttgtttttgcccattaagtaattccctcccatccctcttcaatgttcccctttccctatcaaccagccctttctgcaggttggagtttgatagacttggcacttggcacaccccctgagcgccagtgtcaccctctgcgttgtgaatttatagatggagaccccttcatccttttacagtcgtgctctgatcctggggtccctgaggtccagagcagaacctgaactctgagtatcaggcaagcgcatcttacttcaaaaaatgggaagaacaatttaaaaatgcaacttggatatgtttttataagatattcccgctttctgttttctacacttatttagcattttaacattttcagaatacgtgaaaattagatttagtttcttttttaaatgtgaaatataagaaaattatgattacccgtaacacatttgtgattaaaagtacattttttaggaaaaaagtattgtttccagggaacaattttctattaagttggtgcagtaatgattgcgatttttgccattgaaagtaatgcttaggccgggtgcggtggctcatgcctttaatcccagcactttgggaggccaaggcaggcggatcacctgaggtcaggagttcgagaccagcccggccaacatggtgaaaccccatctctactaaaaatacaaaaattagccaggtgtggtggcaggcacctataatcccagctacctgggaggctgaggcaggagaattgcttgaacctgggaggcggaggttgcagttagccaagaccgagccattgcactccagcctgggcaacaagagtgaaactccatctttaaaaaaaaaaaaaaaaaaaaaaaaattaatggttaaaaccacaattacttttgcaccaacctaatacttagaaagatgcaataatactagatggttacctttaacttacaggtttcgggtttcacagaaacaacagcaaacccaatagtgcttcactcagtttccctcccaaagacagcaaagagagaaaattaactacctggccaggcgcagtggctcacgcctgtaatcccagcactttgggaggccgaggctggaggatcacctgaggtcaggagtttgagaccagcctggccaacatggtgaaaccccgtctctactaaaaatacaaaaattagccaggcatggtggtgggtgcctgtaatcccagctacttgggaggctgaggcaggagaatcgcctgaacccgggaagtggagattacagtgagctgagattgcaccactacacttcagcctgggtgacagagtgagactccgtctcaaaaaaaaaaaaaagagaaaacaaaaaaccaactatctaaggcagaatggtaataaactgcccagtaatgctttcagggataattaaatgagtgatgagggcacaattacaaataagctaacccgagttacttggaaagcagatggaagcacccaagaccatacaacaagaatgaaaccccagaacagtaaacacacggtattcctaccatatatgccccccatcggtgtcacctaaaccaacatctctttgaccttttttttactcatgtgaccagttatttgattgtttggctgtcaaagtcacaccaagataataaattaggcctttcagagccaaaattatattatctagggtattacagtgaatatagagttaaataattttagtgtcctgaaaacattacaaaacacatatcagaaataagagccattctatgtagtgaatcgggggagaaatgagagaagctcagagaccaacatagagaaaagcaggagaaagcagaaagcactggaaacaaacatgtctgcttgttggtggtgggcgatggatacaaagatacccagccagaatccccctggaacaagccaggcattaaatctttacagctggagttgcattaaatctttacagctctaagctgcttgctgcaaacatcctgtagttctcgtcaattcaaactcatccccaactttctttttttttctaccttactcagtgcgtctgtgtctgggtgaacttcagaaatctctctcttacgttttcttgcaagactctttggctagttttatctgaaagtttgtttgtttttccagctagtagttcttccccctcttccctaagctcttgaagtctaacactgtttctctggtcagagggatcagacaaagagagctctgctcccggccacccatccgtctcattgattcaagccactgggtctgagtgggccccatcagagggtgtgatgggttccagacaacctggacgtgcttttagaaagcagtcaagagtaaatccataaagccttatctttgtgttggaggggaccacattataagcaaatcgtacattttcttccaatacaaagtaagatagtttcctgcattattagtggatatttttgcaaggacatatttaaaaatatatattgcccaataacccatcattcagtttaattccacatccctgctgggtgccttccagtctaccttgggcaacttaacataaatatggaaaatatagtttgtgtttatggagctcatcgccctatgagagaggccaggccctcacggaggacgaggtgacagcgtgggcacagccagctcttgaagaatatcataggtgatgaatgctctagagatcccaaggccaaagcggctcaggcacacgtcattcatttgtttgtaagcaccgtcaaggcaaagagaccaggcatctgtctttcataccccagccacaccccctgaagcagagtagataatagatgcttacaagacagcgagtgatttcatctcagtatgtatgaacagcttcaatcacacagattttgggcagattcactacctaatcggatgcgagacttttcatttcttctgacctatattagtaaacagcaatataatcttttctaattacagacacataaaatgattgataaaatccaacaattgtatgacccctccacaaagcattttttacattcaagcctcacaccagcccctggaaatagatattatttttaatcttaattcatccagcattgtgctgggtgctggggatagataggccagggaagaaagattcgaagcccctgcttttatggagctgacttgctggtgagaaaaaaataaataaataaaacagcaaacaagaacaaacaaatacatcaataatttaagtcattgttaaatacgatgaaaaaaatggtagtatgatagagagtgatcaagggaggaagtgagatctctagagtggatttgaaggaaccagatctaaagacagggggttccagttaaaggtataataggagtgtccaacctttcggctttcctgggccacattggaagaagaattgttttgggccacacgtaaaacacactaacactaacggtagctaatgagctttaaaaattgcaaaaaaaatctctcttttttttttttgagacagagtctcactctgtcgcccgggctggagtgcagtggcgctatctcggctcactgcaagctttgcctcccaggttcacgccattctcctgcctcagtctcccgagtagctgggactacaggcacccgtcaccatgcccggctaattttttgtatttttagtagagatggggtttcactgcgttagacaggatggtctcgatctcctgacctcgtgatccgcccgtctcagcctcccaaagtgctgggattacaggcgtgagccaccgcgccaggccaaaatctcatgatgttttaagaaagtttacaaatttttgtttacaaagccatcctggaccgcataaagcctgcaggccatgggttgaacaagtttggtatagcaggaccaaagaccctgaggtcagacaaggccggcatttacctgaacagaaggaaaccttgataaatagaatgaatggggaggagaaaagtagaagctgaggtcatagaggaggcagtggccaatttagcgagagggcctcacaggccaagggcaaggggtttgaagtttattatgagttgatgggaggtcagtggagggctttgatgtatcattttggcctctgtggatgatggatggtggggagaccatgagtggaggcagggaggctagcagggaggccactgctggagtttagtggagagatatggtggctttaatgagaacataattgaaggtacaaaaatgggcagattgaagatgtatttgggaggcacagctaagactatctgcggatgtattcggtgtggggaatgtggaagagagaggctcaaattcccaatttatggttgaaactgacactcaaagggattaaggaatttctgtctacagccgcaaatacagggcaggcaaggactccaggctggttctctaattcccaaatgacagctcttctcattcttgcatgaggatatgaggtttgcagaaagaagggattcatgagtagtaagtcctcttaatcctcctagtatggatctaatgattttttgaggtcatgcgtagtaaacaatgtgtaatatccattcaactagtcagctgatttgtggttacttgcaataagtcattattttcaatggggtcgataatactgtctctgacactaggtgtttgtaaccacaaagtgcacttcagttgaattcctttccgaggttgttttatgttcagaaccaacctttcgtagttatatcattagttattagagggataccaggcaacagatcgagtttatttcttgtaagcgttcttgttgcagtcatatatttcgtggtttcattaaatcggccttggtagacaagctgttctttcaaatccctctgtgagcagcaaatgctgtggattgagatctgtattctccagatgatttgctaagtcatctcagaagagtcctctgaactgtgaggtgtccccagcccttttgtcccagatccaagaaccaaaaaaagaacttgaaatggggatcctgctgattgtgcctacacttgttcattcatttcataaatacttactgggccctccagtgcacaccaggcactgttccaggtgctggagagatacaagcgagcgagagaggtcaggctgctgccttcagggggcttcttattcgtgggcaaaacaagcatgacaaatgggcaaacaagattatcacagtttaatacgtgataagttggtcaggtaaggcctgataaggcaacttatcacgtatcaaggttttggcctctgtggatgatggatggtgggaagaccatgagtggaggtagggaggctagtggggaggccactgctagagttcagtggagagatatgaccaacttggttaagttggtcaggtaaggcctcctcaaggacacggcacttaagcaggaggctggaagtataacaaagcagctatgagaggagctggggaaatgcatcccagggagtgggaacagcgaggacagagccctaaggaaagtgtggtgcattgtttagtaccctgttggctgctataatagagaaacccaggccaggcacagtggctcatccctgtaatcccagtactttgggaggccgaggtgggcagatcacgaggtcaggagttcaagaccagcctgaccaacatggtgaaaccccatctctactaaaaatacaaaaattagctgggcgtggtggtgtgtgcctgcaatcccacctactcaggaggctatggcaggagaatcacttgaacccaggagccggaggttgcagtgagccgagatcacgcctctgcactccagcctgggcaacagagtgagactctgtctcacaaaaaaaaaaaaaaaatagaaaccgagactcacaggggtttaagcaagatggatatttatttttctgtcacttaatagcatgggtggacagttcaggactgatgagatagctctgcaatattttgggacccagactctgctgtgctacaatctggcattctcaatatgtgacccctacctcatggtccaagaaggcttctccactcctgccatcacacctacttcccggccattcagaaggggagaggggaagagacggcctcttccctatgtagaggcataatatccagaatttgtgcgtatcttctccaaaggagatggaatcagataagtgtgtggtaggcaggtcattcgggaccatgtagatcatgataggatattgcgttttattccaagagcagctggatgccgctgaagggttttaagtagtgaagtgacatggtctgatttatgtttttacaagaacactctggctgctgagtggaggatggatgagtggaggatggatgacagaagggcaaaagtggaaatggaagatcatttaggaagctgtgatcttaaggagcaaggcaaggtggactcagacactgagacatcatataattgtagctttagagtattaactgtttaaagagacaatgagtaaagactgaatgttcatgcacctctttctaaaatacagggacagcctttgcgtggacaacttactggatgagcaggtttaaggaattgtatcctataaaagatagacgtgaaaccagccaatgtgaatgtgccgccaaattggacctggttatatttgtggggacccttaacttaggaatatagaaagcacatgaaagtgcctgtcaagctagagccctgggcaggggcaggctcagtctcccaggaggttagagctggaggccctctgagctcatggattcaacccttgtgctgcaggtggagaaactgatggtaggagtatggggggctgtggcttgcccaagttcaactttggacagttgcagaatcaaggcaggaagccaggactggaagccgccactctcaccatgcaccgtgagggggtatccttgatgggatgctttctcctgaatcacacatttaccttttggcctcctttgccagcacctcccttagaacaagttcccttctttacctttccccaaagtcccctggcctgtacctcaagtgattccatcagttaccttgtcttccaaacaggactggccagatgacgatggtaaagtgattttgagagattataactcacgtttgctgaaatgttttgaagtttcaagacagtagtatgcactgtgaatgccagtgttgctcaagatcctagagacagccctgggtcctggagccccggcagcctgctccaaggtcaacaggcggggccccggcaattgtttggggaccattttcacaaccttaaggtaatttgtggttcctctgagaatgcccactgaagtgttccccctcagaatgctgtggatgggagatagaaggaaacaaaagaggaggaagcagtgaggattttactggatactgcagatgcacttccacatcggcatgggttcatactggattatgcaaaagtatggattctggaatgattcattccccccaaaacctggaactcgagggcagcatgctgcctcgttgtccataaaacactcccttttgtctctgcagggatcttaaaaaaacaaagcaagctttactgtggcaaaacctcctctacatattatcattgtctgattggattttaagcacaatgctatcttggtctacacattttcttatacaagtgacagtaatactaaaaatctcagaattattatcaagagccttttggtagggtgaaagtttcttttaagtattttcattttcaggagtgagttttcacacacacacacacgcacacacaagtatcaggaaacaaaaaggaaatgtgtgcaaacttccaatttaaatgttctacatcttagttgagatggctatgatacagatacatgtatttggcaaaactcatcaaactaggcatttaaaataagtacatttttggggtacaaattatacctcaatgaagttgattcaaaaagtcaaaagtaaaccaaaaattccaattttatattccattaataagtttttggtgtctgcttctggttttattaccgaggattctcatttgagtacactcagaatggaacagagctattatcatcgaacgtttcctatactgggactaaagtctggccaggaaattaacttttaaccctaactttgtgctattttgagataaaagaaatgcacacctcagaacagcaaggtgttacagcacataactgcctgtacaatttaaaaactcgataaacccaaagctttggtagcaagtcttagcaggtgctgagaaatacgaaacgattaatttttttttttttttttttttttttttgtaaaccagaaaacaagtctggtgttaagcctgttgtgcaaatactagcattaaatattttgtagcatatcttagttccaagtatttcttttctgtcacatttttctggttcctcctgataatcaaggcaatattctttgaactgtttccttagaaaagttgttgaaatgaccaaatttctaattccattgggatttggacacatttctgaaatggcccagaaatcattttggggagcccttaggctgctgttccaatccagcacataggtgtgacagcggagacccactcggacttcagggactgcctgcctcctccctccacacccatctcctgtctccccaggacctgtcctcaggagctcaaaagaagaggggtcttggtcctgagagggtgagggggcgaccgggaggaagcacttcctctctgtttcttaagacatctcccttccctgggacaacttccctaaaaggctttctttttttttttttaaccacttttccaaagtcagaaatgaatacattctgaaaataacccaactttctttttatgtttctttctttccacccccacctcaagcccctagaatggccagcccacctggctagcaagaacttaccttcctgagcatgcctggggacagaccctagcacacaccccaccctgggctcgtggcgggactctggctctggccaacatggagatcccagccacacactgatttggaggcctgagtgtcaatgacaaaagcaatccaaacccaaaactctcaaaattgattaaacaatggaaagcttggctttacatgagatgtgtggaaagcatcctgcatccaggtactcactggaaggcagaaatttagcagatgttgctattattatccttagggttaatcatagtgattcctgacttacagaatccaaataaaggaaatccacttcatgcatcagccgccagctgctttttttttttttttttttttttttttttttttgagacggagtcttgctctgtcgcccaggctggagtgcagtggtgcgatctcggctcactacaagctccgcctcccaggttcacgccattctcctgcctcagcctccggagtaagcccccagctgctctttgtggacactcattgcccagacccccactatggtcgatcagtattaattgcattaacagatttaattataaaattatttcaactgcctgtttttttctgtcttccattctgtgttataatagtttgccaggttagctccaaacacttaatgtctgttacttactcaatataatcccacccagtacatcacctttactgggaaagaagcttgttaatctctgtttaccagtctgctcccagttattcaaggactctctgaacctaaaatgtataatatgacctaggtcagaatggcgttcccataagtgagcaccaacagtacgcagcggctgacacgtgtgaatccatctcttgttcccttgaactgtgaatcaacatggatgtagccatagtcatatctatcaccttttgtgagaaaaattttactttgaaaacaaagtaatagactgtacagttaaaggacagcagaatccagcaaaggtctgtctgtatcacaaaggaaagccacatcatgtgctttattcccatcatcagtcaacatccattttttgtagctctgggaacctaggtgtctgagagccagcgctgcgtattggtagcactggttctgccatctctaagccccaggacaagtatcctaacagaactaagccctggcttcctcatctgtaataaaataagtaccttctagtattcttattttattgtgaaaagacaattctgtgcacatatggttacacacacatagactataatgacacttgcattttattggtattcacaacttttaaaaattttcctatttaagacacagcttaaaataattaaaaagaaatcatcacatagttattactgaagatttgcttctatgttccataaaacatggttttaaaatataaaaaaaagacacagcattgatttccttcaatctgcactttttttcccattttgctcagcacacaaccttttaactcactcttaaaaaaaatccaccataaaggactggaaattaagagaagggtgttatataaaaaatgccatgtgtgctctgacttacaaagtcttcttcagtccatgaactcacagacagtgtcagccactgagagtgtcgtcgtcaaaacgaataatagatgtggaaagccgtggctcctgctcctgagagctggacgcctcttggctgacctcctgcttgagccagatccaagaggtgaaggctgaagcaagagagctcccttgagaaagctccagagtttgtagcctactaaaccagcagtgtcctatattacattaattctcctgatgtattttcctgacatttgtcagcatttccttctatttgccaaacatggacaaagagaaaaccaggttttagaagtatgctcatttataaagtctctcctgagtcctcacctttccatcccttctgccatcacctcagtcagacccttaccccatcactcaagacagctgtaagtctcctggcttgacacttcgcttcaatctcactcatctctgattaaaattgtcccatgatcgaaaattttatgttgttttcgtcaccattaaaaaaacaaaaaaacaaaaaaaaaaacccttcctcttccaagatgctccagtgcttaacaaatcaagtgtaaactgatttgaagcgtgaggccctgcgtgatatatactgtaggagacctttccagctttatccaatatccatccctagtactttgctgttaccccatgatatggtttgactgtgtccccacccaaatctcatcttgaattgtagctcccataattcccacatgtcatgggagggacccagtgggacgtaattgaatcatgggggtgggtctttcctgtgctgttgtgatagtaaatgagtctcatgagatctgatggttttataaaggggagttcccctgcatgagctctcttgcctgccaccatgtaagatgtgattttgttcctcctttgcctttgcctatgattgtgaggcctccccagccatgtggaactgtgagtccattaaacctctttcctttataaattacccagtcttggttatgtctttattagcagcatgagaacagactaatacaccacacatgctcattgatttcttggttttgtgaaaggcccatctccctctcccatcagccttctctttgcaaattgtagcccccgttcaatgatcagttcagttggcactgacacccacaggcttcccttgatcctgtgccccaatctagatccatagctctctcctctggatgtccttcatgtgactgtgcatcatagccttctgtattttgcctcggtcagtgtttattcttgactatgagatcctgcagggtattgtagtataactgtttctctgtgcctcacagtgccaagcacagggccttttgtatagagcatactaataaaatttctgattccaactaaattcttgtatgcacacataggaagtgtgacttaatatatgcatatggaatcaaaatgattactttatagttagcatgtgtatgtttgtatgcagaaaattcaaaacaagtattcaaacaagcacaaagttgtgtaactaggaaaaacacatgctcatttactcctgacctgtggggcccaggttccaggccctacactatgtgatgaagacacaagacaagaaaatatggcaccttctttgagaagcttccatctagtcagggagaaaaacctgtgatcatataactgtagcaggccctattactcctgactacactggagaggccaaaaggagcgtgcctggttcagcctaggggtgttcaaggtggtcgtatcactggctgagggagtgtctgagggaacacacagccagggggctgggagaagcagggtgggtcagagcacaaagagacttgttcatcatttcgaggcgcctgtgctttctactagagatagtcactgaagcagaatgagaggatcctacgcagtttcagaaacatccccctgagggccaggtggaggatgaaatggggggaagaaggcaagatggcgggcagccatgagaccatggcaagaactctcagactggaaatgaggctggcttgagggaaatgggagacgggagcatttgagaatgtggagattgcatgagaagggatggcttttgggtgagtgaggatggctggcctgcctgttcacccgctgggagcctggtgaggtctcatccacttaccatgttgtctgggctagagagaggtagcacctgtagaaaccgcaattaggggtcctatgcttttgtttaactttctggaaatagaacaggcctcccttttaatacatctgttattcagcctttagatattctgctttcaagcgcgtaatcaggaatgcattagaataaagcagttaggagcagagtaacagaagggttaaagtatttaacttctccaggcctgtttcctctgtaaaatgagaaagaagataataatagcacctatttcacagaggagctacaaaaattaaagaagttaatgaatgtaaattgctcagcctagggccctgcataaaatgtgcacttaagacatcagttacttttttttcctgtgtgattggtgaggaaggttgagaaaagcatgaggactccttagctcttccgaaatacagtcatgtgctgtgtaaggacgattcagtcaaccacagactgtgtgtacagtggtggtcctatgagattataatatggttacttttactgtaccttttctgtttaactacctgtagatacacaaatactaccattgcgttacaattgcctacagtattgagtacaataacatgctctacagatttgtaacctaggaaccatagaccttaccatatagcctaagtgggtggtaggctctgccatctaggtttgtggaagtgcattctgtgacgttcccacaataacaaagttgcctaacaagactcatttcacagagtgtatccccatcactaagcaacacataactagtacttgctacagttgcaatataggcaaagcctcccttcttaaatataaataagcacacttttcaattcggagatgtattttgtatactaaatttgaagacattgttttgcctttttgtagggagagctggagattctgctcttatatccagagtggcatccgtgtgacatagtcattctttgtatgtgtgcctttagcctatgggtcattgtcagaatttagaaattcaaggtgcagccagttacattgctagagagatggaatatttcagagtctctgcaagcttcctttaagaaaaatgtcttcttttggaaagccattcagaaaacatactcagtaggacagtttcaacttattaaactttcaggaaatttttttaattgtctcacactgtctcttttgctgtataaattttaacagcagggtaaagagagaagcgttcttgaatttcactagctgcggagaaaatatttctcactgccctgggatacataggaaatcacagtcgttagtttcagatgtttagtttgggatattcaggtgcattcacaataccttttgattcattattactttaaaccatttgtggtttgatcctacaaattgaggacttttctccagatgtgaaaaatacaataaaattttctaacagaggggatctcgagaagaagttatctttatttctgcagtttctacaagagtccataaacccctttagaacatggcaaaaactgcagattggcagccatgggttggctggactgaaagggaagggggctcacatttaatttagagcataagaataagctaaacagcaaggcagtgacaaatgatacaacaagcaacaactcctagctgactgctccgaaataaacacatggattccaggcctcacctagaccaagaacatattctgcaactaaaattaaaccttcgggacatgcaaactctttagggaaaggagtggaagaaggagaagaagaaggaactcagaggttaccaagcaattgagtggtgaagagaacaggcatgaagaaaagagaacaggtgtgaagcaacgaaggaaattgcttctccaaatgaaaagttttgaaacacagccctcaccaacctcagaaaaatgctaactctgaaataggaaatggagacggaattggaaatggaacgtgaggaatatcagtaaacccttgtaactgtgcgatcaacttctttgtaagatttttaaactcaaaagtaaacacttttaaaaacttaaaagtgtaagattttaaagtggtataaagatcttaattaggcatttaggtagtgcatgctgtggagccccaaacttacagaagtgacaccagaaaaagccagaatgatccctttctgtgttccagtacttgtgggaaaaaattatttttattaatttgtaaagggctaaaatatttatggactaaattcagatgagtaaaaagatgaaggtgttagagtcgcttttctttcttttttttctttttcttttttttttttgagacagtttctctcttgttgcccaggctggagtgcagtggcgtgatcttggctcactgcaacctctgccccccagattcaagtgatctcctgcctcagcctcccaggtagctgggattacaggcacccaccaccatacccagctaatttttgtatttttagtagagacggggtttcaccatgttgaccaggctggtcttgaactcctaacctcaggtgatcacccacctcaacctctcaaaatgctgggattacaggcatgagccaccatgcccagcctagagttgttttaattttctatatcgggtctcatcttgttctgaggcatccatttctatgttcttggtttgggttgaggggagattgaagcttgcacttaaagtcaactaagtctctcatttaaaaagtgtttcttttaggtgaattcagtctctctgaggcaaatactcaatctctctgccttcatatctcctttccagagtgtcaaggggcccgggattacacgcagtcttcagggtctgtcttcatctcctaggctgtcataacaaagtaccacaaactgggtggcttacagcaatacagatttatcctctcacagttccggagcccagagctctgaaatcagggtgtcagtaggggtgggtcctcttggggactcagagggggaactgttcttctcttccagcttctgatcgttactggaagaccttggtttttctgggcttgtagaagcataattttactctctgcctgtgtctccacctgcctttctccctgtgtgtgtgtctgcgtcttctctttttataaggacaacagtcactgggttagggcttaccttaactaaagatgacctcatcttaactcgaccattgtattagtccgttctcacgctgctatgaagaaatgcccaagactgggtaatttgtaaagaaaagaggtttaattgactcacagttctgcatggctggggagtcctcaggaaacatacaatcatggcagaaggcaactcttcacagggcggcaggagagagagaatgagtgccagcaggggaaatgccagacgcttataaaaccatcagatcggccgggcacggtggctcacgcctgtaatcccagcacgcctgtaatcccagcactttgggaggccaaggcgagcagatcatgaagttaggggttcgagaccagcctagccaatacagtgaaacctgtctctactaaaaatacaaaaaaactagctgggcatggtagtgcgtgcctgtagtctcagctacttgggaggctgaggtaggagaatcacttgaacctaggaggcagaggttgcagtgagctaagattgactctagcctgggcaatagagggagactccatctaaaaaaaaaaacaaaaaacaaaacccatcagatctcatgagaactcactatcacgagaacagcatgggggaaaccacccccatgattcaattacgtccccccaggtccctcccttgacatgtggggattacagttcaaggtgagatttgggtggggacacagagccaaacagtatcaaccacatctgcaaaaactgtctttccataaaaaggtcacactcacaggtaatttgacatagctttttggggcacacaactcaacctgtaataggatccttacaggtctttgctgtggtggctatgctggtctggtggccacccttgtggcgctgaggtgctgaggttgggggatgttctgccgtggcttattaaagggcatagtgctagccatctcccattcttcctgcatctgtactgcgtgcaggctgcaggggagcacagcactacctaagccccatccaacagacaagtgtggctctcttaacagggggacttactactcgtgtgccaaattcaatgctgctaataggaagcttgaaagcaaacagtctatgctttggcaaggaggatccactctcactccagccccatgtttcaacgtttaaagggaagccagaatacatacacagatggtctccaacttatgatggtgcaacttacaacatttttactttaccatggtgcaaaagcaatacccattcagtagaaaccgtcctttgagtacccatacaaccactcttttcattttccctacagtattcaatagattgcatcagatattcaacatgctattttttttttaaacggagtttcgctttttgttgcccaggctggagtgcagtggtgtgatctcagctcactgcaacctccacctcctgggttcaagcgattctcctgcctcagcctcccgagtagctgggatcacaggcatgtgccaccacacctggctaattttgtatttttttagtagagacggggtttctccatgttggcctggctggtctcaaactcccaacctcatgtgatccgcctgcctcggcctccctaagtgccgggattacaggcgtgagccaccacgcacggcctcaacattctattataaaataggttttgcattagatgattttgcccaattgtaggctaatgtaagtgttctgagcacatttaaggtagggtgtgtttggtaagttgagtgtattaaatgcacttttattctgacaatatacaagacagtaatattattttttgactgaattagtggctgaattaataagtgaaagacaaaaggactgcttttgcagggtgagctcaaaaacgtacgatgggtttactgggatgtagccccttcatgctggaggaacctctgtacgtgtgtttccttagggctttgcaatcactgttccttctatctggaatgcttttttccttgggttccttttgagaggtgacagcgtgctggcagtcctcagagccctcgcttgctctcggcacctcccctgcctgggctctcactttggtggcatttgaggagcccttcagtcccccactgcactgtgggagcccctttctgggctggccaaggctggagcccactccctcagcttgcagggaggtgtggagggagaggcacgagcgggaactggggctgcgtgcgggccagctggagttccgggtgggcgtgggcttggtgggccccacactctgagcagccagccagccctgctggccccgggcaatgggggacttagcacccgggccagtggctgcggagggtgtactgggtcccccagcagtgccggcccaccggcgctgcgctcgatttctcgccgggccttggctgccttcccatggggcagggctcgggacctgcagcccgccatgcctgagcctcccacccactccatgggctcctgtgcggcccgagcctccccgacgagcgccaccccctgctccacagcgcccagtcccatcgaccacccaagggctgaggaatgtgagcgcacggtgcaggactggcgggcagctccacctgcagccccagtgcgggatccactaggtgaagccagctgggctcctgagtctggtggggacatggagagtctttatatctagctcagggattgtaaatacaccaatcgggactctatatctagctcaaggtttgtaaatacatcaatcagcaccctgtgtttagctcaaggtttgtgagtgcaccaatcgacactctgtatctagctgctctggtgaggacgtggagaacttttatgtatagctcaaggattgtaaatacaccaatcggcactctgtatctagctcaaggtttgtaaatacaccaatcagcaccctgtgtttagctcaaggtttgtgaatgcaccaatcgacactctgtatctagctgctctggtggggccttggagaacctgtgtgtggaaactctgtatctaactaatctgatggggatgtggagaacctttgtatctagctcagggattgtaaacgcaccaatcagtgccctgacaaaacaggccacagggctctaccaatcagcaggatgtgggtggggccagataagagaataaaagcaggctgcccgagccagcattggcaacccgctcgggtcctcttccacactttggaagctttgttctttcactctttgcaataaatcttgctactgctcgccctttgggtccacgctgcttttatgagctgtaacactcaccgcgaaggtctgcagcttcactcctcagccagcaagaccacgaacccaccagaaggaagaaactccgaacacatctgaacatcagaagggactgactccagacgcgccaccttaagagctgtaacagtcaccgcgagggtccgcggcttcattcttgaagtcagtgagaccaagaacccaccagttccggacacactttcacctggctcagagctcaaatgtaatctcctcagagtggccttccctgctcctgctacctagagtagcatctccccgtctcactctctcccttctcctgctttattttcttggtaaaatatcatttcagagcacgaggctttctttaagcaaaggacagacattttgcttattgctcaactagtttttgagctcatcctgaaaaaagtagcttttttgtctttcacttattaattcagtcaaaaaataatattactgtctagcaggctgggcgtggtggctcatgcctgtaatcccagcactttgggagaccaaggtgggcagactccctgaggtcagcagttcgagaccagcttggccaacatgatgaaaccgcgtctctactaaaaatacaaaaattagccaggcatggtagaatgtgcctgtaatcccagctacttaggaggctgcaacaggagaatcacttgaacctgggaggcagaggttgcagtgaaccaagatcgcaccattgtactccagcctgggcaaaagagtgagactccatctcatatatacttgagatgtatatatatgtatatatgtatacttttatatatatgtatacgtgtatatatgtatgtgtatacatgtatacatgtatgtgtatacgtgtatacatgtatgtgtatgcatgtatacatgcatgtgtatgcatgtatacatgcatgtgtatgcatgtatacatgcatgtgtatgcatgtatacatgtatgtgtatgcatgtatacatgtatgtgtatgcatgtatacatgcgtgtatgcatgtatacatgcgtgtatgcatgtatacatgcgtgtatgcatgtatacatgtgtgtatgcatgtatacatgtgtgtatgcatgtatgcatgtgtgtatgcatgtatgcatgtgtgtgtatgcatgtatgcatgtgtgtgtatgcatgtatgcatgtatgtgtgtgcatgtatacatgtatgtgtatgcatgtatgcatgtatgtgtatgcatgtatgcatgtatgtgtatgcatgtatgcatgtatgtgtgtgcatgtatacatgtatgtgtatgcatgtatataggtgtacatgtgtatgcatgtatataggtgtatatgtgtatgcatgtatatatgtgtgtatatgtgtacatgtatatatgtatgtgtacatgtatatatgtatgtatgtatacattatgtatacatatctgtcaagcataatgtcagaattagcaatattgattaaattatgtagtccttgaaggtagaaactctttttcactattgaatcctcaccacctggcatacaatagatactcaataattccttgtgtgggtgataaatgaatgggattccataacaaagttgatctgtgtaagacttttatttcactctttctataaaattaagtccacaatttttccatggatccttgcccaagaccacatgttgaaaagaacttatacgaatggcagatagcatcacggctaaagaaatagaatcttttgaagacaataactattttacttttaaaattgctcacaaattaaagaatgctggtagagataacaaagatgatttccaggagtaagaggccatcatgcagtttgtgatttccagatacttttgcagaaaggcaaccatgctgtagagtcagtagcagagttttcaccacctgtctaagacagaggaaaatgaccccaaaaaaaaaaggcaacttcaggcccttcttcaaaaatgcaaatccagggctacttccagctgtctccatagcatggcaaaacaatattcccagccaagcttcaagccattaagaaaaaccatcacagctgtgcgcggtggctcacgcctgtagtcccaacactttgggaggcccaggaaggcggatcacgaggtgaagagattgagaccactctggccaacatggtgaagccctgtctctactaaaaatacaaaaattagctgggcgcggtggtgcatgcctgtagtcccagctactcaggaggctgaggcaggagaatcgattgaacctgggaagcagagattgcagtgagccaagatgaagccactgcactccagcctggtgacagaacaagactctgtctcaaaaaaaaaataaaagaaaagaaaaaccatcacatatgtttggcaggggccaacatatccatggggttcagtaggcccacagtacttccagggacccacaaaagtgttctaataacatttaaaatcagaagaaaaaaatgaactgttaagtcaaaggaaaaatgttctaatatataatatgttaatacataatatcattatattcatctttataccaacacagtcctaaaatattacttttgatttttttttaatggaggaagaaaaccttgaaagcaaaagtgcctagggcctgtgaaagtcatcacatgaccctgatttggcgtctgctttgccttaaaaaagcattctagacagatattcagctggaaatactgaaatgggctcatgccaaaagaactagatctcttgttatccagaaaaccatattttctaggcagattcatttcccccaagatgcctaagagtcatgataacatattttagaggcgagattaatgcgatcgccccataaaatattttaagctctcatctgttctgaaacaaagtacgcaacatgtcaccaagagaaaatgactgctcataccgagaaaatgtattttcttcgaggtgccacagccactgtaatttgcacctcctgaagtgtagatggaagtcccctcaacatgtacagacagttaaaagagtcacggtaatgataggactagagaatgtgcccagctgagaaaataagcacacagcgagcattgtcagagctgaaaattaagatcccccaagcaaacatttcagatagagcccctcatcttttgttaaaagtaaaatgaaaatcaacagccctctacaccacatctgagccatggaagtcactccctttaggtgtctaagagacgactgcagcttcagtgcctggctcagattagctttgttcttccttgtctcttatcctttgaatagctctgacagtgccacaaggagtaattaccaattcgcagggggacacatcttcagttaaagtggattatctgcaagttgaggggtgggggttgctggcggctacaactgagttaggtattaagtataatctgcaaatgcagggagagttctgcagagccccaggcagttcttaactttctagaagtagctcccagctgaggcctcccctggtctccaggcatctggataatgtcttaactggtagagtgatggttaagagcatgagttttgggggcaaatttcctggttttatgcactggcacttcctagctcatgtgattctgggcaagttacttcactacagtgagcgacaatcagaatgggtccaaaattgtaccagccatagcaaggtgctgcagatgtagcaggacgaattgcagacaaaactcagacaccaagttaaagaaggaagaggtttattcagccgggagcatcggcaagactcctgtctcaagagccaagctacccgagtgagcaattcctgtcccttttaagggctcacaactctaagggggttccgtgtgagagggtcgtgatctattgagcaagcagggggtatgtgacaggggctgcatgcaccggtggtcagactgagacagaacagaccaggaagtttcacagtgtctttctatacaatgtctggagtctatagataacatcagttgctaggtcaggggtcgaattttaactaccaggcttaggtcaggcgggcccaggcctggtttcgggtctggttcctaggcactgggctacctgcctttagtttcgcttctctttccttttctgattatagaacaatataaaacaatatgagagggtctgtctctcttctctcacaaacattaataagacattgtgtttcaaatgctaagcatacatctaatacatggtaataaccccaagaatctttagctgttaccattatatttttatattttttttaattaaaattgaatcccttttttttttttttttttttttttttttttgtcttttgtgacagagtgcctctattgcccaggctggaacgcagtgctgtgatcttggctcactgcaacctccgcctcccaggttcaagccattctcatgccccaacctcccaagtagctggaattacaggggtgtgccactacacctggctaatttgtgccactacacccggctaatttgtgccactacacctggctaatttttgcattgttagtagagacagggtttcgccatgttggccaggatggtctcgaactcctggcctcaagtgatccaaagtgctgggattaccaacataagacatggcacccagcctctgttatcattattaagcattcatttaagccaagatctaaggggaaccaaggcccagtagcaaatctgctaatactcaggaaatgggtttgtgagaaatgttgctgttctttatcattattattattattattattattattattattattactattactgctacattcactatgagaaaacattcacgtctcagaaataacagtaataaggggtaagcattgccaggaggaggcagaaggcacatactggccaagtccggctctacgccctgtgtgtacagatatgtcttccaactttcgaaaagtctttgtaaaggttttcgctgatttgagctgttttcagctaagtcaccagaacatccagaatctaattttaaatgaaggttattataatgtccctcagtttcgtagcctcttattcaagagagattagaattctgtgaaggaaaagctttgttttaagttccaagggatgtaaagatttgctaggctgtctttaaatcccatttgggaactcaccatttatataaaaatggatgacatataatgtgtctttgggaacagtgaactctgaagagaaagatatggtcaaatggcccggcctcctcccacctcggaggatacactgcaccctcttcctacccctgatttggccctttcacaaatctcagctctagactgaggcagaaggacataaagatgcccatttccaaagctctccggctccccagtgcctctggttctatccatctttgtgacctgacgtctcagtggctgggtcccagatagggagctctggtctccggttcctggaggctgagcctgaatccctccacgcagaaagagagtcagggacagcaccgggggctgaatccctgccccaccttctagcagagtgacctcagtcaggtgactttactcctcaggctgtttcttttctggataacaaaaggtcattcaaccccatcttgtggattttctgtggagatttagttagataaaggactggcacacagggtgaagtgaggcagccttcccctcttccgcacagtgccacacagaacaggggtctgaggacttgccttctcccctgcatggctggtccccccctacccctgcccttccctggtgtttccaccgcaccccaccagctggaatgacatccaggattgaactcaatagccccttggcttacagggccactttctccacacctaccctggcagacttgatctcatatttgctttcagtataagatccagttgagcatccttccattaatgccccacagaacaagtctcagccttctccctggtgccggcctttccaacacctgaaggcagtgacggtgtgcttctagagtcttctcttccccacattcagcatccacagttccttccagtctgcttcacatgacaccgtctcaagcatggtgccatcctcaaaacacaccccggtttattattgctttcctgctcaagatgctctgtccagaactgatcacctctctggggtatgctgaccaccccaggggatggtctcagaaaccactttctaaattggaatatagactccatccttttcatgactcagtcaggtctcactcttaattcctaaatcccaaataattaacaaaaataccagagtcctgaggggttgctggaaaacaaaactggaaaaaaaaatccagttttcttctatcagccccattgtcccaacaaaggagggggagaggaggctacgtgcagttaccaggtgtgtcctatacaatttggtattgaaggtgattggggtgggggaaggcacgatggcatttccaaatatagaaattggttattcgtttctgctaaactgtatttagttatatctagggaaatcatttcagcctctcggagtccctttggctcacgataatgtcctcttgagtggagccatccctttttactaaatgccatatggcacattcatcaatgtgccattgatgtctttatccaagttaataaaatgattaaatgtaggcttggaatcaccactaaaattctccttgaagccaatttctacctatttatcaaattccaccactgttcatctcatgattaatctacctttaaaatactctcatgcatcactgaacgacagggatacgttctgagaagagtgtcattaagcaatttcatcattatgcgaataccacagagtgcacttacacaaacccagaaggtgcagccttctacacacccaggctctgtgctacagcccattgctcccaggctgcagacatgtgcagcacgccactgcactcaatactgtaggcaacggtaacacaacggtatttgttcactaaacatagacaaagtatggtaaaaatatgatataaaagataaaaattggctgggcgtggtggctcatgcctgtaatcccggcactttgggaggccgaggcaggcggatcacaaggtcaggagatcgagaccagcctggccagcatggtgaaaccccgtctctagtaaaaatacaaaaaaaattagctgggtgtggtggtgtgtgcctgtagtcccagctactcgggaggctgaggcaggagcatcgcgtgaacctgggagttggaggttgcagtgagtcaatatcacaccactgcactccagcctggggacagaacaagactccgtctcaaaaaaaataaataaaaaataaaagtaaaaattggtacccctatataggacacctaacaggaatgaagcttggcaggactggaagttgctctggatgagtgagtgggtggtaagtgaatatgaaggcctaggacattatactactgtagattttataagcactggacactttggccacattaaatttaccttttacaattttctttctttaataataaattaaccagctgggtgcagtggttcatgtctgtaatcccagcactttgggaggcagaggagggtagaccacttgaggtcaggagttaaaaaccagcctgatcaacatggtgaaaccccgtctctactaaaaatacaaaaattagcctggtgtggtggcatatgcctgtaatcccagctactcgggaggctgaggcaggagaattgcttgaacccaggaggcagaggttaccgtgagccgagattgtgccactgcatgcactccatcctggtcagcagaggaagactccatctcaaaataaataaataaataaaataaattaaccttagcatactgtaccttttctaactttatagacttcttaatgttttcaaactttttcactttttcatatttttgtctaacacttagattaaaacacaaacacattatacagctgtaaaaaatatttctttttatatgcgtattctataagattttgctatttaaaaatttgtttttaacttttaagacttttttattgaaaactaggacacaaatgcacacatttgctttggcctccacagggtgaggatcatcaataccactgtcttccacctgcacaccttgtcacactgggaggtcttcaggggcagtgacacacatggagctgtcatctcctgtgataacaatgccttcttctggaatagctcctgaaggacctgcctgaggctgttgtacaattaccctttttaaaaataaaaaataaaaaaaaagtaggccaggtgcagtggctcacacctgtaatcccaggactttgggaggctgaggcaagcagatcatgaggtcaggagttcgagaccagcctggccaacgtggtgaaaccccgtctctactaaaaatacaaaaattagccaggtgtggtggcgggtgcctataatcccagctacttgggaggctgaggcacaagaatcgcttgaacccagtaggtggaagttgtggtagctcagattgtgccactgcactccagcctggacgacagagcgagactcagtctcaaaaaacaacaacaacaaaaaagaagtatactctaaaataatgataaaaagcacattatgataaatgccaggcaatagaaaaatttcagctccattataatctcctgggaccaccctcctacatgtggttcatccttgaccaaagcatcattatgtggtgcctgactgtactactcaaacatattacaatgagaccatatctatttgtcttgaccacaaaaatgtcatgagaaacttactaaaatgctttgctgaaatttagatggcctctctcagtgctctcccacctaggaggctattaccccaatctgaaaataaaggaactggctttaggggttcagcagtgagaataggtgttgacaggaagaagtatccaaaggcctcccagtgggtctccggactgtgtcccttggtggcatccagggtggttgcgatcgtatggtttaaattttgtgatgatccactggagcttcaagttcagcctcaaagcattaggctctgttttctgaacatcattttatatggcaaggtcccgagattctaattttttcttgtgttaattatgtgacatggagcgtcagttaagggaaccatccaatacactttccagaaacagttctccctctcagtttcttcgtgtgcttgactggctcatggccctggggaaaccatcgctttcaatccctacctcaggtccatttcgtgatgtttatgcattcatgcgatcttagtcctcaaaggatttttttttcttctcttgggtaagatagctttagaggccttctgggataggaattataatacaactgagaacaaaggaagaaaaataaaaagtgaactactttctgttttactgaatcattcaacttgacattatctggaaatacaaaaatttgctaacacacttttcctagcctacactttgttatgctgcttgtgaaatgtatgaggtcaacacctttctacccttttttccccattgtcgcaaattctcctgctgtccagagttagtttcaaatgaccctctgctagtcttggccggcatacctaccagtggcttggagaggaattaaggaaaagcttgaaaactgaagctcatttttttgtatggtgttggctagagtttaacgtggttctccaaagccaaaaaaacattttagcagaagcggagcacacacagagataaattatttttctgtactacatttcagttggtaatttcgtacacaggattctatttctgctgctatcaagataaaatgcaaaagtggaaacattccaatgagtaagaagcaggtctgttcattcccagctcatgagaaactcaggacgcacattagtgttctgtttcccagcagcaaatagccaggacatatagcttcaatttactgggattcgaagaagtcaaatcagacctgatttcccatgaagtaaatcatagcacccagctctgtggtttgagtgacaggtacatccattattctgaaaggtcttgttactttcagcagagcttgttattcttagccctaaaaaatcatgccatgtgacagggcacctgaggctgaggaatggggcaccagcaccttccaggctttctatcttacatctgacaacttgaaacatccaggaaagaagtggaaaatccacatatcagatgtgtgctcctacccattccaaatgtctggtgtttgggaaacatttaagggatcataaattctcttttgtgtcaatgtttttggtactgtgtaattacaactatatatgtatagttatgtatatatgtatgttatactatatataaaactatatatagttacatatatgtatatatacaactatataaatatataaactataaatataaaatataaatatatatatttttatatatatatagtatattatatatatacaattttttttgagacagagtcttgccctgtttcccaggcttgagcgcaatgccgtgatctcggctcactgcaacctctgcctcccaggttcaagtgattctcttgcctcagcctcccgagtagctgggattacaggcgtccaccaccacgcccagctaattttttgtatctttagtagagatggggtttcaccatgttggccaggctggtctcaaactcctgacctcgtgatccacctgcctcggcctcccaaagtgctgggattacaggcgtaagccaccatgcccggccattacaactatattctaagattaactagcaatcataagttttttgttttcagtctagattttagaaatgcgaatgacaccaggcccaacactttgggaggccgaggcaggtggatcacgaggtcaggagttcaagaccaacctggccaagatggtgaaaccccctctctactaaaaatacaaaaaaaaaaaaattagccagacatggtggcgggcgcctgtaatctcagctattcgggaggctgatgcagagaattgcttgaacctgggaggtggaggttgcagtgagccgagattgcgccactgcactccagcctgggtaacagagcaagactccatctcaaaaaaaaaaagaaaaaaagaaacgtgagtgacaatttcaacctatttagtatccccaaaagctcaggagctgtgataaattgatacaaataaaaatgtaatacttcatctttttgcaaaatagtgcagtgggctctatgaagacatttctttttattgttgactctggaaagaaaaaatccagttttgtgttatcagtccttagaaaaagatttatgagttaaaatgcagcagaggccaggtgcagtggctcccatctataacgccagcactttgggaggctgagggggataggattgcttgaagccaggagttcgagaccagcctgggcaacataatgagaccctgtatctacagaaaatttttaaaaacaagccagtcatggtggtgtgcgcctgtagtcccaggtacttaggaggctaaggtgaaaggatcacttgagcccaggggttcaagggtacagcgaggcctatgatcacaccgctgcattcctgcctggctgacagtgagaccctgtctctaaaaataattaaaattcaaaatgtggtagagacactagaaggaaaaatgattctgcttctcccagcattctgcctctgcataattgagttagtgcatttcataggtcaagaactatttaaattacacctgcatattttagtcctgcatatttcttcataagagagaaaagcatctaataaatacaatgaaatttcattcatgtctttatttaagggatgaataaaatgtcacagtacctaatcgtatacatcaattatggatccagatttaattctggctgtgcctctttggaaaggcagctgatgagcaagacatcactgatcaaaaactgcattctgttagagcaggagctgacagggaacctagatgccagcatttccatgccctgcctgatgtttaccatttgatcacgttcgaactgaggaatgaggcttatcggattttatgttgctttttttagatgaatgctcttggctttttgttgttgttatggttacttcccattgatttattccactaaccatttagactcccgttcattcacctacggccaaatgggactagaatggaaaaacggaatcctacccgatcaatgcaaattctatttctctctctccaagaggcccagatgaccagccctgacactgggagccactgggagcttcaggtgctggcccagcagtgcctggccatgttttcaagtgtacatcaggtgaccactcacctgttgtacttcagtctgattttccaaggagtatttaaaaccacccaggcagtgatttcaaaccgactttctacttattccacaaggtaccgtcgaaccactgttctacgtgtgaggcctgtggagggtttatacagcaatgagtgttcagtgttaagtcctgccttccttcatagaagagaaatttatcagttcctctgggtgtcagttttagagcaatacaacaacgttttgaaagacaaatccatttttaatgagacggacagattttcaggtaatagtactgctagaaataacatataatgatctactggttctgaatacactgctgaattcctgaatacgctgaagacctccccctcctctttcctggttatgttctgcacctgtttacactatgaagctgaaaaacaaactttgactatagctaactatgattgttctaatttccatagtacttgatcccctcccacacaccaaactatgaatgacagactgctgaatagatggtttcagtcatagaccgtccctgacttatggttccacttagaagttttcaactttaccatggttcaaaagtgatatgcgttcagtagaaaccgtactttgaatacccatacaaccattctgttttccactttcaacactttattataaaataggtgtgttagatgactttactgaactgtagactaatgtaagtgttctgagtatgtttaaggtaggctgggctatgctatgatgttcagtaggttacgtgtatttaatgcatttttgatttacaatattcccaccttacgatgggtgtatggggaggtaaccccattatacgttgaaaagcatctgtatattcattcctacagtcactggtgattactttgtccaaggcattattttgggggaacacaaagagaagtgacatttagtcccagctgtcaagaaaactttaattctaggaaaggcacagttgcgggcctctggcccatccgaagagagcaggaacacacctggtccagttaggtagagccgggagcagaatccaggaggaagccccactcagcgggggtctctggtgttctaaagtgatggatagtgactggtactaagtgtgaggggagagggtggattacacctgaatagtacagaggctctaaggcagaacatccagggacttagagagacgtcaaactcctccacaacaatgttccccaaacaagagtcatttgaggaccaatgtcacgatttttgccatttctgatgacatttttaccatttctagtggcctcctttactgttgtttacttaacattttcctttaaatggactcactatttttacttaaataaatttatgttaaaaagtttatgttaaagagaaattttgcaatactaccatgaaatgaaatgccagtaccgcttgctgtcacgatacggtggtgctaaaaatacgtaatataaaaatataatgaaactcagcactgttgcccaccgaagcatccaggtctgaggtctgacctctctttgttaaaaagggaaaatagcaagtattggcaccataataaagatagtccagccccacactgagccggcctgagactctgagaaattgaaagggaatcggggaaggaataagactggatgttatttagctcccagtctgtgaattacctaaagacccccagtgccaccagtgcgacatacttcaccccagaacagagggaaggaacagaatggtaggcagtgctttggggccagttgtactacagtctctgcagagcaaccatatgctgtgtcagggctggaaccaggtttggccatctgtgttgaccccacagattctatgaagggtgacttccacaatccctagcacactggggagcacacagtacatacttatcaaaagtcttaaattaagtctcactgatgccctaaaatcttctgcctgtttcataaaaagtagaaaatgaagttgacagtgattctttgtatctcataatatcacatcgccctccccaaaaaggaacattgatagaaaactataagatataaaacctaacaaaaatcatctggtgaatagatcccatggaatacacaagaagaagatataggtgcatttaaataatctcaaaggaaaagaagaaatctcctttgagaagtcacatctaaatgcttatccaggctgggcacagtggctcatgcctataatcccagcactctgggaggccgaggtgggtggatcgcttgagcctagttgtttgggaccaacctgggtaacataacaaaaccccgcctctacaaaaaaatactaaaaaaaaaaattagtcgggcatggtagcacacgagtgtggttccagctactcaaagaggctgaggtgggaggattgcttgagcccgggaggttgaggctgcagtgagctgagattgtgccttgcactccagcctggatgacagagtaagaccctgtctcataaataataaataaataaatccctgtccaaataaataaatgcttatccaatcgctgaaaaggagctcaagcatgtacacgaggccccaagcacagctctgtcctccgtggagctggctttattctcccagtgtttcctgctcaggtgcccttttctctttcatttctcacaacactcccgcctctcacttggcattcagtaactgaacaaggagcgggaaagcatgctaatgcatcgcaaatggagttgctgcatttccttaaaaggactgtcatgagcatttcattttaacgtattacccggaattgtgtcagtgttttaagtgaactattttctgtaatccatatcgttatgaatataagacattaacgtactgattgccacttgagaatctcattttaaagtgattgtactgcatttctaaaatttgcatttttaaagcaagtttcccccacaaataacaccttacccaagacacctccaggcagaacgttgtttcttacagtaaatgatattttaatatttggtttcagtagagaccagtctaatcaattatagagtaacatactttacttgtaataaattcaaaaaagtgatagctatactgtcatttgtagatgttcttaagaaatatggaatcttattccagacaggcatttctataactttgtggtgctatcaatgatgctaatgaagatttgacatcagttcaccacatttttgaaaatcaaattgttggctcagccgctaatgaaacacaatctcaaagcagttttaacaaccatttacattttttctgaaaacctcactctaccgtttctatggggtccctgactagaaatatcaaaagtctacatgaatataaaacaatatagtctatttttcaaagagaaattgagactgatgcaaaatatttgacttcttttttttttatatgaaacataaatgtttattcattggcaaagccttaacttctctaagcctcgtttccctcatctgtcacttggcgggtaatcctatttagctcagagggttaccaggagacttaatgggatactgcataataagtactaagcacagtgccccccatcatgtactgcccttggtctgtgctctaatattgaagcaggatgcttccctgaccgctttgtgggacttgcaacaggggtgccctcaattacccagcccacagctttcaactcctcatgggaggaagcacgcatgtgaatgaggcaggaactggagtgcatgaatgctgaaaccagccagccacttaggtactgccaggagcaaacgccactcacttggacccactgtgctccaccccttgcaggggtaagcacgcgggtgagtgggtgcaggagccagggtgagcgcttttgagcgccaacaggagtgaactctgtgcaggctccgtggcagcatctaggggtggtgcctgcaacccctgaagccccagagggcatgttacagtgcttttagttctgctgtccccagacagcctaagtatcaacagctcagtggcttttcacgtaagctggctgccttctgccagtgagtacaaagggcaagtgtgacagccttttgtagccacactagcagcatccgagctcttgtcccacatccaggagaaatgacatcacacaaattgaaggatgacaaatgtaggggatttttattgccgatgaaagtggctctcagcaggaagggaagttgaaaaggggatggagagggaaggtaatcttctcctgaagtccagccatctctggccagattcttctctgatgttacgtgtcaagctgtccctctgaagtgaagctgcttctctccaatgtctaaccatagtcaccaacgtccagctgcttctcttctctctgccagctgagtatggggtttttataggcacaggatgtcagggggcaggcccatgggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggcccccccccaggggaattggtcccagccaagggtctctaggaaagaggcacatcaactagatgtggaacacactccggttttggaagtactggttctgttctccagggcatcagaatcctcctttttgtgaccctgctgccttacaggaaagaaacaacagttgaaacactgggaattttccccaatagggagaaggcacagaaaggagaaagctaaagaagagagtgaaagaggcccaaagagaatggaaaagtgagagcaggccatttgccagggctcattcctgccatccagccccagcttctggctgctcagtggacgcttctgccaatgctcacagccccacaggcctgggcccgggagcctctgctgccacccgtggtttctctccctgttccaccatcggaaccccgtgccccaggctctctcccttgaggccacctcagaaggagataccaaggggaagacagctctttaagaagtgtagactccatgttaaattgagaccccgcagacagatacggctttgaaacaattgattttctgtggtgtcatagggaaacctgccctcctcaaagttgcgaaaactgtcagggaccctatgaaatggagcgggagtcacaagttttctacccagctctaaaagaggagacaaaactaacactggttcacaatagataacagaacggcttcagcaaagggcaagcaagcgtagagagatgctggagaagaacaaggcactttatccatgtcccccacagcaccctgcctcagcgccggggcaaaagaatctttgtgtgagcccagggagtcggcagggacatgaggggttgatgcggcacttgctcagagcaatcgcagtgctgccgctggaattatctttctcacacagttcccagtagtggttaaaaggctctgaggtcagtccgcctggcccactagctaagggctcttaagcatttaaggactctttcaacatttgtttctgttagtttctaaaacttggaacagagggccattgatttaactggtataacaacgtgtgggtacattgcacttgttaccttggaaatgcctctactcagtctcacctctgagctgagttagtttgggaagatgttgagcctacaggtagtggggagatggtgagattcaccaaggcatgtgttgtttgtgattgattgggttgggaaagtttcctgactgccaaaacctccatcagacactagccggggattctgtaaatctcagaattccaaggggattggattttgaagaaaggagatgttcacgtacaggctactagaattcttgttctttttttttttttttttttaaagaattctgaagaagaaaataagtaagagatctaaaacagaaccatattttgccaggagggcagagcagggctgctttgttcaatttgttaagagggtcagggaagcatcagaaaagataaggagaaaaatcaatcagaaccaagtcactgttgtgagtttcggcagcgtctgaagtagccagaaggtactgagaaatgtattttatcacatatagtcttattttcaccctaccgtattttctgttaacacaaggttcctttaaagtcaagtatgcagccctaaatcttatcgacccattaatatttcatccaaaacaatgtaacatcttaaactgaaacctaaatgtaagctttggacacaagcattcaaagacaggtatgttgtacagctggactatggtgagtcaagtaacattttcatttctttttttcttttagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcaggtaaagtcttcagcaacctcaggcaggttgcttcatttctttaaacctcagtctcttgggactatggaatggatttaataacagaacctcactggtaatgtcattggaggattaagaaagggcaaaggaacgttgtgagtacggagttctcagggcagcacttagcacatctgaaatactcagggccagaaataaataagttgaaggtaaagaatgtaggaagtattaactcttcaattaggttaaatgatgacttgcctaaactgatgtctgcgccatgactgtgggtgatttgatcaattcactgtctcacttttgcctcttatgactcttaatgacttgctgtaacataatctgtgttttaatttaagaagagatttacctaaagcaatatagagatccgtctcctggctctgtatttatatgaataatactggtggcttccagatctttaagaggtgcctttaagcttgcaaaactctgtggatttagtcccacttctttgagtgggaagacatgtaatttgaaagcacagggctcaaatgaaaggatgtagctgttggctgaaaaattaattggatgaaaagagtatacacataaccctgggtgggagacagcctattaagctgtatctcaggagacttaggtcgtactcctagctccacctaaattggccttgggcaactcaagtgacctgcccaagcctctgctttttcacccataaggtgaagaaggggaggggagtgtaacctctaagtgacctccgaatccaacattcagtgggtctccaggcaacatgtgatgttgctgaagctaaaaagaggaagaagatgaggcaggaagcaacagctaggaggcctggattccagcaccatcactgcctctcaccagcagattaaccttaggcagttttcataacctcattcctcagtttccccacttcctaaatggagataagacctaacccttggaattctatttaaagtgatgtgtttaaatctgacgtgttttatcacaagcgttaaagtttagctacaataatattaataatctaatattattatattagacacaatttgctataatgcttgaaccttgagtaaagacttccaaatcctctccccctgcaaacttgtaatttgtaacagttcattctctaaacctcgtgcatttgattgctttaatcatgttccggccctgcacatggagtgtgtggcttcagtgcagccattgtcattgtgattccttgccagggctgtgctgcaaagctttgtgaagcttagagagaagccaaaattgccctgttgtcagaataacccatttacagacgaaacaatcctctttgttcctcacacatggattcctagaacttgacgcggggcgctgtgagctaagggcacgtatgaagaattcccttttatgaatgttgttaagattacacagtgggctggcttgaacaaaggaaagcattcctaatgctgaaagaagaaaagtaagagtgaaaatacaagaggagaaaagacatgtcagggccacagaggaacagagatctctcagataaattcctccaaatgcccgagtagacaaataccgtgaatgatctttgcaaggcaggagtccttccgctgtcaaagggacccactgcctgaggctgtgagcacctgtggtctgagtcagggccaatagactagtttctaaaacatctagatcctaccttgggccaatatgagttttatgtattattacttaattaggaacttgtttgttaagatctgtgagatatgactgtagggaccaaagagtttttgttcctttactttaaaaaaatcatgctttgagtgtgacaggttttttttttttttttttttttttggagacagacagagtctcactcagttgcccatgctggagtacaatggcaccattgcaacctctgcctcctgggtttaagcgattctcctgcctcagcctcctgagtagctgggattacaggcacccgccatcatgcccacttaatttttgtagagacaggatttcaccatgttggccaaactggtcttggactcctaacctcaggtgatccacccgcctaggcctcccaaagtgctaggattacagagtgctaggattacaggattcttttgattgatttatgaaaatgtatatagggaacatatctgtatttgatgttcaaatccaaattctgtaattctgatattatggtaggcctgtgctatgtaacatgagatccatttgcagaaaaatttccacttacacttggagagttcttacccagtgtccagcagatgaagtattaatgcaattgtcattataccaattacaaggacagaaaacagttgaccgggctcggtggctcacatctgtaatcccagcattttgggaggctgaggtgggtggatcatgaggtcaggagttcgagaccagcctgaccaacacggtgaaagcccgtctctactaaaaatacaaaaattagctgggcgtggtggcgcacgcctgtaatcccagctcctcaggaggctgaggcaggagaatcgcttgaacttgggaggcagaggttgcactgagctgagatggtgccactgcaagactctgtctcaaaacaaaacaaaaaaacaacagaaaacagtttacaaactataaggcagaggtttattgaaataatatgattttcctcttttaggtgaataggaacatgagagacaatgtgggttgaggggctggaaggggcagaggacagacgtagaaatgagggaaggttacttaacagcagcctctggttgctcagtgtcagggaggaaaaacttttcctctgtcctcttaagttcagtacctgggggcctgcaaattaagctgataaaagacagattaacaggtgggcagggggaccttatttatatgcatataggagcttgaaaaagaagaaactcagtaagtagttaaagctagaaacttatatgcccagcttagtagggaaaagaggcagtgggggaaaaggcctctataggaggaacagatggatttctagaagaacaaatgagagataaagagtttgtgatagtgcttgttcatgcaggcctgagtgatctctgtatctcattcatggccataaaacttccctggagagaggacttacggtaggtttcttgatcatcttcctgggagtaaaagccacccgtaagagggaggtatggcagcctcatttttccagaagtctctgctttttgtcagataaaggaagcaccaagaaggcttctttctgcacctattgaatccccagtggcttcagtttaaaatgagttccataccaactcgggttctaagtgcatccctcacatcagcaattgcactctggtttcgtgagcctaaggtcatcattctgaatttggactttacggttttgcacttttctggtaatatttcatgtttgactagaataagattccttgctatcagatatttaaaaacaaaacagtatatacacaaaaatgcctttctacctgtaaataacgtgaggtacttgagtctgtgtagggttaggatggaaagaaaataacatgagagctcgtgagtcctggcttgactagaggacatttggaagtagattatctcatctggtgccttggaagtttattcctcaacaagcagcaatgggtctcctggaagcttttttagaaatgcagaatctcaggcccctccccatactgactaaatcagcattcgtgttttttagcatggttcccaggtgacttaccactgcaatttaaaagctctaatcttgtatagtgcttctcaatctgggaagcactttaaaactacctggggagctttttaaaacccaaaactacctggggagctttttaaaaccctgatgtcaagactatacttctgtcagaggtgtctgaaccagagcaactccatctcgaataggggctgggtaaaataaagctgagacctactgaaaactggttgcagtaaagaagccagctaaaaccatcaaaaccaagatggcaatgagattgacttctggtcatcctcactgctacactcccatcagcaccatgacagcttataaatgccatagcaatgtcaggaagttaccctatagggcctaaaaaaaggggaggcatgaatgatccaccccttgtttagcatataatcaagaaataaccataaaaatgggcaaccagcagcccttggggctgctctgtctgtggtgtagctattcttttattcctttttgttttattattatactttaagttttagggtacatgtgcacattgtgcaggttagttacatatgtatacatgtgccatgctggtacgctgcacccactaactcatcatctagcattaggtatatctcccagtgctatccctcccccctccccccaccccacaatagtccccagagtgtgatgttccccttcctgtgtccatgtgttctcattgttcaattcccacctatgagtgagaacatgcggtgtttggttttttgtccttgcgatagtttactgagaatgatgatttccaatttcatccatgtccctagaaaggacatgaactcatcattttttatggctgcacagtagtccatggtgtatatgtgccacattttcttaatccagtctatcattgttggacatttgggttggttccaagtctttgcaattgtgaatagtggaggaggagaggtgctctgctttttagagtttccagtttttctgctctgttttttccctatctttgtggttttatctacttttggtctttgatgatggtgatgtacagatgggtttttggtgtggttgtcctttctgtttgttagttttccttctaacagacaggaccctcagctgcaggtctgttggagtttgctagaggtccactccagaccctgtttgcctgggtatctgcagcggtgtttgcagaacagcggtttttcgtgaactgcgaatgctgccatctgatcgttcctctggaagttttgtctcagaggagtacccggccatgtgaagtgtcagtctgcccctactggggggtgcctcccagttaggctgctcaggggtcaggggtcagagacccacttgaggaggcagtctgcccattctcagatctccagctgcgtgctgggagaaccactgctcttttcaaagctcagatggaaatgcagaaatcacccatcttctgcgtcgctcatgctgggagctgtagactggagctgttcctattcagccatcttggctcctcctattcttttattcctttactttcccaattgatacagtttgactatgtccccacccaaatctcatcttgaattcccatgtgttgtgggagggacctggtgggaggtaattgaatcatgggggcaggtctttccatgctgttgtcgtgacagtgaataagtctcacaagatctgatggttttataaaggggagtttccctgcacaagctctctctttgcctgctgccatccatgtaagacatgacttgctcctccttgccttccaccatgattgtgaggcctcgccagccgtgtggaactgggagtccattaaacctctttcctgtataaattacccagtctcaggtatgtgtttattagcagcatgaaaacaaactaatacactaataaacttgctttcactttactctatggatgcaccctaaattcttggatcttgcgtgagatccaagaaccctctcttggggtttggatcaggaaccctttctagtaacacttccatgcaccatttctatagtttcttaccagagaagtttctctgaacatgtggagcaccggaaaccacgaggaggcggctcagcattcactcctgagcatgaagctggctcttggtggtgcttctctgcaattgccttttgctgctgatgatcactcttctcttcctttgggagagtgaaagggaaaggaagccatctgaagggtcttcatggttattttttaaaaagaaaaatcccaatatctagtactaaacccctgacggaccaaatcagaccctcggggggataggagggacacaggtgtgtgtgatgtaaacccccctccccaggagtgtccagtgtgtgaccaaggtcaagaatcactcaccaaatgaaagaagggtccctttggtaagtgcatcaaaataaggttaccaaaagaaaaaactgaatacccaaatactgcccaaaacatggtttatgaaaaacaataaagccgttaggtggttaaatcacaaatagtaaaggctgtaccatcaagcttgcaaagagaccaggctctccggccattttataaggaagctcactcagaggagatgtttttacctaaacttgaggagaactgatctgcctgtttgcaactggaaagcagacttgaaacaaacaaatgaacaataaatttgcagtgtggggcaggactcggtggctccagtgaaagcacctcattatgaggaagatgtgaaattattactgtgttttgaattggctgctaacctactctgaaagatagaaaaagatgctgctttaaaatgagggctgtgcttttctgaaaatacagcaggtgccttgctgtgaagagtaaggaatcatatggccttatggttaaagggatcttggcaaaccagggctactcaatccatacctataccaggatgtttgcatacctataccaggatgtttgttttgcaggaacttggtgttagaatggaaattagaattgaagacatctacccataggtctggtgatctttctgctcccatacctgtctttctactgtctgagatcatagtaaatgataaaaacagaaaataggttctaaggtatgctggctttagtaataagattctttttctcatctgtaacactactgttacacttctataacaaacactatttgttacctctccaatgtcctttgggctctatcagtgttttctaaaatgagggacatttatgttggtcaggttgtgcactgcacaactataacagatgtcatttgtagtgcagtctctggcttctggagcagtgcagcatgtagcctagatagggggtcgccattatgggaagcaaatagacatggcctcgtgtaacatacaaagcaagtcatttcctgttcatttgtctttcagtccttctgattttataaagagaaagtctctatttggttctggcacgcttttaacacctctcccatgattgtattttaccttataataaagagagaacaggcttctggttagtgcctcacaggcaatagaattactcagtagggatgtaaagttttatcaatagatttatataaataagaaatttaaccaattttgtgaaaataagtaaataaataatacttggattttacagtatatgtcaagaaaaatatgaaggtgattttcacatgattggagtttgggaaacactgggcagtagagaaagatcaccccaagcgctagggcctagcatggggctttaagaacacatttttatagggggatgaggtaaacaaaagacttacacattatgatttaagttgacttgatttaaaacaattctgctctattggaaacatccaatctttttttcttctagttatttccctctttgataataagtacagcctgtttctaaaccattatatggtccttaggaatatttttagaacagtagttacaaggtagaaaaagtaacccccagccctgagttaaggtttattttaaggtcacagaatgccaggcaattgccgtgatttacctctcagaattatggactctgttgtgtttcttcctttttgtctaatttagggaatcttatttgcttggaatgaaaaggatttgccagcaggaagacagccacagatggcagtgcacattctgtaaaatacaaaaacaaaacaaacaccagaaaaaataaatccaagagtctgatcccataaatttctgcactaaggagcaactccaaactgcacaccaagctgctttaaaaggcgtttgtgttaagccttagagtgttttatcacattcgtgatatttgatacagaatacgtcagaccaaaagccacatcctaggatcttctttaaaatatcattaaaatagatgaagcattttaagatgtaaagtttcatttcctaagggatcctctagttgtaaagattgcagctagttgttgttgttattattatttgagatggagtctcgctctgtcactaggctggagtgtagaggcgtgatctcggctcactgcaacctccacctccggggtacaagcaattctactgcctcggcctcctgagtagctgggactacaggcacgcaccaccacacccagctaatttttgtgtttttagtagagacggggtttcaccatgttggccaggatggtctcgatctcttgacctcgtgatccgcccgcctcagcctcccaaagtgctgggattacaggcatgagccactgcgcctggccacagctagttattttaaaggacttctagtaggtccaggctagattctcagcaaagtttgcatggtatgtgatgtgtggtgcatctcaccccagaaaggacctgggagtccttctgtaaattgctagcaggtgaattcacagcatccactgtaaccttaagttatctggttctctgccctaacgctaacctgcatctgacactgggaggtccttgaccaggaattctcacagctcctccaacagggaagtgggtaggagatggaaaattcagaagcaggagtggagggaagggagttaacacccaattctccacctcccccagaaccaaggccaggattgtcaagaatccagggttgagaatcccctgccaagctggtccagtggattcactcaggttggcagagtggctgaaaaccagccctcttaggcacgtgggtcttctcccagatatattaggaactagatggaacttggcacttgggatcactcagtgtaacaaccccatacccccattagacttgagtatacccagcactgagctaggaactcactcaggcttcccgtcaccacatcggacactttaccactggccacagattggtttctgaagacctcttacctccatcgttatgacttctaagttgatttctgtctatattccaagtttcctttctatcatctggccataaaatatttttatatcttcatgtgcaaagagttatggatataaagaactttttaaaattacatatatcatctattctgttttctacctaactacaagctgatcattggttttctttaccacctgcaagcacttaaaagtaatcattcctgctcttataattacatctgaattatttctgaacagatcccttttctctccttatgctaagactgcatgattaatgcatttttatctctcacactcagtctttttattatgttatttgtctttttccctcttcagtcaccaacacagttcacacttaatcgtgtgaagaaaaactatcatcccttgcttgctaatgtgcattttcctgcaaagatccaaattccacttttcctgcaaaaacaccaagcgcatttatgtatctcaaatcaactatggtattagtcttacctatttttgcctggtcattttagttgtatcccaccttttgtttctacagtgttttcatagaaaatcagtttctacagtgttttcatagaaaatcacattgtatccatgattttgttgagtcaaaggatatgtgtgtttttaattttgatactactacaaaccatcctctaatgatataatccgattgacagtccagcaatctatgaataccttttccccacatcctcaccaaaacagtgcatcatattattcttttaaatgtggctgttctatatgaaaaataaaattttcttgttatagtttgtatttcattaattatgagttgggttaagtatctttgcatatgtttatatatcatttatatttatttttccataaactccctctttatattctttgctccaataattatttatatctttatattctttcctattgatttataagtattcttaatatattaagtaaattagtatttttaatgttttccttgtttcatctcaatttttttgaatttatgggatttttttttccatgtaaaagttactaaattttacatggtgaaatgtaaagtgttttatggcttttgggttttgtgacataccttctccatttagaacttattttttaaattattccatgttttttataataattttgtgttttatttgtaagttctacgtattttcttccctggaaatttatttgggtggaaggtggaaggtaaaaatctcactttattttttcccaaatggcccactgttccagccccattggttgaggctccatcctctccacctttaccatcttctaaattcccttcatttctgagtccctactggactctctggtctattacattgatatgatgccttgtgacatgggagcaaactgcagtacttatcattgagcttttattatcacatttagtggctcatagagctaatttccctttttttctgagttttttttcccagaattttcctgttcatccttgcacatttgcttttcccatgtggatttgagaattttaatcattttattggaattgtttaaaatttttactgggattaaggtttatgtataagttcattacctggtgatgcccagttacaccatgcgtgtcttctccatctctctccaagttgcgaaatgattcagataagtgtcatccagattttaatgtgcttagaatcacctgggggaaattagcaaatgcagattcagctggtcaaacatgggattagagattctgcatttccaacaagctcccaggtgctgctgatgcagcgggtccctggaacacactgggagtggcaaggagataagcagccttgaggcactgcctctggtagatttcataggtttcccctggaaaaccacttgagcccactgcttcttgtgggagcagatctttgacaactctctcaagttattttatgataatctgtctaattagattttctttctcatctaggataatacccgttattttatctttttctagaaattcgtgcatttaacctaggttttcaaactcattactgtggagttgaacagaaacttgttaataatttaatttccattccctttttcgtgttttttatattgaatgtttctgttgaccccccccccttattgattagattatgtggctttttttttttcttttctcaaagaaccagctcttagatttatttgtcaattctttgttttctttctactgtcgtgtcttctttaaatttatatttgctggcctctaactttctaatttgaatgtttggctctctctcttattttccttcttggtggggtgtgtgtatcatggtcttataagaatgtgaaccgaagtcaacaaatcttaaactccagccatgctctcttctgaccacacctctgctgccccagccccgcctccaggactgcaccctccagatgtaattgacaccaatggcttgcactagactttttgctaagggacctgaaaagaacttagaggctggcgtaagttgccaaagccttcccacatcactgagagaatagacttggcaggcttgtgttttgaaaagcagttgggggtgcgctctgtcaaggctcagccatgatgaagaaataatcaaagagcaaaacgtcacttaagtggctaaacatgactggcagcagggttggattccccttcagcatcgaacacctcacaggccatcctctgtgtagacgggctgctttctagtggctccacaggcctggccgtgtcaggggctgcctttattcaaagacttctgttctgtcttaaccaggatcacttaactctctgaaactccagtgataaaaaagcaaaaccggcacaaacatacagctttggaactatctccaaggtcattgttttttcccctgccgcgaatttctttcattcctaattttcctctacctttctttcccttcatcccctacgatagattttgaaccccagggaggttaggactctgtcccgttcttctccctgggctgtccaccctccgacccccaccccacctggcatggcactcaaaggtgcattttcctggggtctgtgcatggaaatcattgcagctgtcagcctgtgtcacgtggggctggctaagtgcggggcaacgcggttgtacatgttgccatggtgacttctctgttgatggcagaaccactgactccagcaagtcacagtattcatttttgcgtcatgctcgtgctacaggaatgctatgagtagcccatgaaaagggaggcgagttgagctcagtgttatcccttgacttgtgtgtctttccttacccccagcgatcccccattcagatgcttcctactgtaccgcatttttgagtattcttcagtatcatgcttctgttacagcaccatatcactcagctatggaagcactcagaggagcacaacaccctctaaattatccgccatcacttcttttacggcctcatttaaaaagacaattgtcagaattcccaggtgtgaattctcacaggggaatctctgtcagtcaccacctggaaatgttagttccacctctgctggccaatcagcacctcatgtccttgctatgatctctacagttgcagaagcattatcctgatgaggtttttaacacatcaccacatgcttttcagagaaaagtccttttataaataccaataactaaacatgataaattgcttcactcctttgagatctttgtctgattccacgtgctctgcatagactattcagaaattctaaagacggatgcagattcctaattctgctgttgagtttgttcctgagagcaacgctgaaagacttttaaaaaattaaaatcagctttatgttgaaatgtaattgtacataaatagccatatgaatgtggggtacagttattttaaacatagaaaataagatgaattgttttggaaattcccctttaaacatgctaaaatgattttcaatcattgacgggaattttaacttttagaaaactggaaaggatacagacaaaagtagtgataacttaaatttgtaaactattttatttgttgaaatgctttaatgcatgattttgttttatcctggaatggccacatgtggtaggcaaagtggacattatcagccacattttaaagataaggaaaatgcagctcagagaaaataaatgtattcattccctcagcaaacactgactgggtggccacagaagtgcggtgcacaaccctggctgcacatcagtcacctggggagcttttcacaaatcccaatgcctgttccccatcccagaggattcctggtgtgcatcaggattgtgaagcaatggggactgagtttatagcaccttactctaaagtatgcagagactagcattatgaagtggaaaatgcatatatttcagattcagttatttttttcccactattccttcctctcaatgaaaattttggagtaaaacatataattccagttctttattctgaactgtcttactattttctatcaccctttaaatataatgcagaagtctggaaggatatgtaatttgcatacctgttggtgaaatccctgctactaaatacactttgctttttcttgttccacattccccttttcgacagggaataaatcatccccaaggctgctagagccaattaaatattttttcacactccgttgacatgaatgagaagaactgtgacagagccacacggctcatgccaggactttatcacgctatctttataatgatgtgagccaggcaccagggaggaatggtgtggggaaccatcaggaagctttaataaccaaggataatttgtttcatcagtttctccttgatggccatttgccatttcacctgtcaggaagcaaaactagttgtcttgtgagatctcaggttaactcaagaagagaacagctcagacaacaatggaagcatatttagcatggagcttttatactcagttctctgaagtcagccttcttggaagaaaatacattgtcttgggattggaattataaatttcccttgtgctaatgcaaccgaaaagagtatttcaaaaccaagagccgaactgggcattcataaaagacttaaaatatgtgtagaattaatttttaaaagcactttaggtttgcccatgccccccttctaaccgcacagtggagacagaatctggtcagctgtctgtggtctgggtgactccaccatgttctcagcaacgctcctcatctatgtattatactagtttctgaaaacttaagaataaaaaggatcaacctcacattttgatgaaatagcagttacaacacaaacatcccatgcctattggcagaactggtccacagagcacagaagcacattcatcgtgtaaagctgaaaacagcgtcttctgcaagttgagataccgaggttccagcagaagataaaaagcatttaaaaatatttaattattcactgaactcctttgaaagacacaggatgacaaagcagatcaataatattcagccatttccaaagggtccatccacagccaaagtatggcctttgaatttactagaaatttccacagagggagagtaaaaggaatcccttcatccttgcttgagtcctaaaataacatgcgcctaagtattctcacaaatgatgaagcgcatctcttgagtagacttaaggtgataaaatgttattttcactgagctcccaagccatacatcatggaagtccaaagcccttactgataattgcataatgcccaggggatgtgtttctctgcagaagtctgaagacaatagatccagggtctcctgaagactttcatcttatgaattgtgcgaatccctgaccactgcctaagaggaaaggtgaaatacatcagagaatgtccttaaaaatatccctttttgacttactataattggttgctttcctcttttaactatcataattttctcagccaccctctccctagaaactggggctatttctatgactcagcaaacaaccaattcttgctaatactgctttgctaataaggaaaccacaagttctcttagctgagactcctgtatagcaggtgtgttcacaaaacttggtgagcacccatatctgagacacagcattccataaagccagaggcagtcaccgaggctgtctgacataccataatatgcccgtatggcttcaggctttccaccctgatctggctgtatcccgcattgcacccatgcagcagcagaaccagcagtaagaatgttttgtcaaaaaacaaatccataaacttcaaaaaaatccacggtacagtatttttaaaaatacgtctagccaggcgcagtggcacgtgcctatagtcccagctacatgagtccaggagttcaagatcagcctgagcaacatagcaagaccctgtctctaaaaagaaaattttaaaatgcatctgttctctctcatatatgcctttaaacgcatccatagcatcaagaacctaaatgccaacatcccaatatttttcctccctgataaacttgctttagagattcaacttgtatttttgctttgaaccaggaaaggtatccaaggtcatactaagataaccatttattaaactctttggctgttttttcctaaactgtaataaactccccctctccaacattcaaaataatagtaaataattctctctgaaattaacacagtgttcctattattgctttcacaacactaaaaagaaatagaactaacggagtcgaactgtggggcattctggcaggcaaatcattaaattcacacaaatgattcggccaagggaaaaaggacaaggttctcagaaggaattatttcagctccctctcagacactgctttaaattaaaacacacacacacacgagcagctgaagacctgagtcaccaatggtctacattaaatttctgcaactgaaagtcaggcaggtattcaagcactctgggagcctgttagaaatacagatgcccaggtcccccacccgagaccaactcaggcagaagcagcatttttaccaaagctcagggcatccgtatgccccttaatgtttgaaaggtctgaatcagagtgctctcccccaaaggcatctcagactgagatagaaattgaagaaaaagcctaaggaggttcagcaactttttcaaggccgaagaacccaccagttacacaagtgcagagccctttgtccctgacattcagagccctgcatgcataggaagtgacagccccttccggggcaccctgctgccgccacgcgcattctggaaactgtgcagcaggagaaacagcgttttccttcagaccggggtttaaatggcacttcccgaatttatattcccctagatttggggcttcttccttcttgcactcctgttaacatcagcatgaattcataaactccctgcagcggaaaggaaaagaagccgcgacaaacctcaacgaagagccgtacggcactgttaaccaagtgctccagtcctgccccagtgtttacaggaaattggttccaggacccccaaagacacccaaatccacagatcctcaagtttctgatagcaaatagtgtggtaaatacctacatataacctacacacaccctcccatatactttaaattgtctcttgtagattacttgtaatacctaatacaacataaatgctatgtaaagagttgttggccaggcacagtggctcacgcctgtaatccaagcactttgggaggctgaggcaagcagatcacgaggtcaggagttcgagaccagcctaaccaacatggtgaaacccaatctctactaaaaatacaaaaattagccgggcatggtggcgcatgcctgtaatttcagctactcaggaggctgaggcaggagaatcacttgaacccaggaagcagaggttgcagtgagctgagattgtgccactacactccagcctgggcgacagagtgagactccgcctcaaaaaaaaaaaaaagatttgttatgctggattgtttagggaacaatgacaagaaaaaaatatctgtacgtgttcagtacagctgaaactttttttcccgaatatttttgatctgagtttggttgaatccacagttggggaacccgtggatgtggagggccagctggatagctgctcctggcagtgaggctctctgatccagactttcaaggttcaccctgagaactacagtaagatacatgagagagtcctgaatgaggagtcgaaagacctcgtcctcgtagcagcgactctggcacccaccaaccatgtggctttcacctaattatcatccattctgcatttttgcctccttaactgtagagaggttgtggaactacagaatctataaaggccagctgtcacaatcaatactttacaagtgcccacaatattttacaataactttgaccattgatttataaacaattataaccaaacattaggactggaacaatttgcccacctgagaaataacaagacatttatctcacatgaaaatggacaccaaataccttaccttcgtgtttattttatgaaatacaaaatctgagcatatattaataatgagctatttttttcttttttcttttttttttgagatggagtcttgctcttttgcccaggctggagtgcagtggcacaatctcggctcactgcaatctccgcttcccgggttcatgctattctcctgcctcagcctcccgagtagctaggactacaggcacccaccaccacacccagctacttttttgtatttttagtagagacggggtttcaccgtgttaaccaggatggtctcgatctcccgacctcatgatctgtctgcctcagcctcccaaagtgctaggattacaggcgtgagccactgtgcccggcctaatgagctattttcaattaaaatacctctttatcgttaatcagacaaaagagtacaatgtcagcctactctgagagcattaagaaatctttttcctgaaaggcaattgagacaattcagaagttaactaagtaactgatggaaagagggagtacaatggaatcaattgcccactcagtcctttcatataaaagttggtttaaacaatcataacatatagccgatgacgacaaatttgtttattctgtttctcttcactcgacctcttttggtcactggatcttggacaatcatgaaagcagctgccactttctcattcctttaagaagctggaaatgtaaagcttgtttaacttttcaagtcaggagccaaaaagtcacaatcaccttcccctgtttgaaattggaaatgctggctggctactttttttttagaaactaggaagtgaagggtagagagagaaatgtgaaactcaggatcatgtcagtacatgccacataatgctctgcctacggaaaaacctgctgacttagagaaatcgctccctcccaaaaatgtgattagcagggatcctctcttaaaataaaacaatgtcccttatatcttcagcatcttagtcgataaccatttgttttcatatctgtttcagaaatatcaatagtgaatggctaaaaacattatttaagaaaaacaatcattttctgctatataactcagatttgaaaacagaataaaatgtaataaaacaaagaagctaagaacaaaggcagagatacctcatctcgcccggacccactgtaaaaataatgttgcaatttaaattaaattataattaatagcagcagttttgttgaagtgtctcaaattattactttagatgctgaaactccagtggtttccatggagatattttctctaggagatgtcagatatgatctaatttttttgtctctgatatatgacaacctgaagcttccagagcctttcattttggggggttttatgttagatatttcaatttatttttatatgcacttcaatatgttttgtttgcaattggtttctgagcctaaatattttgaaacttagtaaataagaaccacaaccaccaaatttatcttctgtagttaaaaaaaaaaaaaaactttactctctccttattcactaggacagacaaacatacttctccttgggtgaggagcatagtagtgcatatgtgtgtgggcgctaaagccttagccaggatgtttactaagtacgttcctgggagaagactctcccatcatcaattcctccagcaatatgtcctgcctggcctgtgcttggtggaggaggggaggagagctaatctctgagtggtgcaatggaaacatggtctacaaatataggaacacggatgactacacacaagggcacgtgcaagggaaatatgcagaaatatgtgggcttttataagactctaaatcagactggaatggcaccatgctttggtggttaacatggagtgtcatttggggatccgcaagagaagtatgttgaatagagtctgtgcttatttgatgaaagactggtcttgagaatgttatagctagtctgttttaaattaacacgccaaatttggacctactcactgtttcccaaagtataggttccttgatactccaacaccactaaaattgttcagctctcccagcaagctgggtgaggggaacgtggatgttagcagtagaataggtgagctttattatccatgtctcagtcatgtttcttggtctccgtttttctctgtgcgcatttccaagaggatgtttgttcccaggggaaaggtcagtggcaataaaatgtatctatcaaaatagcaattgtgttgatcgccagaataaaatggctttgcctcaagggggtaagcactcacatgcattaggacaaccaggcttacagcataaataaatccaggaaaataggagtgctcacactaaacaaacaaaagattttgcccttgaaatgtataaggattcctgacctgaggattttctacaagttattttctaacaataaccaaagtccagcggactaggagtcactaatatattttctatattcaatatgtccatctcctttgttaggaagaataagaaacctgcctcactgtaaggatttagttgagactaggcatctgactttcaaaattctacctgcatagaaggttttgttatcagaagaagctaccgatgtttacatacctcttaatcaactgattttaattatgccagccaatgaacatccatttagcccttgctactgcattgttagtcactggaactgcaaacatgattaagattggtctctgacttgaagaggatgactgtcatgtaagaagtcacaagaattaagattattcccattgagaaaagggacacacagtctgaggtcgctgaggatactttcaggaaagtggtaagatctgatggacaaagaaaaggatagtaaaccagatgtccagacagagtgccatatggcagagaaaaggtgtgtcaactggaggcatcaggaactcctatgagacgggagagttccctagaccccttcactggacttgcaacagggtacagctcactcaaaccttttgcgggacggcgagcacacaggcaagtgggtgccaccgctggggtgaacgcttttggtctccagccccacagcagcatctaggggtatgttacaattaatgctgttttaacagttactgtctggggatggctaagtgttaaccagctcattggagacagggtgacagacttttaccccctgccctcttggtacccaggtccttgtctggcatccaggaagaatcaggtcacacagttttattgagtgatggaggtggctctcagtgggatggggagctggaaagggatgaaatgggaagataattctcttcagtcatcctcagcgaaactgctttccaactgtccagttacctcttcaacattcagatgctgcttctcctcttgatgttcagccgcttgttctcttctctcctctgccacactgctctgctcctctgccagtggagcttggggtttttatggttacaggactggggggcatggcaggccaggctggttttggaaaaagcagcatttgggtgggaaaacagggctgtgaatttctcatttagggctgtgggctcaggtttgtgtgtggaacccttgccagggactccaccctcttctacccagtatttccctgcctcctgtccatatcacctatacctagaatgttgagttggaaaagtgaccccaggaaggaaggggcaggagagaaatccagctcaagggagtctttcttccctatgccaaggagttcagatttacacccaaaacaatcgtggaatatttttaaatgttcctccctagctcttgtcattctccttgcgtcatctcaggtaactccttccactatctccgtatgttctgctactgtttttatccgtaacctcaagggaaccagattaccattgtaattttttttttttttttttttttttttgagacggagtctcgctctgtcgccagggtggagtgcagtggtgcaatctcggctcgctacaacctccgcctcccaggttcaagcggttcaagcaattctcctgcttcagcctcctgagtagctgggactacaggcacgtgccaccatgcacagctaatttttttttttttttttttttttttttttttttgagacagtctcgctctgtcaccaggctggagtgcagtggcacgatctcagctcactgcaacctctgcctcccaggttcaagtgattctcctgcctcagcctcccgagtagctgggactacaggcgcacgccatcatgcccagctaatttttgtatttttagtagagacggggtttcaccatgttggccaggatggtctcgatctcttgacctcatgatccacttgccttggactcaccgtgcctggcctaccattgtaattttttatcactatatttaatatatttcgaaggtacatattatttaaagaaggtcggccgggcgcggtggctcacgcctgtaatcccagcactttaagaggccaagaccggcagatcacgaggtcaggagatcgagaccatcttggataacacggtgaaaccccgtttctactaaaaatacaaaaaattagccgggcatgttggcgggcgcctgtagtcccagctactcgggaggctgaggcaggagaatggcgtgaacccaggaggcagagcttgcagtgagctgagatcgcgccactgcactccaacctgggggacacagcgagactccatctcaaaaaataaagaaagaaagaaggtcatgacggggcaggggataagggaagacaaagaaaaaggaggtcaggaaatttctgcgtttatcaaaaggagacaggaaatatcactcactcacaaagtatccaaatatctagtaaatatctccacctgggtgccccattagcacctccaactcaatatgtccaatacaaaactaattaattcctcatcacctaaaagggctcctcctcccatagtcccaacccaagccaaactgtctgcaagctgggacttcctcaacccttcaactccttgtccctttctagccttcaaaaggcagggtagagaagattgttgactttggaacgaaccctacacctgggttctaattttaactagactattcacaagcttggtgactttctagaaggatatggactaaatagtgtccagagaagagtaattataatgtcaaaaggtctggaaaagatgggcagtaacggtgcaagttttcattcctgaaaaatagcttttggtctttgaagggtggcttatgccagggaattgtatacattcataaccaaatcttcctgtgcttatggtttatgggtagcatgacttatcaggcaatttactgtaaatggacaagttcataactgaaaccacatccatgcttcagtatataatctaaagactatataaaccaaactcttcaaggatgcgtagaataaacagaccatgtcggaccaagaagttctcattagctaaagaactttattctttgtctattttattgttcactgtatatcctcagcacttggaaagaagtctgacatatagtaggcattctataaagatttagtgaataagtaaatgaataaatttgaagagaagattcaggtttaaaaaagaaagccaaggtttttattcaaggtttttattatatgtttttatataaaccagttttattcccacgggataattttaggactaatcttatatctgatgataagcctaataaatgaaagatctttgcattcttgggctgacatttgggattgggaatattaatccacactacctaccccagaaaatcctgaagggaaatgggaaagtgagctgatgagaaagtagctgactacactgtactacatgttggctctccccatttccctgcctagctaactggatttaggattggaccaattggccgggcatggtggctcacacctgtaatcccagcactttgaaaggccaaggtgggaggatcgtttgagcccaggaattcaagaccagcttgggcaacatagggaaaccccatctctacaaaaaataaaaaaatttgccaggtgtgatagtgcatggctgtggtcccagctactcaggagtctgaggcaggaggaacacttgagcctgggaggtccaggctgcagtgagccatgattgtgccactgcactccagcctggtcaacacagcaagaccaaatcttaaaaaaaaaaaaaaaaaaaaaaggattgagccagttaaaacaagcaaaaaccatcagtggtctcttttgcatcccccagttaaagacttggggaatatgaaatccttgaatacccaagagttaagttcactttcatttgtagcttgcttagtgtctgtgcttttactcagtcaactgatagttgagataatttggaatatatatacgtatctatctaaaaagtataattttcctggtcctaaacaagaatatcaagtctggccaggtgcagtggctcatgcctgtaattgcagcattttgggaggccagggtgagtggataacttgagatcaggagtttgagaccaggctggctaacatggtgaaaccctgtctctactaaaaatacaaaaattagccaggcatggtggcaggtgcctgtaatcccagctacttgggaggctgaggcaggagaaacacctgagcctgcaaggcagcagttgcagcaagccaagatcacaccactgcactcactccagcctggacaacagagtgagaccctttccccacactgcccccgccccacacacacacaaaaaaagaatatcaagtctaaaagagaaaggattaaatcacatgtgttgaaagaatctggaatctccctttttggttgccatatttccaagagaagaggaggaaaaagggctctacctgcttttcatcattatcccggataatcttggaagtccatagcccaggaataaattagtgttagaaaacggagtatgtagcaatgttctccctgaatcataacataaacctgtttgcctggtgtgtacacatttcattgtaccaaataagtacttctaaattctttttacatttaactggtgccatccagtagccagagcttgctttagactaaggtgacctgcttctgttggaagatttaccttaacttctccaacagaagaccaacaaatgtgaattgtttctgaagttggattaggtcctatggatgacagaagatagtctgccgacttgcagatggacttcgggatctatttgcctttaccgggcttaaaatttgttttatcttagagaaatacctaaatttaacacaactgattcttacgtttataatagggaaagaaatagaaaattcactaggcagttaatattcttaactgttttgaattattacccccttacaaattcctaaagtgtgccagtgtcttattacagccatgaaaaatacaagtttaaaggaatgattcctttttaaactttttaatactgtagctgtaaaaagctcatctacaaatacattgaatgccaccagttgtgcatggggttaaaagtggatgggaagcagatttcaaccaaatgtaagaaacatattcaaatgcataaactcgtctgtctgtggaactagagcaggccagctcaggtagctctaggattctctaatattgctccaagtgggaagtcgtgtttacctaggccttgtgcaaagagaaacagcaggaacagggatggaggctgttgtgattcttgtgggagacaatggcaagacgggtccatctgaaatggagatttcatttgggaaaacaggaagtgttgaagagttgcatgaagaaataggtatcaaattatttgggatcaatagtatacttgactctgacacttgactctttctttctctacagccagtgcggattttccatataatccaggacaaggccaagctataagaaatggagtcaacagaaactcggctatcattggaggtaggtgatgtctagaggaggcttatatggggctactcaactatggaaagtaatagttgtcaataacatagtagtctaggaaaaaaagttttctaggtttttacattattcattttgctgtttaaagattatgacatatgatgtgaagaaatatagtaaatatagccgggcacagtggctcacctctgttatcctagcactttgggaggccgaggtgggcagatcacctgaggtcaggaattcgagaccagcctagccaacatggcaaaaccccatatctactaaaaatacaaaaattagctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcagtggcgggcgcctgtagtcccagctactcaggaggctgaggcaggagaatggcgtgaacctgggaggcggagcttgcagtgagccaagattgtgccactgcaatccggcctgggctaaagagcgggactccgtctcaaaaaaaaaaaaaaaaaagaaagaaagaaagaatatagtaaatgtaacctggctactttttaatgctggcttgtaaaaaacaaatagcagtggaaagctggacagactcagaataattaagtaggtagtagtgaccatagccaggacatttctttatccccctcggatatttttcagtcttatcctttcgcatccaaaatggtccaggatagcgtactataaaaaaatgaaaaggaatgctgggtgcagtgacttacgcctgtaatcccagcacttcgggaggccgaggcaggtggatcatttgaggtcaggagttcaagaccagcctggccaacatggtgaaaccccatctctaaaaatacaaaagttagccaggcgtggtggcgcattcctgtaatcccagctactcgggagcctgagacaagagaattgcttgagcctgggaggtagaggttgcagtgagctgagatcacaccactgtactccagtctaggtgacagattgagacctttctcaaaaaaaaaaaaaaaaaaaaaatacgaaaagggaaatgccagtctgatttcagttatcataataaaaattatcagaaaatcactggaggtcattattttaagtgaaataagctaggcacaaaaagacaaatattgcatattctcactgatacacaggagctaaaagatttacacacatggaggtagaaagaaaaacacgtaacagagattgggaaagttgagcaggaggaggaaggagaatgaagagaagtgggttacagggtgcaaacatacagtaagaaagataaaaggaacaagttccgggtttgctagcagggtaggatgactatatctaacaaaaatgtactgtacttggttgatgaacccctaaatactatgacttgaccactattccttatatacgtgtaacaaattttctcatgtaccccgtaaatttgcacaatgaaaataataaaaactaaaaatgtatcagaagatttaacaagctgtagcatctaaaatattccagtgttttcttctcaccatggacagctacataataatttgactctcctcggatagccactgagcctcatgcgtagatcgatattgacatccctgttaccattaagatcccaatcctcactgtcttttgcttttttaaatgaacttaattgaagtataatacgcatctataagtgtaacaagtccgtaacttttatttattattattttttgagacagagtctcactttctgttgcccaggctggagtgcagtggcgtgatctcagttcactgcaatctctgcctcccgggttcaagcgattctcctgcttcagcctcctgagtagctggaactacaggcacgcatcaccatgcctggctaatttttgtatttttagtagagacaggattgtaccatgttggccaggctggtctccaactcctgacctcaagtgatccactcgcctcagcctcccaaagtgctgggattataggtgtgagccaccgtgcccggccccaatcttttttatagtttgtggttggtttgtcctatctaaaaagtctgcctacccaaaggttttgaagattttcagctttcttctagaagttgtatcactttatcatttgccatcaggtctttaatcacttcgagttaatgtttataaatggtgtgagagaagagtcaacgtcagtattttccaaatgaatatctagtcattccaagaccatttgttgaaaaaaaaaaaactatacttttcctcaattgaattttcttggcacttttgttaaagcaactgacatatgtgtgtgtgtgtgtgtgtgtctattttctgggctttttgttttgttggtctatatatatctttccttagccaatatcatgcttgctttattgttgtatctttttttgttgagatgggagtcttgctttgttgccaggctggagtacagtggcgcgatctcggctcatgcaacctccgactccctggctcaagcgattctcctgcctcaacctcccgagtagctgggattacaggcacgcaccaccatgtccagctaatttttgtattttagtagagacagggtttcaccatgttggccaggatggtctcaatctcctgaccttgtgatccacccacctcggcctgcaaaactggtaggattacaggtgtgagccatcgctcccggcctgttgtatctttatactaagtcttgaaataaacaatgtaagttctctaatcctggccaggcgcggtggcgcacgcctgtaatcccagcactttgagaggccaagacaggttcattagaacatcttaacgatatttagtatttctatctttacatggtgtatctatacgtttatttgtctcatcagtttctctcagcaacgtattgtggttttcaatgcgaagtcttgaacagcttactatttcattaatttcattttctaagtgtctctctctggcatataaaagtataattgatcttttatatcagccttgccttctgtgaccttgctaaatttgctgttagttctaataactttttttgtatattcctcagaattgtctacctagacaagcattttatctgagaataatgagatttttttacttgtttctttccagtctatatccttttgttgtttcattgcaccgggtaggattttcagtacaaaagtgaataaatattgagatttgacaattttgcattgttccctatgttaggggaatgtgtttgatctttcactatgaaataggatattggccgtaggtttccaacagatgtcctttatcagattgagaaagtttcttctactcatagtttactgaaagctgtttgatgaatgggtattggaagttttccaaatgctttttccacatctatttagatgatcatattgttttactccttatttgcttaatgtggtaaatcacattgctttattttttaatgttaaaccaaacttgcattcctaggattaacattatcataatacatgatcttttttacatattgctgggtttgatttgctaaaattctatttaaaagaatattgtggccaggcgtagcagctcacgcctataatcccagcactttgggaggccgaggcaggtggattacctgaggtcaggagttcaggaccagcctagccaacacagtgaaaccccgtctctactaaaaatataaaaatcagctgggcgtactggtgggcgcctgtaagcccagctactcgggaggctgagacaggagaattgcttgaacctgggaggctgaggttacagtaagcccagatcgtgccattgcactccagcctgggcaacaagagtgaaactccgtctcaaaaaaaaaatatatatatatatatatatatatatatatatatatatatatatattgctccatagttttcttgtaacatttttctggttttagtgtcaggataatgctggtctcataaaatgaattgagtagtgttttctcctcctatattttaagaaagatgtgtaggattggtctaatatcattaggtaatgcttgttagtagtattgttcgagtcttttaaatttttgctgattttctgttcaattgttctatcagttactgacagaacagtgttaaaaaatctccaactataattgcaaattggtctaattgtcctaccagttctgcccgtttttgcttcatttattttgtacttaggttagatttatacacattaggaacattatgtcttcctgatgaattcacccttttgtcattatgaaatgttcttcatttctactaacaaccttgtcctttgtctcatattaacgtagctattccagcttatgattattgtttgcatatcttttcccacccttttactgttgacctgtatttaaagttcatgtcttgtagatatcatatagtaggcatcttttttatccactgtctctactttttaattggagtgtttagatcagttatatttacttctgttttatctaatctgtattatttcatccagtatttttttctttttccattttttttttttagacagagtcccccccccccccctcacacaagctggagtgcagtggcacgatcttggctcactgcagcctccgcctcccaggttcaagcgattctcacgcctcagcatcttggctagctgggatcacaggagcgtgccaccatgcctggctgatttttgtacttttagtataaaagaccgggtttcaccatgttgcccaggctggtcttaaactcctgacctcaagtaatccgcccgcctcagcctcccaaagtgctgggattacaggcgcgagccactgctcatttcagacattgtgtgtttcacctctacaagttccacgttgtctcattttttttcccctcattttgatcatgttttcctttaaacccctgtgcaggtttctaatagctattgtactgtcctcatctgctcattccatgctctgtcctttctgtttctaatagctattgtactgtcctcatctgctcattccatgctctgtcctttctggctctccttctaattgactgatgtttcttctggtcaagtgacattttgctacattttttttctctgaattatttttctctgcagcttgacgttatttagatgtgttttaaagctttttcaggacagagctagagtagtctttattctaggcctattttagcaaacaccttcagcatgaccattctatcaactgtattaaatgctctgattgttcaatgaggtctcttcagtgtggttgttggactataaacatctcccagccctccgtgagctctggttttttgcctggcctgtggacttttattctgtacatgcacatgttagtattattcggccacaaattcagagagacttatgtgcagattattagggttctttctatacatagctctctcgcgcgcccactctatctcccctctccattcagggaaaccactgtgctttcttgtgctgcccctccctacactgctgtccaaaaatcgctgccagccagaaaactaggaaaaatgtaggattcctcctttttgtttctctgttctcagacatcatggttcctttctgcctgttttctaatgtctgtagactgtcatttcatagactgtgtccagtattttagttacttttggctggaagacaagttactcctgtttttcctgttactccttcatggacaaaaacagacatcttacttcatttttgttatctttgttgttttggaggttgtgttttatatgggagagggctgtgtctgacggagctgtagtgaagtggggacagtgttggagggactcccaagccctgtctaacctctcgtgcttctcctttctccgtcaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaacctttttaatatttctttatagctgagttttcccttctgtatcaaaacaaaataatacaaaaaatgcttttagagtttaagcaatggttgaaatttgtaggtactatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccagctctctggcatctggggttcctgactgataccagcagttgaaggaagagagtgcatggcacctggtgtgtaacgacacaatcagcacaactggagagaggcattaaagaaccagggaaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgatttgtttgctctttttcttttatagtttagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaagacggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaaggctaccatttatcatcattatatttcaagcctcttatacttaataagcactttctaaaaagtcttgagatcccaccattctgaggaattcaatatgatcactttttccttctttgcctgggagaggttaagaggaggtttcgaaggtatagatgctattgttctgatggcccggctgaataaaatggaaattctagtttgttagaattatgcattctttttcaagattctcagtgtgcctaacttattggagcacatcagtttcttgggtaatggaaaacattacctagagttgccagtggcacattacaccagtacagagcacattccaaaggagacattggaccagttaattcccatacaagtcaaggtaacagaacaaaagggaatcctgatgcccttttaccattgctggttgagctcaggcactgtcatggacacccttaattttaaaaggttttaatcattcttctataaaatacatttaaaatggaaaaatacttaatatcactaaatatcagaacaatgtaacatttacaaatgacatattgaaagcaaaggctgttttatttagccaagatgattaccattaggagttactttatgtattgttgaaagcaaattttaaacatgatgttttagaagtgtttctgatttttaaacctggtttacaggtattacttctgcacttaccaaataatgccagatggaaatttattatttcttgcaattcccatgatagctctgttctttatgcattgtctcaacactttcccttttttcccaaaatgagtagagaattaaagccacccaaaacagcttctgctactaaaatgttctcatcctttctcctccctctccttttcctgccacaaaaggtgaaaaatgagatccaatcctctcaccaaaatttcaaacctaggacactggaatgactgcagggatcagtggttctcccatatcaccatcaattaagacatataggacactgtcttccttcaagagggttacaatgtggccatcagacaggaaaccaaacggtggataaagtattaagtaactaagtgccaaataaatgctggaaatcttgacctctccttgggattatgggtgtaacaaaaatccctacatctgtttatgaaggccatattcagtacattttaaatggtaaataatctgtttatgtgaagaaaaagaattaagtctttcttccaactctctccttggatagcctagcacagtgcagcctccataaccatgacattcccgcccaagctctcagtgcctaatcctgctttgtcattcacatctcacaaaatcttgacatcttacattccaatacattatcaagcaagcacaagtatgctggtagtagcctctttaaataatatgtatagacaacaacaacgacaaaaaatagactgttttaaagtttcagggaaagttggtggctgatttaaagttgtgcaggaaacatcttctgtgtatgaagcaaatgtcgatgttttgaaaaaagctaggagatgactttgaatgaatgcaaggttagtgagatcctaagctctcaaaatagcatattccctagagctcaagaaagctggtccaggaggttgaaaaagctattttgttgttaaattattttctggcccttcttaatatttaaaaatgtatttccccttgtggctttcaaccacctgctcaaaaaaagagacttgttacatgaaagttttcattaaagagctgaaaacaagaatttagagagccattcctagaaaatgtcctactgccctgcatttgacaaacaagcatcctttactaacaagagcaggaattcagaggcacaagaaaaagcattggcatgagccaaagagtctgtcttaatgttacttttgaaaatctgctgagcggccaccatatgcaggctgagagctgggcacaggcgaagccattggaagcacttcaggaacaagcacacagctgtgggacttgaacatgcaagtgttcaggttgtgtcaagaagcttttctttccttctatgatggaatctgttcttttctatcctacttttttctctcttcctctcctcaccacattataccctgctcttacgcagtaaacgttttaatggcccgtttatgtctcatgcctccaaacaacactgaatttgaaaccccccattttttcttttcaccaccctgttgagcaattttcccaaaaaaagggcagcaattattaaattgaattcaagtaagccagccaaagataggtcctaaattgctagtcccagtagaaccacctgatcctaaaccagtgcgaaacaaacagtaacaatgtccccagctgacttcagctaagaaccaatggctcctacccccgccccgcttttttttgttgttttttgttttgttttgagacggagtcttgctctgtcccccaggctggagtgcactggcgcaatctcgggctcactgcaacctcctcctcctcccacattgaggcgattctcctgcctcagcctcccaagtagctgggattacaggcacccgccatcacacccagctaatttttttttttttttgtattattagtagaagccaggtttcaccatgttggccagggtggtctcgaactcctgacctcaagtgatccgtccacctcggccttgcaaattgctgggattacaggtgtgagccaccgtgccgagccagccccattttttaaatgatgttttggttaagagtggaccatgagaattagctgacagcatcccctttctctctccctgccttggtgggaccctccctgtgtgaccttggtcaagtcctcgaacttttgtcccgtatttaagatggagctgttttacctacttcataagacagttgcgaggtgccattgattcttgactgcaaaataccttgaaacccttatataaagactgaagtcaacggagcctagtgaaagacttactttgtggcttgtggttgaaagtcacatcaaaagacaaatgtggccacgttcaggaattggagacttactggcatggctctacagctgctcagttattaatcatgcagactaacctgtcaacactgggagatgcaacatagcaaaaggacagagaaattagaattttttgtgcagaaagccctaaattcccacctgaatgtaacttacagctcccttacctactctcacacatgccctcaaacatgctagattggcttatacataggccaacacaaaatacaaacgtgacgtgttcatgtagcctagtggctatatgcctattctccatgtaccctgcatggtagtgctgcaaactttaaagtacatttctttcacagcagtattttttttcataagtggcatataaatgtcattcaatgaaatggggaaatcacgttgagaagttggtctgtcatctcccattgagcaaagactggcaggagataataaaaataaatatgggcacacatgtattaatatacagcacgcatttacaagtttattttccagataaaattgtgctataagaacagctctaccaagacagtctgcaccatttccaagtctcagttaatttacagcaactgctgctttcggagatggctgtgaaaatatggaagttcctctcaagtaggccaagaaacagttctagattttactaagttttattttgtcaggttttttaaattttttcagtgagcgtggtgactgcagaggttagtgctgtgaaaagctgggctaaatattctttctgtaaagtcaaacaggattccatcccctgtgaaataacacaaaatttcactctctaaaagcaacagcatgtaaactagaatgaaagaaggaaattatgtacgtatgcctaatattctttgtgaatgtctttcatttaactaaaattatattagaaaccagattgataaataaaaaattcaaagtagttttaattatcctaa

SEQ ID NO: 733 - DNA, 6488 bp, Homo sapiens
gtgtacttaaacatacccctctactttttgtcgtttatttctatttataacaaactcttgtgttgagggctcttgatggacggcagcaagggagctgctctgctgcatatgaaaccccgacccagagcccctctactcatgcgatgtgtagttgacagccacttcacaaacattttcagctacagaaaatatattcaaggaagaatgttaaaaagtttccttataacctacaaggggttctctctagatgtaaacaaatctggatgaaatattttaatccaagtataccatttcccacgtcgtaaatcttctgggctggtgggagccaatccagttacacactggaaggggagtgagggtcccagggcttccccacacctcacaaggcccacccttgtttccactgaccctctctttgacctgaaacccccaattgcctccacaggcaaaacaaaactcaaatctctctagactcaaagacttaagactatgccaacctatttgtttgtaattacactgctcaaggctcctgtttcctctccttcagccattctccagagcgctcctcaagagattttaagtctctcacagccagactgtatttcccttggtcaagaagcaaccacggaatattctacctgcaggagataacaaatgttgactaatttatgtatgagaccattctatagtacttttgcagcgaattaccccctattctgaaggttaatgtttttccttctgatgatctagacggggtccacacactacagcattcagcccaaatccagcccatgagcagagaatcttttttaaaaacaatcctttaaaaatataaaaacctaagactatgtgacagagatcatatgtggcctgtaaagtctaaaatatttactgtttggctctttatccaaaactgctgatagtgcctctggacaagagcgtaaaagatgagtcatggcgtaagggaataactgagaggtcacgtagaaacctggtcagcctatgaggaaccttgaggcacgatgtttctttatcccagtaattcggcaactcgactccaagcacccaattttgtggatgaaccccaaggagtctgtcaactttcaaaatcacggcagctgtctgccacttgccagacttattttgggtgagtaataataaatagagaaataagtaatagttagaggttgtaataaaaagctatttaatgtttgatagacaaattgaagtccataaatctccttgaataaagatgctaaaaatgttattcttgttttttaaatagtttcgtttttacaaagttctgtacataaaaataaatatacagaaacaaaccccatcaactgtccacatcagtaatcctcactggtgggctcaccattgataaggaagacatcattcaacgcaacctgtcacagagactgtcctagcagcaaggatttctaacctcaaaagaacattactaggcctcttttatcaagattgctaatcatctagaggcctttacctaccaactagcaattaaccatgaaatcaatgaatgcaatcactgtctccaagtagaatgtgaccaatgacctcatgcctagaggcaacatctataccttttgctgactggagccctgacatatgcaggtgtagttaggaacagaaatcaaccccacctccccttggctagtcactgtgaaaagcgtgcgtaaggcaattgaatcgagggttaagggttcatcttgctaatgtcaaaagtgacactaacaagattcttagcctcatccgccagatgacgggcctctgcgtccaggtctccaggagcaagctccgcctccttcaccagacaacgggttataacctgggaggacagaaaagcagcacaacagtattgataaaaatctgaaaatctgggaacattgtatatccacaataaaattatgagagtgacacgcaaagcactgcaaagatacagatcctaagggacatttaaaaaaaccttttagctatgtgaaaaaaaaaaaaacctttatattgtgattgccatttgaactgattgtctggtggggaaaaaagtcattcagcttctttgtcccaacctccgaaacacatgcaaaagggtcaccaaaaaactctctcaagagggcctgatttaagtatatgaatcctcctatcacagtgcttactaaaactcatacattcaaataagggctgttcacgctacagaaaacagattaaaaaaaatcaagagtcaaacttgtcacttctaccagtcagaacggggtcttctgtatccttccctacccccaaccaccccactccctcatgagcttcccaaagtcagtgcacaactggtaacctggttgagtgctaaggttctagggccacccagaacttaaatgttacttttactccttacttatagtggaatctttgggcaattaaacactgtgcctcagtttccttatttgtaaagccaggctagtcaaaagtcccagctcagaaatgctggggatgctgaaagaggccgtgcaggcaagcacaccctgcattccatcttctacgatttccattcctctcctaaatatcacctctatgtgtctaaaaataagcttccggcaggaccatttaaaaatagcattttctttccagatgcatcaccttctctacagcaagccaggtttagtcttctgacacaaaggggattacagctcagcgtttaaggtcagccaagtctgtggccctgctgccttggagcccatgccccagtctttcctcagtcctcaaagacaccatcagggcctctgcggtgcccctctcctcctatggaggatacaaaatcttccgccttggttcctacagtgttctagtgtgtttgttctttccttcctcagcagtaacttgcaactcttagccagaatcaccaaggattgcttattttcgtttgtgagtcccatcttcccagatttgaaattctcagggatgggatgaagacagactgctgtggcatcatccagagtccccggggcagtgctgcacacaggaagcagctttggatgagcatctgtctgctactccttgttatttgcaagaaacaaggtggtcccagccagaaagaccaaaaccactgtgttccagctccttgacactcatctgaagattggcagacaattcctcaccctacttagctctccctctacggggctgcagaaggatcaagttagaatactataagtacaatccttctaagtacttagtgaggacctaggaggtgatttgcatctgtttcctttattgaatcttcacaatcctaaggaattagtcttaatttatggacaaagaaacaaacaatcttgttcctaaaaggtaactatatcctgtaagtgttgaaaatctgttaacatttgacatcagtggtgcttacctcctccccgcaaaggctttctgtccgatttccgtttcaggacagatgaagtggaaggcccaggactgtcttcctcctgtttgaacacacacagtagtgtaagaagcaattaaaacattctacttggcaatcttcatctaccgcatgccagccggccgaggtctccagtcacctggggcttctttgcatttcctttgtaactttttccttcttgcatgctgtcccacatttcaatcttctgtctccttttttcttcttcaagctgagaaacaatcacattttacagaaagaattcagaagctgccatttctctcaaagacaaagctaactctgataattcttaatttaaatgtctttcagaacaaacttcaccctcgttttctttagttaataaaactgttgtgatctggtagtgtgagtttaactcacatagagcagctttggtttttgtacactattaaagaaagcaaaatgtttcatgaaaaagattactgactccattcttctgaaactcactcctgtcaggacatttttggtaatggggaagacacaggcacatgcacacacacactcacatgctccctgctccagcctgtccctccttttgtgctctggacctttcatggtaatatattcacacatctagtgttccctaacaatcgtgtattcttcttgatatcaccaatacttacatggtaggaactgaaatgcttattgaatctaatgggataggacctggtcctagaagcttatagacaacacagacacaggcatcgttagccactaaacctcagacaatttctatgcacacattcaaactgaaaccagttcatacttgtttcagtttttccttatgcttttcaacttgcgcatttagttcttcttgcattttcagtcgagcagctgctaaagcttcttgtcgtttaacaacaacatcaggttctaaaatgtcagaaaaaaatggagataaagcactgtgtacaatataaaatagaaacttttgagtgtccatattattaaaagtataaagaggtatggatatcagacaatgaaacaacatatttttacataagtactcctaacccctctgcatacattttactgcttcagggggcaggggtctgttgctgagccacggattttagcccgaaatatctacatcaccagaaatctgttagaaatgccaatttctgagttcccctgagcaattccgattcataaagcctgggatagtggccacacagagcacatcttggatacctcagtgacacccacagtctctaggctgactagaatcctggaagactaccaaggaaatataaagttttctaaatcattatccatcccttaattagcgcagaagattcttaagtatttgtttctacagaaaagaaaaatccttccaaatagcattatgaatagaaatgaactcatttctattcataacgtctactcatagagtctcgctctttgcaacaaggctagactccatctcatagaaaaaaaaaaaaaaaagaaagaaaagacagtctcactctgttgcccaggctggagtgcagtggcacaatctcagctcactgcaatctccagctcccaggttcaagcgatttctcctgcctcagccaccctaatagctgggattacaggtgcccgtcaccacgccccactaatatttgtatttttagtagagacagggtttcaccatgttggccaggctgttctcgaacccctgacctcaagtcatcctcctgcctcggcttcccaaagtgctgggattacaggtgtgagccaccgcgccccaccgagaaccatatacttcctactttttttttttttttttttttaaagacaaggtctcaatcaattgcccaggctggagtgtagtgtggcccgagcatagcccactgcagctttgactccctggactcaagtgattatcccgcctcagcctcctgagcagctgggactacaggtgcgtgccgccactcccggctattttttttttttttaaatagagacagggtcttcctgtgtggcccctcttacttttactaagagactaactcttaatataaaggaggtgcaaaaccaccgctttcatttcggttatcaggcactaacccacagcagccgcagctcggtccagctgcctctgcctcaaggctcttagccgggcggaaagcttctgaaagaccacgtagagaaggatgcagctgaagacgatgtaccagccataggtggccagcagggagcccactgaaaagaaaaacagttttcaaaaaactaaaaatgacactactagttgacctttccataagactcaacaaacacaaagtgtaactcctgccctcaaagccttcatggtctaggctgaggaaaaagcctcctaagtagatcgttaaaacacgaactcaagaagtgcgacaattcagggatcactgagaagtgagacttcccaaccatctggggagtcgggggcagttagagtgtggagggcacagcaactgggttttgaagaatgaagagcaactaatctgaatcaggaaggcaaaggcctttcagagccacatagaaaggggtgacagcgcggggagtcaggagtgtgtatggggctgtgtgggacgggtcccagaggcaaacgccaacggccgagtgaccccagtaactaccacaggaagggcttggttcgcaaaaaagacttgcgcaaacaagggacagccgagccgcccagggaagtgcggctcccgagaagcctccgcgcaaggtccgggcctgctgcccaaggtccgcgtaagcgccaacgcccgaccgttcccaggcctcccaggctccggcgcccggtgcagcggcggacgacccacccatcatggctgcgcgtcgcaaaagtggcggcgcgcgcccggctgccccgcaacgactcacccgtggtgtgcaggaagcgcagcccctcggtctccagggccggccgcgcggacagagactcctcttggcgttccatgaccgccgccgccgccgccgcccagccctgccgccgcgcctccagccgggcgcttccggtgcgctcctacgcacacgt

SEQ ID NO: 734 - DNA, 5312 bp, Homo sapiens
atagttagaggttgtaataaaaagctatttaatgtttgatagacaaattgaagtccataaatctccttgaataaagatgctaaaaatgttattcttgttttttaaatagtttcgtttttacaaagttctgtacataaaaataaatatacagaaacaaaccccatcaactgtccacatcagtaatcctcactggtgggctcaccattgataaggaagacatcattcaacgcaacctgtcacagagactgtcctagcagcaaggatttctaacctcaaaagaacattactaggcctcttttatcaagattgctaatcatctagaggcctttacctaccaactagcaattaaccatgaaatcaatgaatgcaatcactgtctccaagtagaatgtgaccaatgacctcatgcctagaggcaacatctataccttttgctgactggagccctgacatatgcaggtgtagttaggaacagaaatcaaccccacctccccttggctagtcactgtgaaaagcgtgcgtaaggcaattgaatcgagggttaagggttcatcttgctaatgtcaaaagtgacactaacaagattcttagcctcatccgccagatgacgggcctctgcgtccaggtctccaggagcaagctccgcctccttcaccagacaacgggttataacctgggaggacagaaaagcagcacaacagtattgataaaaatctgaaaatctgggaacattgtatatccacaataaaattatgagagtgacacgcaaagcactgcaaagatacagatcctaagggacatttaaaaaaaccttttagctatgtgaaaaaaaaaaaaacctttatattgtgattgccatttgaactgattgtctggtggggaaaaaagtcattcagcttctttgtcccaacctccgaaacacatgcaaaagggtcaccaaaaaactctctcaagagggcctgatttaagtatatgaatcctcctatcacagtgcttactaaaactcatacattcaaataagggctgttcacgctacagaaaacagattaaaaaaaatcaagagtcaaacttgtcacttctaccagtcagaacggggtcttctgtatccttccctacccccaaccaccccactccctcatgagcttcccaaagtcagtgcacaactggtaacctggttgagtgctaaggttctagggccacccagaacttaaatgttacttttactccttacttatagtggaatctttgggcaattaaacactgtgcctcagtttccttatttgtaaagccaggctagtcaaaagtcccagctcagaaatgctggggatgctgaaagaggccgtgcaggcaagcacaccctgcattccatcttctacgatttccattcctctcctaaatatcacctctatgtgtctaaaaataagcttccggcaggaccatttaaaaatagcattttctttccagatgcatcaccttctctacagcaagccaggtttagtcttctgacacaaaggggattacagctcagcgtttaaggtcagccaagtctgtggccctgctgccttggagcccatgccccagtctttcctcagtcctcaaagacaccatcagggcctctgcggtgcccctctcctcctatggaggatacaaaatcttccgccttggttcctacagtgttctagtgtgtttgttctttccttcctcagcagtaacttgcaactcttagccagaatcaccaaggattgcttattttcgtttgtgagtcccatcttcccagatttgaaattctcagggatgggatgaagacagactgctgtggcatcatccagagtccccggggcagtgctgcacacaggaagcagctttggatgagcatctgtctgctactccttgttatttgcaagaaacaaggtggtcccagccagaaagaccaaaaccactgtgttccagctccttgacactcatctgaagattggcagacaattcctcaccctacttagctctccctctacggggctgcagaaggatcaagttagaatactataagtacaatccttctaagtacttagtgaggacctaggaggtgatttgcatctgtttcctttattgaatcttcacaatcctaaggaattagtcttaatttatggacaaagaaacaaacaatcttgttcctaaaaggtaactatatcctgtaagtgttgaaaatctgttaacatttgacatcagtggtgcttacctcctccccgcaaaggctttctgtccgatttccgtttcaggacagatgaagtggaaggcccaggactgtcttcctcctgtttgaacacacacagtagtgtaagaagcaattaaaacattctacttggcaatcttcatctaccgcatgccagccggccgaggtctccagtcacctggggcttctttgcatttcctttgtaactttttccttcttgcatgctgtcccacatttcaatcttctgtctccttttttcttcttcaagctgagaaacaatcacattttacagaaagaattcagaagctgccatttctctcaaagacaaagctaactctgataattcttaatttaaatgtctttcagaacaaacttcaccctcgttttctttagttaataaaactgttgtgatctggtagtgtgagtttaactcacatagagcagctttggtttttgtacactattaaagaaagcaaaatgtttcatgaaaaagattactgactccattcttctgaaactcactcctgtcaggacatttttggtaatggggaagacacaggcacatgcacacacacactcacatgctccctgctccagcctgtccctccttttgtgctctggacctttcatggtaatatattcacacatctagtgttccctaacaatcgtgtattcttcttgatatcaccaatacttacatggtaggaactgaaatgcttattgaatctaatgggataggacctggtcctagaagcttatagacaacacagacacaggcatcgttagccactaaacctcagacaatttctatgcacacattcaaactgaaaccagttcatacttgtttcagtttttccttatgcttttcaacttgcgcatttagttcttcttgcattttcagtcgagcagctgctaaagcttcttgtcgtttaacaacaacatcaggttctaaaatgtcagaaaaaaatggagataaagcactgtgtacaatataaaatagaaacttttgagtgtccatattattaaaagtataaagaggtatggatatcagacaatgaaacaacatatttttacataagtactcctaacccctctgcatacattttactgcttcagggggcaggggtctgttgctgagccacggattttagcccgaaatatctacatcaccagaaatctgttagaaatgccaatttctgagttcccctgagcaattccgattcataaagcctgggatagtggccacacagagcacatcttggatacctcagtgacacccacagtctctaggctgactagaatcctggaagactaccaaggaaatataaagttttctaaatcattatccatcccttaattagcgcagaagattcttaagtatttgtttctacagaaaagaaaaatccttccaaatagcattatgaatagaaatgaactcatttctattcataacgtctactcatagagtctcgctctttgcaacaaggctagactccatctcatagaaaaaaaaaaaaaaaagaaagaaaagacagtctcactctgttgcccaggctggagtgcagtggcacaatctcagctcactgcaatctccagctcccaggttcaagcgatttctcctgcctcagccaccctaatagctgggattacaggtgcccgtcaccacgccccactaatatttgtatttttagtagagacagggtttcaccatgttggccaggctgttctcgaacccctgacctcaagtcatcctcctgcctcggcttcccaaagtgctgggattacaggtgtgagccaccgcgccccaccgagaaccatatacttcctactttttttttttttttttttttaaagacaaggtctcaatcaattgcccaggctggagtgtagtgtggcccgagcatagcccactgcagctttgactccctggactcaagtgattatcccgcctcagcctcctgagcagctgggactacaggtgcgtgccgccactcccggctattttttttttttttaaatagagacagggtcttcctgtgtggcccctcttacttttactaagagactaactcttaatataaaggaggtgcaaaaccaccgctttcatttcggttatcaggcactaacccacagcagccgcagctcggtccagctgcctctgcctcaaggctcttagccgggcggaaagcttctgaaagaccacgtagagaaggatgcagctgaagacgatgtaccagccataggtggccagcagggagcccactgaaaagaaaaacagttttcaaaaaactaaaaatgacactactagttgacctttccataagactcaacaaacacaaagtgtaactcctgccctcaaagccttcatggtctaggctgaggaaaaagcctcctaagtagatcgttaaaacacgaactcaagaagtgcgacaattcagggatcactgagaagtgagacttcccaaccatctggggagtcgggggcagttagagtgtggagggcacagcaactgggttttgaagaatgaagagcaactaatctgaatcaggaaggcaaaggcctttcagagccacatagaaaggggtgacagcgcggggagtcaggagtgtgtatggggctgtgtgggacgggtcccagaggcaaacgccaacggccgagtgaccccagtaactaccacaggaagggcttggttcgcaaaaaagacttgcgcaaacaagggacagccgagccgcccagggaagtgcggctcccgagaagcctccgcgcaaggtccgggcctgctgcccaaggtccgcgtaagcgccaacgcccgaccgttcccaggcctcccaggctccggcgcccggtgcagcggcggacgacccacccatcatggctgcgcgtcgcaaaagtggcggcgcgcgcccggctgccccgcaacgactcacccgtggtgtgcaggaagcgcagcccctcggtctccagggccggccgcgcggacagagactcctcttggcgttccatgaccgccgccgccgccgccgcccagccctgccgccgcgcctccagccgggcgcttccggtgcgctcctacgcacacgt

SEQ ID NO: 735 - DNA, 91918 bp, Homo sapiens
aggcggagccaggccggcctagagtcacttctccccgcccctgactgggccgggagcccggggctggtctctaagagtgggtaccgagaacagcctgaccgtggagaagggctgcgggaagcagaacaccgcccccagcgcccagcgtgctccagaaacatgagcacaaacgcctcagcctccttccccggcggcaccggcaccggcaccagtacccgcaccagtaccggcaccggcaccagtacccgcaccagtaccggcaccggcaccagtacccgcaccagtaccggcaccggcaccgagcgcaaggcggagggcccgcccgaagccgggggcacaactgcccaggtcccgaacccggactccagcttggacgacacctcctacagcctgtccgaatggagcgtccgttctgagtggcggtccgtctcggatccgctagccagttcccagtggagcacgtcctcaactgccgaggccgcctcctggagctccagcatacactccccaatcagcactaccggtcttagcgagagtactgactccgactccaagagtggcctccggggtttcagcgcttacaacccgagcagtcggatccccaagtctaccaccagctcgaactcctccgatggggccgtcacagcctccaatcaggacaccggcattccctgggtattagtaacaggacctaccccgcccgtaaactcccccgtagagtcattgcaagggtctgccttctcctcagggttcagcaccccacggggtttggtaaaaggaccgaccctgcccccggattccaacctgacctcagtgtccgactacacttggatatttgtacggggacctcctatacccaatgacctttcgcaagtgtcaatacaagcacctcctacacccagtaacacccccgagtgtcagtacaagggtctgccgcatcctcagtgtccagcttcccctggggtttggtaccaggaccacctctacccaataacatttccccagtgtcgccacaagcacctcctgcaccccataacatccccccagtgtcaaggcaggcgtctacccccacctcagtgcctgacactccgcggggttcaatacaagaacctcctgcacccagtaatcctttccagctgccgacacaaggacattctaaacctaataactctcgccgagtgtcagtacaagggtccgccccgctctcagtgcccagctccccccgggtatcagctgaaacatcagctccgcccctgggcgctcccggagtatcagcaaaagggttcgccccgcccacagtgcccggctccccccgggtatcaaaagaaggatcggctccgcccccgggctccccgggggagttgatagaagggtccttcccaccctttgccgtccccactcctgtgcctacgacccaggagcgtgtcagccaaagcatggagaatcaagagaaggcgagtatcgcgggccacatgttcgacgtagtcgtgatcggaggtggcatttcaggtcagtgtggaccgtagcggtggcctgggggaccctggccagtgaggggtaggggaacctacagtagctcttgtggtgtttgggggtctctcatgcatgcgagagtgtagtgtagccatggcttggccccatatcctgcgaggtaggagtgggggttgtgccagttttgctggtggtgtgactgggggaggcagacacaataattttactactactactattaaatactaatatttaattagctcttgctgtgcagttgtatttagcactttacgtggattttctcagtcctcaacagtcctgtgaggtgggaactaaattcatccccgttttgcaaaaccaagaaactgaggtctggggagtttcaataactctcttgaggtcgaatcacctagcttgtaagtggctgaacgattttctcccatttaagacctgcagtactaattcctgaggtggctgctttgcctcactgatttcatatcctttgccctaaacagaacatcaggatacagatttctgtagtattgagggagcagtagtgttattccagtcctgctcttctctattttccgtagaaaatttagtaggtgaagaggaaggaggtagactcctttaagaaaaggttaaaaaaaaaaagaggagaagagggggtgagctcttaaactattcctgtgtgtgtgtgtgtgtgtgtgtgtgtgtgtgtgtgtatgaactgtgtttatatatatatatgaactgtgtttatatatatatatgaactgtgtttatatatatatatgaactgtgtttatatatatatatgaactgtgtttatatatatatatgaactgtgtttatatatatatatatgaactgtgtttatatatatatatatatgaactgtgtgtgtgtatatatatatatgaacttgcaggaaggtgtaggacatttattgtccaaagagaatccctttatgaagcaggggctgagtgccctgttgtatcctccttcctcctttcactaagagctcccaccacctgaatcttgtcttctgatgagccagttggtgggccagggtgcccctggtcctggcttggatttgtggctaaccaagtgagtggtgcatgaggctttccaatatcttcctggaagcctcatcatgattgatatattgtcgcctatgttgccatcattggtaaaatgtttgaaaattaggaattttgttgcctttcatccctggctagaataccacactgacctatcctccccctactaggtgttaataatttctgagttatccctgcaggatctgattcagaaagagaaagctgatgggagggagtaagtagagtggccccacagtagccatttttatatataaatctttcgaggagactctgaacatgctacaaattaatgttgggtagagatagctttatctgaacccaacattgtttatcctgaacaggccaagagaagagattggcatgaactgttgctttgccagttccagccagtaccagcaaaaacatacatgtatgttggagcatcagaggaaagcagctcctggtggagagtaagaaaaaggagtatttcagcttgtttctctttatttatttatgtatttatttattcattcaaaaaacacttgttgagtacctgcaatgaagtggactgctgtttcccaaaatctggtcccactaggcaagcctcctaaaagcaatatggttgtagatcactggaaaataaatatgatgacaatgtgttatatacattgactaggggttctgggtcctctcccatctccataccatctgtattctgcaattcagagttctttctgggattttattcttagtctttttcttgttcagtctccagaattccttaaggagcgcggtttttttatttttcctctgcctgattacctgctcttcctccctttctatactttatgctccatacttggtcattagcagaggtgaaattaccatgtagctgataaactttatgctttatggccttataactgtaggttgcttctggttctcattctaaataaataaccagtttcatactcagtcctgtatttgcaattttgctttcttatttcttagagaggatacccaagttatatataagttgtaggtcccacaaaacctgaatctgtccatagtcactcttaattattaatttatttccatttgggggaagtagagggcatttcttgcacagtagttcacacctctattccagaggccagcttcagtgacactggaaaaagcacttgacttcctctaatgccatctccatcagtcagatctgagtgattttaatactcaaactgaccagaaacattgctttctatctgtggtaccttcccagatggttcacagctaaaatgaaagtagttgcaagtgtggctcgtgttagatcctggacataaactgagtgtttcatgagcgggtgagaagcatcacttcccaagcattcttgtgaattcagaaacataccatttttgtgtgtgcttggcagtatcccatgaattacttaatagtccctgtggcagttttatatgcctttggatgttctttataacttttattaggacttgtacactttgataggttacccacacattcataatacatcaccaatccatagcatcagcagtgttatttctattatatagcacccagaagagtacatattctaagtgacattactcaaaattgatccatattagcaacattttttaaataactctctacacagagaatagcagcatctggatgtatctccttttttgtcattataaaacataaaatagactatgtcttacaaccacaaactctttttatctgcctaaccaccaattaaataattatatatagtatgttaatagttgagaggggaaataaccctgctgatttgttggtctagtggtatctttaaaatgctctggtccttaaccatcattcatcatctatcacccattcctttttgaaactcctttcatgttttcagcgatgctattggatcctgaatttttatcccatactgattgctgcttttccatccctttcattgtgctcatattcttgcaaacatctggttttgaaaggtttcactgttcatcactttggggctcttggtactctctccctctctttctcattctaggacttcagctgtcccttatctatagaaaactctcaagtctctgatttgaatcctcttccttccctgaactcctgtcccatagcttatctgctcctgggtatttcacgattgaacacttcaggttcaacatgtaccatagctactgtgctagccaatccagcttcttttcctcagttccttgactctgttcttagcaccaccatcccttctataatttttgacataatcttttcttttatcttctgcacccttttagcagatccttctcactcttctttggggctatctctcttctcctttctctatgatgacctccctccccccatcaccaggacagactcttttttaaaagtattttgtataaatgtaagggatacgactgcaattttgttacatggatagattgcatagtggtgaagtctgggcttttagtgtattcataacgtgaataatgtacgttgtacccattaggtaatttctcatcatcctccttcctcctgccccacacccttccagtcaccaatgtctattattccatacctctatgtctgtgtgtgtacattatttagctcccacttataagtgagaacatatggtattggactttctatttctgagttgtttcacttaagataatggtctccagttccatcaatgttgttgcaaaagctcttgacccctgaagctacctggttatgacccccttcccagtggccaccctttacaataatggctctccctttatgtccatcctgcattcagtgttctcccaaacttgatttttcttaaacacttctttcatcaccttgcccctctgctcagggccttcaatggtctcctattagcagcctcccaaacacctccctatcccgccccccatcatgacaagtagcatttcctactattttccaacatggatctgagctttagtctcaccgcctcgtgtcctcaggctacactacgtttatttagtcccttcatgccttttctgtttttatctttcttaacatggaagtgcttttctcttacatttatattctatctatccttcaatgcttggctgaagatcctttccttgatcactctggctcccattgatttttctctcctcttgtagagcttgtaatctgtacttaacaaacaatttacacttattttctatctcttatttcatgatttgattttaaggataatggctcagtcactgaattcagttgttagttcttactcatgagctgccacagatacaataaatgacagaaaactagcggtggaagatttttaaatctgccctcaactgagaatttctgaaatggttctctttagtagagaaaaaaaggaaacaagaaaaaagcccacctccaggggacaatgtatacttccttcatgagtctgtttggaatttgagtctttgggtcaaaggggttttaaaaggcaatctagtccaatcacctaagattttaatcttcttaacagcacctcgctagtgattagagccagatggctgtagctttgaacgcatttaaggataggaaatgctcggtctctcaaagcaactcattacaagtagaggtagctctggctccttgtcttgtttaagcatttcaagaacctctacctatatactaagcagtgactggggatcatggggaaagaaagagatatataatgatgagtaagtagcatccctgtacataaggtacttctatcttctggaagaagtaatcaagtgggtgaataattgacatgaatacagtgagataataattgatatgaatatagtgagataaatatcaatgtggtgagataaatattaatgttttgaatatgaacaaagtgcagggatcttgagagataagtagaattttaacaggtagagataagaggatggaaaaaaagacataccatacaggagagactagaggaacacagatacagtcatgagggtataagccagatatgagcagtgcttaatttcccaatggtgagagttccagggaatgaaaatagttgtttcctatgcctctaggtatgtgatcctggtagctattgagatgagcccagtgtgccacatctacccatgatttttgttcctgtgtgagctgtgaatggttagcgagcgcacagtgaaaatgccttagtcataacactggattgtcctgggtgaataaagtgtttcttcatttttttttattttgcaattaaattccaagtgtcacgtagaaagacctcttcatgtccaaatagtgtttaagcaatagaactcctctctatttttgtccatcagctgagctctgctgaaagaattgagaacactagctgcccagaattcagtgctgtataaaaccagcaggaatgaatttttcttatcttctgagagacagaaaagccattttgcaagagaaataactaatgttcagcattccgatgattgagtccacaacataccacaatttccctttttgctgaaatatatcacctgtaaaaattattctgctaggaccattttaggcattttaacccagaacttggcagcatgtactgtgtggttttgcagtgattaagaaaagcttccatttaagaaatgccacttatttttggtgtcttagttatttaaatactctgaggttcaatgtgggctgagcattaattttttgctgtttaggacacttctctgcccctaatttatattttatttttctaaaaaataaactagggtgtttttacttcataaactttttaaatactaaacaaagaatacaagaattacatttatttgtgttctgattttttttttttgaaatcttcatggttgaaggagcttttggatttatctggcattaaatgggaaattttagcatttagtcaatactaattgatttgaattgttacataatcctcagctattgtgaaaaatgtatttaacaatagatctaggtatagcataattgcatacattacagagaccaataatggagaaaaagaaacatggaacaccattattggtgaatattgggtcacaatctttgtgcagttatggcatagaaatattttaacctatgaaaaatcttgcagtatttgcattcaagtgtactcagaaagactaaggttgtattctagttttatattacatatagggtgcccagccctgtgatttagaaagtgtagacacccgataaatagttgttaaggaatatacttgtatgtaggagatgtatagatttcataatgatagggttttttttttcattgtaattagaacttcaaaaattgaatcaaaacattttctaaatgttgtgagcatttgagacaaattgattgttgggactgtttctcctcctttatcatgacaaatattttatatttttaccagcaatttgtattttccttcaaacaatctatttcttgttatgttgccatctgtcattgtgtattagggaaatttaaagtctttgaactatggttttgtcatccaagaagttggattaagttatatgtgatatatcttctggtatggatttttagtaattagtcaatttcatgaagatccgtctctttagctttctttcttggaccctcctcaacgtttttttcttctatgctttattctgggaagagtttgcattatctgtcatactgacattcttcacaaacttgaatcagggcctgggtctctccacaggtgctcattcacactttccccatggcttctctgagactttgtttaaaacccttttctagttgttgctaggcaaaagtaaacaaagcacactcaataacaatatttaattgattgactaagagtgttaagaacataaaaaacagatgataagatttaagagttgaagtaattatatattaaccatgtccaagggttatagaatggtggcctgtaagagcccaaagggactgaaacagaggctcagaggggtccagggaattaccaaatgccacaaaattcttagctgtttaacttgtccttggatgcgtaaaatactgacttccaggacagtgctctttctgtacctcacctcactggacctgctttgtcagctcatccatagatctgcagtaaaccttattattgctttactttgaacgttgatgctctaaagcatagtgactactgcttaacagtaatttatatattataagatatcacaaggaatgttattgctttctgaacatttaaatttaaaaatatgggacaccctattaaataaaatgactttcatatgacaaatctatttccttgttggaaaggccattcctggtgcatttaggatatgtagagattgttgggatagtttagatcagtgattcttgaccttttggaccaaatgtctcttggaaaatctgatgaaagctattggacgtttcaccaaaaaatgcgtatttttacgcatagatgtttttctcctctgcaccaggccaatgttctggaaacctcttctgcgtcactgtcctaatagtgtaattatttttagctgatactgagacttcacgaaagtggtgaaaaatatttcagaggattcattatatcattagacagttactagtaatgaatttttaaatagaccatgatgaagagtcaaaacattcaggctggacacgaaggcacctacatttgctatattagctctatgataactagagaagtgaaattgacatgttttgaaaagaaagaatttgggagaaaacattggtgaaggaaatggaaggctgtggtggttgagatttcttttagtagttttcaaagattgtttatttaaagtatcattagcccatcgtctattcagtgacttgtgtgaggcatagaatctgtgtaacctctgtgtcacaggggttacagagatgagcctgaaatgctcttcaaagttggttcagaggtccaatgtcagcacagaggagggaggagttaattccacctggaggaagtgacaaggaaaggatttcatggaggaagtcatactcgacagaagtgtcatagattttggataaattctgaaatgtaatgaagatgacctttaaggtgaccgtttccagattaaatgagttagcttggagctgtggcctaagttgaagaccattttcttgcttgtatgtatctgttcattcattcagtaaatatttgtcaattgtgcatcactgtatgccttgagtaaaatttgtggggtttgctctcgcttctctgctttgggcatattgcctcaaaaataaaatgcctcttcgaaaatctgatgaaatctgattgcctcaaaaatgaggcaatatgagttgatatttgactatactttttattgcccttggagtgttcagtccaagagtccaaatgtgcagttatgtaagaattcttttggccagagaccacttcactgaataatagagaattaacaatgtatcatgcagtgtactctgtgcaattcctaggtgatgatgcatatcaaagttgaagaaagatgtcactttcgggaataaagagaaagaactaggcaggtatacaccatagctacactaaaaccttgctccaacatgctcagcttgtgctctgggcattgttcacctaggaccttgcctttgggagtttattatgctatttgaacaatcaatcttatgagagattaaacaagctttcctaaagtgtgttttcaggtatacatttttttaaaaagcagagggtggataaatgctgagttaaatgggtctttttgctgcaggacttctcaggaccatatgccagtgtgcaccaggcatttcccagaaggagaaacagtatatggtgtctcaacttccatgaacattgatacttctccccagagcatctttcttgaggactcatgttccgtaaaacatttagggaactacagcccatcctagtgtgcagagtccaaggacagcaatatggagtgtccctggtgcattttaagtttcaatgaaagattggggcgaataatgaattaaggggtaattgcattccctaacttgggtgagatccttttatctaaagtgaagatgaatgcggaacaataatcaaataaattaggactgtctagacaaccagtctgttgaattcagggcaaattgaagttaattgttagctttcatctgtttattacttgagacagccctatcttttttagcctatcaaggggattagaagatttggcctttcctaaagcagagaattatgtatctgaaaggaagtacaaaatacagataggcataggtatagattagatagatagatagatagatagatagatagatagatagatagataggaatggttttatatatcaagggcaagtttgtgtgtatattgatattctctgttgtcttctgccaaaaagcacaatgctggttcaaagatcagagaatgtgctagcagtatttagaatctgctgacttacttaggcgtaaaggttaaaatgacatgccaccgtatccttgtcaatgtttcttagttgcttgagataaatatattctaggtagcattagaaacttccctgttgccctcatccacataagcatgattttgttttcttagtatgtggttcttctattcattgcaacaagcatttgggcactgcaacgtgcaggctccatcctagggatgcaaagatttgtaacacatttctgttttttcataacacacatatagctcatttatgcatctcaagattaatgcatctaaaacaagacacttgatatttccccataactcttcttcccctggctgtttccaacttaataaatggtacctctatttaaccagttgctcaggttaaaaaccttgaatccattcttggttcctctctttttgtcatacaccacatccattccagcagcaaatcctattggctgtagcctcaaaatatgttctgtatctcacggcttcccacaacaactgcaaccacagttatccccacccaagccgttgtggtcttttgcctttgtccaagccaccatgatctcttggccagagatctgcctctttactagtctctgtacttccttcctcttttgccccactacagtctgctttcctcacagaaaccaggatgatctttaaaaaagttaaaataaggtgaatcactcccctactcataagcctccagtagcccccatcatacttagaccaaaacctagagttttgatgtggtctacaagacactctgtcacttagtctcttcttacttttctagtctcatattctcctcactaatttccttttggctgtgctagccttactggtctttgagcacatcggcctttttcctatcttccccatatacttgcatggctcacttccttacttcattaagatctctgcttttgttctcactcataggtgggaattgatcaatgagaacacttggacacaggaaggggaacatcacataccagggtctgtcatggggtggggggcgggggggatagcattaggagatatacctaatgtaaatgacgagtcaatgggtgcagcacaccaacctggtgcatgtatacatatgtaacaaacctgcacattgtgcacatgtaccctagaacttaaagtatatatataaaaaaagatctctgctttaatgtcacctctcagatgcattcactgatgatcctgtgtaaaagcactccccacttccatggctcactctccccttactctgctttatttatcttcatagcacttaatatttccttaatagttcctaatcacttaatcgtaatatttattcctttatttgtctctctttcccataaaagtgtaagcttcatgaggacttagttatattcacctgtatcacagcacctaggatgatgcccgggactcagtaagagtgcaatattatttgatgggtgaatagatgaaggaatgactttagctaggtttatgatacttgtgaaggggtaagtatatgtacttgcagaaagattccattgttatccatgccttagatgcttctcatgaagacagcccacatttcatatatctgtaggctgtatttgaaacattttaaggggaaaaataatttggggtagcaaaaaattcttaatgtttgtgtgtactagttttctctttgcaaacacagtgatgttctacaggaaacatatatatgcagtacattcaagtgagtgtatattgaaagatgactcttcattccacttcagccccaagcactataacccaaaaataactgctatgatagtttattgtgtatcctttcagatatttactgtgcaagtatgaagtatatacattttttgctattctacaatgggcctatactatatacagggaatctcaactttgcttattttaccttatttatttcaaagaactttcatactttttaatagttgtatagtatttcaaagaatgcctctaccacatccttgtatgtagctcttggagcacataggtaagtttatatgtaagagagcttgctaggattgtaattgctggatcaaagggaggtccatttacagttttgatagctaatgacaacaaggttgaatcactttactttgccaccaacagtgtaagacagaatctgtttttctgcatccatgtcaatactatgttttaactattttcattcttcaacccaataagccaaaatggtaccttatttttatatttctccagttatgagtgagattgaacaatttttcattgaaaggcatttacatttcttctgtaaaagtttatgttcacatttttttaacctattttaaaagcatgtctggtcatttttccttattgacttgtgagaactttttatattttgaagaaatgaactctttgttgaatgttgcaaatattttctttttatggcttctgggttttgtgtcttgcacagaaagcattctttattccaagaatattactttagaaaaatctgccttactttattctagttttttaaggtttttatgttatgcatttaaatcttctgagtttattctgagtaaagagttagagagagattctgctttactttttagatttccccaaatcagatgtctcaacacaatttattgactaaaccaggatttacctactgatttgtataatttaggctatttctagaccatatgctcttatttctctgtctctctaatcttgtaccagcacaactctttctactgtagctttgtcatacattttaatgaaaagttgagctagttataatgctttttcaggaatttcctggcaagctggccatgctatttttccatgtgaactttagaatcaggctttctaatataaagaaaaagttactaatattttaattgagatttcattacatttgtagatttatttggaggaattaaggtctttataatactatttccttttatcaaaaaataaaaactatttttctgttcaaatcttctattgtgtcttttggtgattttgaggatatttttcaggtttatttttcagagctcttgttgagttgatgttgctctaagaagtgagcttatttttttccatcatattccaattcattgtacatagggtagatatttatcttttaatattaattttggctgggcatggttctcacagctgtaatcccagcactttgggagactgaggcgggcggatcatgagatcaggagttcgagaccaacctggccaacatggtaaaaccccgtctctactaaaaatacaaaaaaaaaaaaaaataccctggcgtggtggtgtgcacctgtaatcccagctacttgggaggctgaggcaagagaattacttaaacccagggggcagagattgcagtgagctgagaccgtaccactgcactccagcctgggcaaaagagcaagactccatctcgaaaaaaataataataatttttaaactagacaccttattccttgaattttctttttgtttttctttcattcatttattcattccttctcatcaattttccaggctaagtttccactatccatccactatgataattttctctcttctctaatttttatgcctcgtttcacccttatctaatggcattgattagtacttgcccaataatgttaaataaaattggtaatggtggaatttctaccttgtttctgattttaatgctactgttgtttcaccattaagcatagtgttcaagccaatcactccaaaagctctggaagctctcctaaatcactccaggcaagctggcttaaggacctccatagcaccttttttttacctttattgtaatctggaacacaatgaacttgagaatgtgtttatcttactgaacaatgttgacaaattctgtgtacatcctcaaagaagtacttttccacagatcgccctctgggaaacacagatttagagaaatacatgatcaacaataccaaccatagcataaaggagtttaaggattgagacaaaaccatgaggcttagaaaaaaggaggtcatcagtgaccttaaggataatggtgatgatgatagctcatactaatggtatatttaccaggcatcagtcacttggctgagtaattatacatgttaccttgtttaatcttcacattacccaccaaggcagaacaattattatctctgttttatagctgtggcaataggctgaagaaactttcttaagattatcacacagtaaataataaaatgtgatttcaaattgcactagctctatagcaggagctcttccacataatactaggagaataaatccagagcctgccccaggaatgttttgtttggccaattcattatgggatttttgttttgttttgtttgtttttaaactgtgaatgccttcagtaggcatacataccattgaatttgtgagtgtttttcaattgcagtctctgaagttttatgtatttaatttttattttattattattatactttaagttttagggtacatgtgcacaatgtgcaggttagttacatatgtatacatgtgccatgctggtgtgctgcacccattaactcgtcatttagcattaggtatatctcctaatgctatccctcccccctccccccaccccacaacagtccccagagtgtgttgttccccttcctgtgtccatgtgttctcattgttcaattcacacctatgagtgagaacatgcggtgtttggttttttgtccttgcgatagtttactgagaatgatgatttccaatttcatccatgtccctacaaagaactcatcattttttatggctgcatagtattccatggtgtatatgtgccacattttcttaatccagtctatcattgttggacatttaggttggttccaagtctttgctattgtgaatagtgccacaataaacatatgtgtgcatgtgtctttatagcagcatgatttatagtcctttgggtatatacccagtaatgggatggctgggtcaaatggtatttctagttctagatccctgaggaattgccacactgacttccacaagggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttttttcttgtaaatttgtttgagttcattgtagattctggacattagccctttgtcagatgagtaggttgcaaaaattttctcccattctgtaggttgcctgttcactctgacggtagtttcttttgctgtgcagaagctctttagtttaattagatcccatttgtcaattttggcttttgttgccactgcttttggtgttttagacatgaagtccttgtccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcaggctcttttttggttccatatgaagtttaaagtagttttttccaattatgtgaagaaagtcattggtagcttgatggggatgccattgaatctataaattaccttgggcagtatggccggtttcacaatattgattcttcctacccatgagcatgggatgttcttccatttctttgtatcctcttttatttcattgagcagtggtttgtagtactccttgaagaggtccttcacatcccttgtaagttggattcataggtattttattctctttgaagcaattgtgaatgggagttcactcgtgatttggctctctgtttgtctgttattggtatataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgactaattgccctggccagaaattccaacactatgttgaataggagtggtgagagagggcatccctgtcttgtgccagttttcaaagggaatgcttccagtttttgcccattcagtatgatattggctgtggatttgtcatagatagctcttattatttcgagatacgtcccatcaatacctaatttattgagagtttttagcatgaagtgttcttgaattttgtcaaaggccttttctgcatctattgagataatcatgtggtttttgtctttggttctgtttatatgctggattacatttattgatttgagtatattgaaccagccttgcatcccagggatgaagcccacttgatcatggtggataagctttttgatgtgctgctggattcggtttgccagtattgaggatttttgcatcaatgttcatcaaggatattggtctaaaattctcttttttggttgtgtctctgcccggctttgatatcaggatgatacgggcctcataaaatgagttagggaggattctctctttttctattgattggaatagtttcagaaggaatggtaccagttcctccttgtacctctggtagaatttggctgtgaatccatctggtcctggactctttttggttggtaagctattgattattgccacaatttcagatcctgttattggtctattcagagattcaacttcttcctggtttagtcttgggagggtgtatgtgtcaaggaatttatccatttcttctagattttctaatttatttgcatagaggtgtttgtagtattctctgatggtagtttgtatttctgtgggatcagtggtgatatcccctttatcatcttttattgcatctatttgattcttctctctttttttctttattagccttgctagcggtctgtcaattttgttgatcctttcaaaaaaccagctcctggattcgttaattttttgaagggtttttttttttgttgtctctatttccttccgttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttcttgttggtttcaaagaacatctttatttctgccttcattttgttatgtacccagtagtcattcaggagcaggttgttcagtttccatgtacttgagtggttttgagtgaatttcttaatcctgagttctagtttgaatgcactgtggtctcagagacagtttgttataatttctattcttttacatttgctgaggagagctttacttccaactatgtggtcaattttggaataggtgtggtgtggtgctgaaaagaatgtatattctgttgatttggggtggagagttctgtagatgtctattaggtccacttggtgcagagctgagttcaattcctggatatccttgttaactttctgtcttgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagatagctcttcttgttgaattgatccctttaccattatgtaatggccttctttgtctcttttgatctttgttggtttaaagtctgttttatcagagactaggattgcaacccctgcctttttttgttttctatttgcttggtagatcttcctccatccttttattttgagcctatgtgtgtctctgcacgtgagatgggtttactgaatacagcacactgatgggtcttgactctttatccaatttgccagtctgtgtctttgaattggagcatttagtccatttacatttaaagttaatattgttatgtgtgaatttgatcctgtcattatgatgttagctggttattttgctcgttagttgatgcagtttcttcctagtctcaatggtctttacattttggcatgattttgcagcagctggtaccggttgttcctttccatgtttagtgcttccttcaggagctcttttagggcaggcctggtggtgacaaaatctctcagcatttgattgtttgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttccctttgtgggtaacccgacctttctctctggctgcccttaacattttttccttcatttcaactttggtgaatctgacaattatgtgtcttggagttgctcttcttgaggagtatctttgtggtgttctctgtatttcctgaatctgaatgttggcctgccttgctagattggggaagttctcctggataatatcctgcagagtgttttccaacttggttccattctccccgtcactttcaggtacaccaatcagatttggtctcttcacatagtcccatatttcttggaggctttgttcgtttctttttatgcttttttctctaaacttcccttctcgcttcatttcattcatttcatcttccatcactgataccctttcttccagctgatcgcatcggctcctgaggcttctgcattcttcacgtagttctcgagccttggctttcagctccatcagctcctttaagcacttctctgtattggttattctagttatacatttgtctaaatttttttcaaagtttttaacttctttgcctttggtttgaatttcctcctgtagctcggagtagtttgatcgtccgaagccttcttcgctcaactcgtcaaagtcattctctgtccagctttgttccgttgctggtgaggaactgcgttcctttggaggaggagaggcactctgctttttagagtttccagtttttctgttctgttatttccccatctttgtggttttatctacttttggtctttgatgatggtgatgtacatatgggtttttggtgtggatgtcctttctgtttgttagtttcccttctaacagacaggaccctcagctgcaggtctgttggagtttgctagaggtccactccagaccctgtttgcctgggtatcagcagcagtggctgcagaacagcggattttcgtgaaccacgaatgctgctgtctgatcgttcctctggaagttttgtctcagaggagtacccggccttgtgaggtgtcagtctgcctctactggggggtgcctcccagttaggctgctcgggggtcaggggtcagggacccactttaggaggcagtctgcccattctcagatctccagctgtgtgctgggagaacccctactctcttcaaaactgtcagacagggacatttaagtctgcagaggttactgctgtctttttgtttgtctgtgccctgcccccagagttggagcctacagaggcaggcaggcctccttgagctgtggtgggctccacccagttcaagcttcccggctgctttgtttacctaagcaagcctgggcaatggcgggtgcccctcccccaacctcactgccaccttgcagtttgatctcagactgctgtgctagcaatcagcaagacgccatgggcgtaggaccctctgagccaggtgcgggatttaatctcctggtgtgccgttttttaagcccgtcagaaaagcgcagtattagggtgggagtgacccgattttccaggtgccgtctgtcacccctttctttgactaggaaagggaactccctgaccccttgcacttcccgagtaaggcaatgcttcaccctactttggctcgcgcacggtgcaccgcacccactgtcctgcgcccactgtctggcactccctagtgagatgaacccagtacatcagatggaaatgcagaaatcacccgtcttctgcatcgctcatgctgggagctgtagaccagagctgttcctattcggccatcttggctgccctccagtctctgaagttttataaactctattcattcattaataaattatttcaacaaatatttcctgagtgtccactgcatgccaggtactatgctaggctctggagatacagcaataagcaaaaatgagcaaagaccctattttcgtgtaggcttaattaaataacatacaaaaaatgtgtgtgtgtgtgtgtgtgtgtgtgtgtagtgccaggtagtaatgtgtactaagaagaaaaataaattcagggtagcagggacagagtgtgacagatgactatattgattgtctgcattgatggtggggtcactgggcattttttatgaggagtacactacatttccaggtttattcaagttaggaaatggagacatctgatcatgtgttgtagaaagaaaatcagaaatcacataggagctgaaaagggtggcatgagtctaattgaggaatttcttacttttctgtgatagaataatgtgaatattcttgaagaaataaggtaaagcaaatggccctgggagaggtggagaaggcagggctaagtgtggaagctaggttccaaagtgacagtatgcctgagatttatgccctgggaagcaaagggattatttcctcaaaagcttcattgcacaaattaactcccaaggtatgctatgtggataaaatcatctcctataccagttctctggggacagcaaccattttgggttgttggaagcattgcagaattggtggtaacacagtttctatgggcagttgctttaagaacctgaagcttgttttgaggttgccatggtaacaccactgctggctgcatacaacatctcacccaggctctcttgatctaataaccaggacccacattgccttgaactcccttaaacaaagtgtgcttttagcagactagctttttttttttaacctctctgataaatccatcaacctattttattttggtttctgtaaattgcaaattactgaggagagagaaattaggagaggaattgtattgttttaaactcatcatcccgatttagaatacttaatgcaaactaattaaagatctgcttgtgctatgatctgctattttcctgttttcaagtttttgcattttgaaatctatcatatctccttgttcacacaataaggccttaacaaactctttgtgaatgtagtttctctgacctctctactctcatagaaaaccacaggatactcaggagtcttgggctcttttcttcctaatgagctctgtttgccatggtttaggagaggaagaactctgagtataggggatgatagattttgctagtgttcacttagacctcttctctcaaaaacatgggtgagagaatcacaaatttttgacactaggatacttgacagtttggcccagtggtcttttaccaagatggctccacatctcctacatcccaatgatgatcataaacacttgctgatttaatagacaataatgttagtagcctgaaatcacactagtagtttgaaacccatgatgagggtacagatacaccatggaaatctaaatgctgtgaaacagtccccgcttcccactgctgggctggttgttaatcatttactggcatacctgtatcaaacccttcccttatcatgcgggtggggagtggtgagaaacaggcttcttatcactagattctatgtggccattaaatgatggaaaataaaagaaagggagagctgtaatgcataatgctcttcatttttgtttagtaatttatattactttggaacaagatgaaataaaagatttaagatgagatttttctctttgcataataaaatgtgaaaaaatatttgattacaaaagctatctttatagtagccacattttatttggtgacttgccttcagacttaagaatcttttctaacaattttatcccatttacaaaaaaatgctcaataaatatttcgaaagattaggtcaaaagcccttaaactaatctgtagggttgacaattaagatatcattttttttctataactgatcattgaattttgtagtgatgagggaagggtagaatgcatagtgagtgacacacaagtacaaaaaagagttggttataatccaagacttacatcttaaagtaggaataatttttaggttttgccattcaaatcagcagatagccacagttattacattacaaaagatttctgagctccaagtgtttgcctgtactttgacttactaagcattcaaaaatattttcctaacagcatcatacttttattttcatgttgtatatattttaacctttaagttatcgtggaaattccttaacagggtcttcttcccagtaaacatgcaaactgaaacattagcacccatttattcagcatcttagaagaaatatgcttaatatagtagattttcctaaataacttaaaccttaacccttcaaattctaagaccttttagaaaccatttatctgaaatcctttttaaatattttaaacatatttcttatttcttaaactaagaatttaaactctccttgctgtgatagggcaatcgtttttctgcaatgtagaaacaactactttcaccagcttttaaattttatttagttatatccttaaatgccaaactgcaaaatgacctttgtcactggtgtggtcattgtattggctcagaagccctgctcccccctccccttttagtttcctgagtagtgtttatttattattggcactgaaatccattcataaaacttgtttagagttacatactagattcgattttattaagactctaagtgagggtgtgagaaggaaaatccttcgcttttcagaagactttgttgtggtcatatcaggcacttggaatatggagataatgaaatctactccaagggatggttgtgagaggcaacaaggaaaggcatatgaaatgaatctataggatgctactgagaggtccctttatgcacacaactgctacaggccccaccactgttgttcaaagttccccaccgctccatccccttaggcagtgtggggagagccagtttcccctccttacaagaggagctgccagagcaattccagtagacccttgggtatatttatctacctaactggtttttagttaggttgatgaaagggaatgagaagagataaaacttttgcatctgagtttctctgtttttaaatatggagtattactttgagcctaaaaatgctcatcactttcgacttagtaatctcccttctagaacttaaccctaaagaaataatcagacataaggagaaagatttatgcataaacatatttttcatctcactttcatcccatttttacattagtcagcacaaactttggctgtgttccagaaaacatattgcgccaagactggcagacattggtttgagtttatttaactgtcaggggatggcttttctttgtgagctgattccacaaattcattacatacttaaatcttttatgggcatcagcaatgtaagagtagtgtacttgaagggctcaaaattgcacacaaacattagcagatagcagtgctggatattatggtttagacttaatatcttttaagatattttagatcttgtagacccaaactcatccttgatttggctatgtgtattctatgacattctgtatatgagtaaaatactgggttctgtgagagcaggcatcaagatagaactagctgtttaaaagatttattgtgggaaaagcccgtgaaggataaaggggaaggagagcatgagtagggaataaaaaaacaaaaaatagggtagtcctgtataatttcttacaatttggattttgttcatttcatcccagtagtattatttaacatgttcctctgtcccctaagtatcagatacagagggctgatcacattagaatttaatttgttccttccttccttctcccctctcctcccctccatcccctcccattccctctcctttcttcattcttggaaaactacttcataggtgatggtgtgtgcttccatcaagagtcagataacatttgtctcatctgtttttctgtgtgtgttagcagcttgattatcattatgctagatccattaattcattaggggttgcaaaatgctgacatttgaattatttctgtcttcacttactaactagcatacttttatacagagaaacttcccctcattagctatttggttgttttgaggttcagcgcaaataggaaacataggatgaatactagattttttcttttgcttaccatttttcaaaatggtaagttgattccttagcattttccaaaggtggaaaatgagagtttttgtgtttgtttagtattattatgaactcatggatttaagccattgtagttgttatctttatttgacactcaaattatttcatctttggccagtaggagtttatataggtaggctcctaagtctttttgacagaatcctagtagtctctgacagccttcttgctttctggtatgatttagtgttcaggctcatcttgtacatttcctgcctcaggtctcactaggtcacaagccatagttcattgtagtgagaattgattttttagaaacaacactgtaagtgttgggagtgttcattgctactgggtaggttattttttctagaccttttcattgtacaaaactaagaaatatttttttttaaagttagagtatatccagagatcatacttataattccaatttatatctaggactacagggttactacttcatctcatcattttttacatctgaatttctttatctccatgctaaaaaacctgcttctcagcaactcaagcctgattactcacttgttttatcacatactacaaatgtaacagccttgggataacaatgctaatactaggactagctaaattgttattgaaaaaaaatgtgaagttcttttttatctttaggatatataccattagaaatgaactatcaaatccgtgtattttaaaatcagttagaatagttctcctcctcaaccacttgtatacatatttaggtataatttgtatcactttactaatcttgtctctggtgccattcttatttccctctaccctaatataactagcattttctccctgtattatgtttatctctgtaataatgagaagtctatgagaagtataatgagaagtataaagttaactaggaactaagacagaatttgaagtacaaaaatgaatgtggatttaaaaataaatgtatgcacaatagcactatatatatatatatatttttttttttttttctttgagacggagtcttgctctgttgcccaggctggagtgcagtggcacgatctcggctcactgcaagctccgcctcccgggttcaagcaattctcctgcctcagcctcccgagtagctgggactacaggtgcccaccaccatgcccagctaattttttgtatttttagtagagatggggtttcaccattttagccaggatggtctcgatctcttgacctcgtgatccacctgccttggcctcccaaagtgctgggattacaggcgtgagccaccgtgcctggcctatatttctttgtgagctgagaggtcttagaagcaatgacaccccagtagcaatgagcacacctagaacccagatcttggtttctaatactgttctccagtaaaagggaccaaagctcaatgaagaaatgcctgattctaaggctgtggcagagaaagataagatgagtcgggagcattgtgtagtactagaaaggaaggaagtgtttaaacacacacacaaaatgataggggcatgtcaaaggggcataggagccaactaacagaactcctaataaccatagctggaagaatttgagcaacgaaataaatgacatagtgttggattataatccaaagtataaaacaaatatctgcgagtccatattgatatattaataagtaaatgattgaaaaagtcagtaagtgaggagaagagacacatctccagtgcagaattccaaataatttatatggatactctaccctcaaaaagctggaacatacttcccactccttaagtgtaggctatgcatagccttttacagtatgttaagatgggaaaaagaataactatagtggaaaaacttgacaaacaccacctcagccaggtgatcagatcaaggtcaacatcagtgataaatcatgcttgtagcatgcacccttgatataatgttaatctgcaatacttccttaatttttctggtattactatgttgggtttaaaaaatattttatctatcctgaaggcttttaattacaggtggaaacctgttctcagctttgtttgagctagtgaaaaaagtatgaagcatggtttctaccttatggtaacttagaaactagtgaaggaaacaagatctagcaagcatgtaatcaaaatataaatcataggacatgattatacaggatttttaagttgagaaaagcaaagcatagctatactgagacctggtgtagctagaggaagttttaaagaaaatagtctcttctgttaatactatcaggatttctgtatgagggaaatgatagggattgatttagaggctcaaaaattctctaaatatatgattatcaccagaaaacaagatatatatattttaagaccattacattttgtttctgttgaccaactgaaatgcaagatgactaaattagttatttttgaatcccttatgacagataataaaaattggtggctcacttaatcacagtgtggtcagaatttattagaaagacagcaaaatcattggattgtatatgataccctgcatttatttgatgtgtagacctggttaaatcttggattttaagcatttgaatgttacgttgctcttttttgtttttcctttaggactatctgctgccaaactcttgactgaatatggcgttagtgttttggttttagaagctcgggacagggttggaggaagaacatatactataagggtaagtgattttaatacttacatgtaatgtaatatctcactcaaactacaagtggcaccactggaaatcacagggctagaggaggtcttaagagttcatgcagttaagccgtttgtcctccatagccctaaagtactcccatcaaataagcgtccattctctttaacatgtacgcactgaagactgacagcttctgaatttcagtggagtgaattcaaaaaacatgagcaaataacttcaatacagtgtcataatttccatactagagacgtaaatgaagtgtgtagtgtctcagatggggtgatagtttggctgtactggaagtgactatacacccgcaatacacacagacacacacacacacacacacacacttagattccctatttatccaatgacacacaacttaatagaaatgtggtggcaaaaacccaaaaaaccaaaaacagacaaaaaaagaaatgtggtggctgcagtaagcaggaacaaatgtagcatatttttgcataacttttcccttggcccttgttccctaagaagtatgcttctgccagagatactcctcaggtcgcgtctggctacatgtaagaaggaagcccagttcttgctacatcgctgctttttttatacttcggcttacatcaccattctggaaaaaatgcatgctattatttactactattaagggaatggttgcaggtggttgactctgtgggtactgatgaaagtaggcagggagataatgaagagtgggaaggaaataggggcaaagatggaagtttttgcacataaaagtgggggagaaagggagaagagtcagagagaagtagtagaggcagaagaggaggaccagactagaccagcaatgggtaagtcagtggacgaaagaggaaggggtgctcaacagtcaactgacacaatatgaaggcaaacaaaacaaaacaaaacaaaacaaaacaaaacaaaaaccctcgcatttgacagaagttcattaattaatgagcccctttgctagagtacacaaatagagtgttaaagactagggattgagagtaaagacaaaactagactgttgaagtgactggaaagaaaggaagcatctatctaactagaagatgcttcagttagactaataacagaatggcgtaagcaatgcaaacatttgattatttcacagaagtctggtggcagatagtccaggctggtgctcttgctttttgctcttctttctgctctgatattctttcttttcttttcttttcttttcttttttttttttttttttttgagacggtgttttgctcttgtcgcccaggctagagtgcaatggtgcgatcttggctcactgcaacctctgtctcccaggttcaagtgattctcctgtctcagtctccagagtagctaggattacaggcaccccccccaccacgccagccaattttgtatttttagtagagacagggttccaccatgttggccaggcttgttgcgaactcctgacctcaggtgatccactggccttgaagcctcccaaagtgctgggataacaggcatgagccaccgcacccagccctgctctgatattctttgcatgtaggtttattgtcttgtggtaacaagatggatgctgagattctaagcatcaagttctcattcaaggctgaaaggagagtgaaagggtggcactagccttgtctgcaactaagcttttccttcgccaaaagaccccagcagacatttgctttagtctcattggctagagttgagtcacatggctaccctcagctgtcagggatcctgggaaagtaagtatttcacaatactaggctacataatggaagcaggcatgggagaggaaatatcaatggatactagaataacctacagacaacatttgaattaggatttcatagcagcgatttcagccacattgtaccatgctacccttctgtcatttgcttcctacctttttagatacagggatgtatctaggcctatttctgctttgctcagctctaagggtgctgtacagccttgctatgcaaagtgtcatctgtgggtcagtagccccagaatcaactgggattttgatagaaatgcagaatatcaggccctatctcagaactgctgaatctggatctgcattttgacaacatctccaggggacactatagaagtgctactctgtggcatttgtttgcttgcttgccttaaactaatgccaatccggattaaattttctgagtgctcccttagatgtagtccactgggaagctattggtctgggagtgaggagactgggattctagcctctgtactgacttgacatgatgtcttggataagtcctattagcactttacatctcagttttctcatctgagtaataagatactatctaaatgtcctcgaagaaactcccttccatcttcaaattctaattgaaggcagcgtgttatagtgcaaatgaagagctgcatcttctgcctgtatgcctttattagatatgattcttctgtcattttctgaaaaatattcctccactttggagatagttattaagttgtcccttagctctatttttcttatctctaaaaccttttggttattaaacaggagcattagtcatgttgcggattttcagttaagaacaagtttctttgtataagggaaatgagaattccaacatacttgtccccatctgtgttattggccccaattactttgccatgctgtgtcatttatatatgtcagcaccacacaggaactgttattgtctattcagcatgacattacaccccccttaggaatgtgagaaaggaatctctgaaatgcttggaaattaggacttagcatttatactccaaatgatgagaaggagagaaagagggctttaagaaacaggcatggaggccgggcatggtggctcacgcctgtaatcccagcactttgggaggccaaggcaggtggatcacttgagcttgggagtttgagaacagcctgggaaacatggtgaaaccccatctctactaaaaatacaaaaagtagccaggtgcagtggtgtacacctgtagtcacagctacttgggaggctgaggtaggagaatcacttgagcctgaaaggcaggggttgcggtgagccgagattgcaccattgcactccagtctgggtgacaggagtgaaaccctgactcaaaaaattaaaaattttaaaaaaggaaacaggcatgaaaattgtatttaataagaaactgaagcaaatattttttaaattgcttctaataacataatcaattaggataattttgggaggagatgccataaaagctactatggatctctgagtaccagaatgtcaaatttggtattacctggcaagctgttcagatgcgtcttccattagttcagaacttgcccgtttttcctaatgtgattcatccatgattcttcagagtcaaattaataaagttgaaatgcctgcagggctgccacagggttggtgtatgtttccaatattgttgcatgtttgtggcctcttcaaaggctgagtagtgagatctaaatcaagaccccaaagactgaggtgcaacacagtagaatacagtgttaccgcttctagtgtcttcatgctgaatttgaggcacttcatttagaacgttcttactttgtaaaggaacattctgcaaaatgcctcactctttttactgcttcatttaggattatttgctttaaagatagtgtcagcattctaaagacatcatgtttggaaactcccaggagtccccttgctgtctttgttaaagcccagaaatttattggagtactaattccagttttgttcattatatcttaaaatagttgttgtagattagaaaaggtttgaaggacagcactgatggttactaaaagagagaataaacattatatgagggcacattaaagaagtcacagaagcacttcatttctggtattatggcagaatggaaaccctaactcctcattgaaataagtaaaatgctgaatacaatatgctgtgctcatctgacatggaagttagaaatttgtagatctcctggatgttgcatagacatctcaaacgtaacacatccaacactagacttctgatcttccttaaggccgctgttccagctgcccatgttagaagatggcaacttcgaaaaaactcagagtcatgctcaacactaccagaccctcatttgttttgtcaggaaattccgttggccctgccttcaaaacatatccagaattcaacgcttcccaccacttccactgctatcccctggtgggagccaccattatatctctaggccagattactagagtaggctcctgattttcctgcttttactcctgccgcctacattctgttctttcttagtgcatcagtgagagtgagcctttcaaatgtaactcagattttagcatttccctgctcaagaccttccaacggctccccttctcactgacagccaaggcctatgtccttacaatgtcctgtgaggctttacgtgacctgctctgccaataacctctgtaacctcatcttcaatttttttccttgctcacattgttccggccactttggcctccttgctatttcttgaatataccagcagacttctgtattacagtctttagatccatgttgctaggagtttttgctttttttttcgagacggagtctcactctgttgcccaggctggagtgcagtgggacgatctcacctcactgcagccactgtctcctgggttccagcaattctcccgcctcagcctcctgagtagctgggattacaggctcacgccaccatgcccggctcatttttgtattttcagtagagataggttttcaccacattggccaggctggtgtgttttaatttctacacctggaatgtttttcagttatttttcgtcatcactgcattgtggtcagagaatattgtttcatggtaacaatccttgaggctcgctttataacctagcaagcacatggttaatatccaaagatcttctaatttctgcttgaaaagaacatgtagtctctaaaagctatatgcagtgttttatatatgtccactagaataagcttaactgtgctccttcttttttgtttgcttaatctattaatcacttttaaaagtatgttaaaaattctctgttctactgggcacttatctttggttcctgtcaaatgttgcttacattttgaagctatattactcagtttatgcaagtttaaacttggttagccttctggatcttttagcattatgtagtgacacttatttcactgagatttattttgtttaaggttttctttgatattaatatagttataacagcttacattagtatttgtatatctctttatctttcagttagagttttctttattctgactttttttcctttttttaaattttagattcagggggtacaggatttttatttatttatttatttattttgagacagagtctcactgtgttgcccaggctggagtgcagtggcgcaatctcagctcgctgcaacctccacctcctgggttcaagctgttctcctgcctcagcctccccagtagctgggatcacaggcgctgccaccacacccaactaatttttgcatttttagtggagttaattgacaaacttggtccatctatatttgttatgatttcttttttaaatgttttaactttattatattatggctttccatttgtcccactttaacagttttcctcttggtttctttctttccttcttttgggttaatggttttcttctttttgttttctttttaagttttttcttctacttgttcagaagttatatagtcagaccaatgtttttcagacaattttcctaactatattaacactcatacttaatgtagtctaaagtttatcaacatactatctttctactaaaaaatacaaaagctttcatgcttcagttgtgagcacccttcttccaatctgtaaactataaaagtatttcaagtttgtatgtttctcagacattattaattttattttattctattgttgatgttgcttaattttctttaaagttttgccagtatctttgttcactgtccattcttgaatctcagaccttttatttgtaaccattttcattctacttgaaacacaccctttcctccaatctgggtcctaaactctgtacacttgtcagcttgacaaaaacatagttctaacaggtaacaaattctacttagaatttctcttcctctttttttttctctcagaacagcaaagatattattcccctatcttctggcttgtatttttattgttgaagagtcactcgtaagtctaattgttgatttttttcagagtatgtatgatttgcctcttttgttttctgaaaaagaattgcttttaggagctcttttctttggtatactgcagtttctctgtgtctgggtgagaatttcttttttatttatcattctttggacctgttgggtttcttatcttccaacaatgctggtaaatcctcagccactattttttaatactacttaatattttgacaccatcttccatgtcttaactacctcctcaacatattttccaattctttatctttgaactgcattctagataatttattcagatctagcagtttactcactctttaactatgtcaaatatatggtttaatccattcacggagttttaaaaattttaattagtacatttttattgctagcagttattttttaatctacttgataatattttcagtttcttttcccctgctcctagttttaatgacttattttatttaaaatatattgcatagtacttttagattctgtgtataattcaactattatgaaatctttctggattattttttctgcttattttcttttggtgccttgtttgcatgtatgttttgtaacttttggctgtgggttgctaattttccatggaactttatctgtgtgtaaattatttgaggcataggggaaaaggacttaagtctacttctaccaccgtccttgacactttaaattttctgcccaagttttttcatatcatatggatagcttaaattcagatggaaaacataaataaagataagctttttttttccttttctttgtgacaatacttagagctgcaaaataatggaaaatataaagtcgtggatgcagctaaagcaatacttagaagatgtatagtctaaattcttccattagaaaagaaaaaggctatatatgaataagctaatcatgcaaagagttagaaaattaagagcaaaataaatccaaagaaggggtaaaaagggaataaatcaatgatgtagaaaatagacacccaacaaagaggatcaataaaataaaagttgattctttgaagagacctattaaagatacacaagaagtgtctgataagatttttccagaaaaagaaacaccccaaataaatacgagatcagagccagatgtggggctcacgcctgtaatcccaacactttgggaggctaaggcaggtgtatcgcttgagcttaggagcttgagatcagcctgagcaaccctaaccctacaaaaaatacaaaaattagctgagtgtggtggcacatgcctgtgatcccagctactcaggaagctgaggtggaagaattcatagagcccaggaaagtcgaggctgcagtgagccatgatcatgccattgtactccagcctgactgatagagtaagaccctgtctcaaaaaaaaaaaataaaaataaaaaagatgaaaatgaagatataattactgatgcaataaagaataattaaatgaaaagaagatgccatgaacattaaaccaacagttttgaaacatatatgaaatgtacatattgtgagaaaaatataattcatcaaagttaacagtgatttagtctggaaatagaaaagatgggtagtgctttaacctaaaaataaattaaatgtctagtttaagattttccctaaaaaaatcaccaagcctagctagttctacaggcatgttctatgtaatgttcaaagaatggatcactttatttacatacaaacctttctagagaatagaaaaaagtatgatcactaaggagattagcagtactgtaatgcaaaaaacagacaaggcagtagaagaaaggagaatcataggccagtctcaatattgcttataaacatagatataaaaattctaaacaaaatgttagcaaagcatatcctccaacagaaagataatatcacgttgggtagctccaggaaggaaatgttgaataatactagacaattttctggaaatagcagattaggtaaattataacaaaatacaaagagactagacaagttgcactgtatagacacacacacacacacacacacacacacacacacacacgcacgcacacatctttaaagcattaaagagccagcgagctaacaagatagtgaagaatcactgggccaacatctggaaaggattaacctacttttccctgggtggcagggggagttgctgaccactgaagaagctcccgaagctgagcagtgctttggacctagtgcaaagctagggtgacaggtcaagtccagagccccatgaagtgtgtactgatttctgggggagtgtttgtcaactccttgtgctgtgggttgggctgcatctaaggaccaagggtaaatggcaagaaaactaggccaaatgtgcatttcggcccagcttcaaatcctctcaggtactgaaaatggtataaagttatctggtactgtgagagtcccaggctgtgggcagaagcaaacataaatcctctctgagaaagatatcatcttcctaggattcaaatgatttctacatgttttcaagtgcaatgagtggcattcaacaaaaaataatcaggcaaacaaggaaaaaatgcatgacaacatgcttgagaattggtatacacaacaaaatagacacagaccctttatttattaaaaaaaaaaaaaccacggaagggttgcagctcaccaatattcaattattgattaaatcattggaactttccaattaataaaaacagctgaaaagcatggagaactgtatttatgagggaggaagtaaacaattttagtttatgatagagggtttgcatatttgtaaataatttagtgatatgtgaatctttttataccttcttgtattcttttcctatgacgcattctttcctggaagtgttttaaaatagcatctagagccatcaatgtggactgatttaagatttcacctggtggaaattagggaattaggctttgggtggctcctccagcaataacaccagacagaagctcacataataatttaaatgtttcataaaggatctaaactggcagaacatactacagtgttctttatcttttatgcattgtattgctgaattggccttaccaataactttaccaaatgatggtgcttagtgatgagtgttagacaggattgtgccccagttcttgagtggatgaggaaagattgccattttcagttgctctttataggggagatgtaaggcacaattaacttttaaaaaaataaatggggttatttttttacaagacaccttttttccaagttttaactaaagtcctctgaccaatttttctctttttgcagaatgagcatgttgattacgtagatgttggtggagcttatgtgggaccaacccaaaacagaatcttacgcttgtctaaggagctgggcatagagacttacaaagtgaatgtcagtgagcgtctcgttcaatatgtcaaggtaaggctgacttttcacccaagtgactgatagggaagcattttatttgagaaaacatttggtttgtttttagttatttttctttcaaagcaattgtaaaagtaggctcttgactttgaagtagtatttgcctttcttttcttgttttcttttttctttttcttttgaaaaaaatctctaaagtctcctggaatcactgcaggatattatgactcagcttgaccttcctccctgtcaccctcagtggccctcacaagctatcctcactcccagaatgggaggctctgggttccctcctaatgcatttgaaggccacaggggtgggggtggcaggtgcctgcaacagacatgtacacacacacacacacacacacacgcacactcccctcccccagctacaggcaatccctgagcaacctagggagcaaccctagagctccaaggaacacaagagtttgaggccacttctttagcctttgaactggttattcatcctcattcttacctggcattatttggaatgcttcatttcctctgtacctggccttcactcttgggaagtctagcttgtttgtgcagtttcctactgtttaaacaagagattgtttaaactctagccactgatttccacagctgttgccagtgtttttctttctcactgaagccaaacatggagtggctggagtctggaaacatgccttgagaaatcaaagttcccatctgacattgcagcctacttcctagagctagtgtcactgaggaaggggtcatttactcattctaatgtcaggattcccacaccaataaccacatcatttctcaacaaatacatcccttcccctactccacctcgggcaataactgtgggtccggaggctacagggctttgggtgtgtcctgggagttgaggatacttgtgacatatgtacactgataaccaatcaggagagaccagaaacctttgtaaactctgatagccacatggtttgagatgcttgggatagtctggtggtgacagatgtgaaaaagcaaatcagtagtctttttattcttttctttttacctttaagctctgttggacttgaaaatcagtagtctttagaaaaactgtgggttcagaggtcaagggaggaatgaagaaagtataaaaaatttcacaaagtatttaggaactctggctacaacaggctgtgatcaaaaaggaaaaacccctttgcttcctcattttctcttttctgcactgcacagtgtttccatggactagtaagtaataacaacagtgagaataatagctgctaacatttattaagcatttttacctgtattctcacatttaatatagggagagagaccaaaccctttgcgctcaactactaattaaacagtcatgtaaattcactctccactccaactgggaagcaaatgagtgtgatgattatcttggaatctgtgcagattcatgctgataagattcagaggctgagaggtttttagtttacctggaggctaacaataaacaacaactaaaagctttttatgcatgaactcattaaatccttacatccaccctgctaggcaggcattatcatccccattttacgtttgagaaaccagaagttcaaagaggttaaagtgacttgacaaggctataaaactcctaaaagtctacctaacccctgagtgcatgctcttcattatcccgatatatggcctagaaaatgaaactgaggactctgaatggagatgtgctggacctccaatgtttgtttgtcctcacacacatctacagtaaggtatctcactgtcaatatcactgaagtctgggtcatatgatgaggagattcagtcattgaaagaccactttttttcctactttcttactcttcttccagtttcatgttccttttatgtacattttaaaaactgggaaaaactggaaaaaactggaaatttacaagtatgtcctcaagctaggtacctgctagtctcccagccacgcccagtctaaaacttgatattgggctgggtgtggtggctcacatctgtaatcccagccctttgggaggccaaggcgggaggatcatctaagaccaggagttctagaccagcctgggcaacatagtgagacctcttctctatgaaaaattaaaaaattagctgggcatggtggtgcacatcctgtagtcccagctatttgggaggctgaggcaagaggatggcttgagcccaggaggtcgaggttacagtgagccatgatcatgccactgcacttcagcttgggcaacagagcaatatcctatctcaaaaataaaaataaaaaataataaaagtaaaacatgatgctaaggtgatagtttgaaagtggcacccataggcagcttttgtaagtaatttagctcctcattgttcttgatggaggcaaggtggagttaaaatgataaagttctgtttgagaattttgactttgcctgaaagtgatcaacagatcgtgacatgctatccaaacttcctaacaggaccttacaaattacatatcttaagtgttagactttctgatgtctctgaaattttctgggctttactgggaaccctgctttctagaaatccagatgtaattgttctgtactttaagaaggtggtcctgctgcaagctttaatagaggatgaactaatggaaagacttaaggagatgatgcacgttacattaggtgcctaagtaaggaaatgttaagagtagcatccagggtcccttttttgattttgttgctgctgctgagtcccgctgtaaggttaggtccacactaccctgaaagtcctgttcctaaagaaaaaacaacttcagctttctggaggggagaactgctcaactctaccatatttttatttcacaaaaatacaaatatggctgtgctattgcataacctactggacaaaggcatcttgccatggcattggacttggtagcccgaggctgctttcaggaatgtaaggcagaaaataaaataaaaacaaaaaaagaggctaggcgcggtggctcatgcctgtaatcccagcactttgggaggccgaggcgggcagatcatgaggtcaggagatcgagaccatcctggctaacacggtgaaacttcatctccactaaaaatacaaaaaattagccgggcgtgctggcaggtgcctgtagtcccagctaccagttactcagaaggctgaggcaggacaatggcgtgaacctgggaggcggagtttgcagcgagccacgattgcgccactgcactccagcctgggtgacagagcgagactccgtctcaaaaaaaaaaaaaaaagaaaaagaataaaaaacaaccaaacaaacaagaatgcaaggcattgttaacctctggatctttgccattgcatggccatgcacatcaacacaatggtaatattagaccataattattgcatatgcagcacgtggcaggtgtgtgctaaaacacataccgtgcctacactttggacaacaaatggcacctttaaatcacagccgctgtggttgatccctcaaggtcagtaccgctcccatagtaataataatgactacctcccctactgagctcccattatgttccaggccctgtgccagggccttcacctccattatcttacttaaccctcacatggatcctaagttaggggttattgcgccatttcacagaaagagtctgaagttcagaggcccagtaacctgcctaagagagtaagggaattcagattaaggtcttttgactttatgctgtctcttgctagtccagattctactgtcagggactgtggactccaggaagctgccttacagtttgtgcttgtcctggctctttctggcagctctcttctgatggtcatcctgtgtccatcattgtgtccccatatgcagtgctggtgaccattttgctcaatcttttgacccggaagcctgaaagagcagtgttaactacctgctatgatacaagcactgtgccttggttattgtttgatggatgcagtaactggaaaacagccatttaactgtcagaaaataaagattgaagctctattttgaattttagtacttattttcaaatagctacacatttaagatggtaagcatcattcttttcattgaatacttaatctcatcgaatgaaaagatgaaaaatagaaatatatatcattaaaccatcctctcacatactttaacctttcagagaatacatattttcaaccaaggtagacaacaatgttaaggcaaaaaagtagtgggttggttaaagtttagtttatttgatctgaatgagtgcctttttgctagtgttttccaatacatcatatcatttctggaatgagaagtactcattgtagtagatgtttttatgattatcaggaaactatattagggaaaagcaggaagatatttagttcaatattccagataagatgattaataaattgtatactaaaagtaactctacttattttaaaatatcttaactctcactgtttttctccacttctaggggaaaagtgggtgtttccccaatgtgatagtgtattgggttaataatacaaattgtatttgtgacattttctgcattgctttttgacaacttcagctttcataatctaatacagtcaatattcgtttttgtaaataacactgaagtgaaaaggaagattgccattttctagataaaccaatcaataatctttgtggcccagattgcttcagctcttaaattttcccaatgcgaaaccttaaagaatgtttaaattgtttaaacactgtcaacagtctgtggcacatctagtcccagcttactctaggatggtttttactattcaccaaggaactactcgttacctttgttagattgtgtttacagtgcaagttttagcaagacagtgtatagttccaagcctgagcctctcagatggatactgaggatacaccttagtggtgtttcctctacctgatcccttccttttctgagactatgcctatctactacgttcatagaggattcacatcgatatgctaaattcactcattgcttaatatttatatttatgtatttgataaatatataagtatttacagagcaaaatctactctgtaccagatattgttccaagctgcagatagagtggtgaacaaatgatcaaaatttctgccctcatggtccttctaatctaaagagagaagacaagtaaacaagaacagtaaataaatattagctaacatttttgcctgtatccttcatggatcttgtgaatagaatccctcttctaattctggtttagaagatcctgattcttatataataggttcctgactggtttctacagtgagcagcttttatgaattttgtgaatttgacatgcttttattggggagattatatctgatctgtgaaattaacataaattaatcatatcattgtgaaccttaaaggtagattcttaaatggcatcagctagatatttttacacttgatcttagccaaaaagccaagaagcagtagctagatatgtttaaaacattctctttatcggttgcacatggtggctcatgcctgtaatcccagcactttgagaggctgaggcaggaggattgcttgagcccaggagtttgaaactagcccgggcaacatagtgaggcccccattgctacacaaaaatttaaaatataattttaaaaataaataaaataaaacattctctttatcagttcttctcttctgcatggcataaaggaagcagctggacctgaatgccaagtggattgattcattacttgcattagtaaataagatgctccatcattatgagtgtgtttcattgagttgtggagatcttttgttaaattttgcaatgctgtgtcttgcagaaaaaatgaaaatgttggattccatttttttttttttttgctttccatgagtttcctgcacatcataatgcaggtagggtgaggggtatggagagggagaacccagccagaaatggagcaaggcattttgcagaggctacttcaaaggagaaattgacaattacatgcattctcacgttcttcctgcttttcacgtcctctctaaataaaagtagagactataaatatataccacccatttgtttttagagagtggtgtgataaagatttatttaaaacaacataggctttgctgacagtaacagctcagcaagaatttttttttttctttttgtattggttctattcttcccacagccctttactccaggtttctatgccaacgactgaaatcaaaggcttttcacaatgtgtatgttctggaatactaagtaaattttgttgttgctaagagggaaacttggttttagccagcaggccatgtagaaagcagagtttgtcttaatgcttaccagatataacccctcacttctaatagaatttgacccatggcttataatagaatttcttttggatatgcgacatttcattttaagtttcttttagtaccttgtccatactaactcacagaagatatttcttttatcttcaaagaaagatacattttcactttcaacctctctcagaaggaaactcaagaagcggaaagtgtgaagtctttgtagggatgttgcttgttgtatatttgcctcctttcttttaaacacctaaattcatccctcctgatgccatgctattaatattgccttccacctgtaatgtacctatacatgttttacctcacttgagcttcccaatggtcctcagagtaaaaagcattatttttcccaactcagagagcgtaggagccaaagtgtggctttccagctctaagcccagtgttctgtgggttacatcaccttgttttttattccaaagttaacttgtgaacccttctagtaaactgctccaagatatgacaaaatcactttatcccaacaggctctgaagttgtaagatgcccctttggaaacagggactcctgtggatatgggggtggtcgttcatgggagctgtatgtgacacagtttatatttcacagttcacagttcatagttcacagtggttgtacatgggagctgtatgtggcacggtggcttctcttctcttgcaccctgagctgtagtctgagaggtcctctggccttcagtgagcacctggcagctaaacagcccccagtgtgtcccagttaggctcagcaggctgaagaccacagatgtattctattattttgttaaaatactaaatctggaggtctaaggcatggtttgaaattgctggctatatattatttttgttaaatgatccatgtaaacttattattcaaagtatggcccaagtattggccagtattttatgttataccattatatcctgcctgattttaaaaataacaaaaaaggaaaggatttaaagtggttcttgataagtattacaaatttggataagtcagggtagaagatagaaaaacaaaacaaaacaaaaacaccagttaggtaaggataggcaagtagttacaggcctgtgctcatgataagaaattctgttttgatgatagaaatgaggtaatacagaagggattgctttcttctctcaatcacaattctgagtaggttttaaaagcagagaggctaaaaatgtttacatattttcagtttgatctatccagtatccagtataaggatatatgaagatagctggtaaaaaatagtttttagtaactttcattcttttttccccctcactttggaaagacttcatttgctgcttgtgagttcccagagagcttaatggcagaattcctcttaaagctttgcactgtttagagagctaggtcagcattagccatctcctctcagaggctccttcttcctataaactctcaggattacatctcagatttggtttcaaaaatataaagttcctactcagtgacaacccaatatatagcaaaataagttaattattagatttttttcttaaaaaatggtaaagtacactaacataaaatttatcatcttcaccaattttaggtgtacagttaattcagtagcattaagtacatccacattgttgtgccactgtcgccaccatccatccaacagaacccctctcatcttccttccattcatttctaatagggactaattcactacaggaattgtttctaaccattcattgagaagtaacctagcatcaccctcccactggcagcacagaaagggggttaagtcagacacaaaggatttctctcacactcaggctgagggactttgtgatcacacataatcatgtagtgcctcagtatttgggttaatggccaaaagaactttgtgaatggaattaaacattatatgagcagcttcctcaagagaaattgctctagtctccataataactgaactcctggaggttctgacctttcaggttaaaatgtagttgcctctcagaggttaaaatctcctccttcttccttgctttctacttccttcctatttcttctcagcaacccctgtcctcacctcagtggcatgcacattactccaatcaaaagactcaatcattgatctttaattttcaaacttttgcaaagtagccttctaacagttgaaatcttaaacagcctctaacgtccaatgaatcccatatctagtccattctgggcacttcctgaagaagggaaattcagttgtctcatgatcacatgttgagccagctagaaaaccttttctgtcattgcctcatcctgctgcctaataggatcgatgctgccatgtaaccctctgtatcacgtgcagactcaaacctttttcatttctatgtcaaattcaatgaacagataccttttgaaaacctgctgggccacagagttttagtaagtgacagttattcctactttagagataagagaaagttataataatgagagtggttcaaggtcctacagaagtgagagagaaagagggacaggcataaaagcctagttaattactaacctttgcaaacacagagcttcaaactgaaaagagacaaataatgataataatgtcaatacctgatatttgacagtccagtactattttcataacacttcattttagtttttgctttgtgtttgggttttatgtaaccagaagaagaaaattcttgatggaatcacagaaaacttgagagttaattatagttcagtgtagtgaatgctttgatcctgaaggctgtgaaactgaatcgttttcattcagaaaatttctcatgtcaggtttttcaaacaaaaagaatgattagtaaactattctattacctttcattcccatagctctcctgtaatttgtaagactcaaatgatacacactgaaccttgggctgagatttaattttgtatatttgccaaagtacacagtagcctagtttccatagccatatctagcagataaatgtctctgaaaaaaaaaatcaggcttcagagacaatgggaggaaatcactgtggctcacacttgcggaccagcagtgggtgacaaaagtggaccctgggacacagacatgggtgcagtcactaattgacataattatttgagcatccaccagtcgagtagtcctgagtatctgtgacttttcctaatctgtagattaaaaaaaaaatactattctgatgtttaaatgctgggaagatggtgctaagagtataatggctcttagttcatccaccctttcattccatgccatcaccctatctctgccatcatggttataaagccatcactgaagtaacttcatctagtagtagggggcagggccacatcctcccagacactgtgatacacaaggtggatgcactcacttaacagcttagctgacaagaagttctgctttgccctttgcccctctctacctgctcttatgtactttctcactgcactgtcttgttacgaggaggacgggctaagggcagaaactcagcatgaagcccatgatgcacttgcaattttagctagatatacaagcaatttccttcctttctcctcgttgttgtggaatgatgtgcccttttgtccagaagggatacaaatgacattgtattcccatgtgtaacatttggaaaataaacattctggttgtcacagcttctatttcatcgcatattttcctgtgttatgtcatacttctgccagtgcaagccagaatgtgaagaatgcctaggggaatatttctcaagtgttttctaagcaacattaatcttaaaaatactttgcaaaaacagggcatttggtggtcagataaactttggaagtgctccatatcctatccctgtctttgatagtcaagatgcccattaacaaattaggagtcctaggaagcctggcaataaaaaaagactattgaacacaaaccaggatttcccagacttatgaccatggaaactattttcatataacacctataaagatcagagtaagagatgctatcacaggaagtgtttttagagatttaggttcacaaattaccaaaactactcgggaataaatagaaaattgaatagacctataataaggaaagagattgaattagtaatttaaaatctcccacagaaacaaacccagacacaaatggctttactggtaaattttaccaaaagtttaaagaagaattaataccaattctttataaactcttccaaaaaaatacaagaggaggaaagatttctcaattcatcctatgaggccagtattatcccgaataacaaaaccaaagacatcacaagaaaactacaaaccaatatccctatatagagatgcaaaaatcttcaagaaaatactagcaaactgaatctagcaatatattaaaaggtttatacaccatgactaagtaggatttattccaggaatgaaaggttagtttaatatacaaaaatccaataatgtaatgcaccaccatattaataggatgaaggaccaatagcacgtgatcatctcaatagacggagcagaaacatttgacaaaattcaacatccttttatgataaaaccactagaaaaactaagaatagaggagaacttcctcaacctaataaaggccatctacaaaaaacccacagctaccataatactcaatggtaaaagattgaaagctttccttctaaaatcaggagcaagacaaagatatttactctggccacttgtatttaacattgtactagggattttagccagggcacttaggcaagaaataaaaaaaaaaagaaaaattgtatttgcagatgatgtgatcttgtatatagaaaatcctgatactgactaaaacaattcatagaactgttaaacaagttcatcgaggttgcaggatacaagatcaatattcaaaaataaattttatttctaatacagtagcaatgaacaatctgaaatgaaattaagaaaacaacttcacttaaaatagcatcaaaaaacaataaaatacttagcaataaatttaaccaaagaagtgcaagacttatatacctaaagctacaaaataacattgaaataaattaaagatgtaaataaatggaggcatcctgtgttcatggacttaatattgttagggtgacaatacttcccaaattgaactacgtttttaacacaatccctttcaagatcctagctgacagtttttgcagaaattgggagattgatcctaaaatgtatatgtaaatgtgagagacccataatagccaaagcagttttaaaagagaagaacaaatttgaaggacccacacttcctgatttcaaaaattactatgaagctagtgtgctaaaacaatgtgtacttgtataaaaacaatgtgtacttctataaggataaacatataggtaaatggagtagaactgtgatttcagaaataaacccttacatttatgcccaattgatttttgtcaagggtagcaagacaactcagtgcaaaaagtaaaataagttatttcaacaaatgttgttggaacgactggatatccacatgcaaaagaatgaagctggacttcttctcacactatacacaaacattaactcattttagacctaactataagagctaaaaatataaaactcctggaagaaaaaataataaatctctgtgagttaggcagtgatttatttgatgatactgaaagcacaagcaacagaagaaaaaatagataaattggtcttcatcaaaaaaagtttttgaagtgttgtcatttgtataccatcaagaaactgaaaagacaatccatagaatgggagaaaatatttgcaaatcatatatctgataaaggacttgtattccgaacatataaagaactctaacaactcaataataaaaagacaaacaacccaattcaaaaatggacaaaggacttgaatagatactttgccaaaaaaaagatatgcacatgatcaataagcatctgaaaagatgatcaatgttattagttattagggaaatgcaagtcaaaaccacaatgagatatcccttcacacccaacaggatggctgtaataaaaaaggcagacattaataagtgttgtgcaggatggggcgacattggaaacctcacccattgctggtagaaatgtaaaatggtgcagccactttggaaaatagtttggcagttcttcaaaatgcagtgtcagagaaagaagagtgactactaataattaagggcttcttctcagggtaaagaaaatgttctaaaatgagatgtgatgatggttgcatgctctgtgaatataccaaagaccattgaattgtacactataaatggatgaattataggatatgtgaatgatatgttaataaagctgttaaatagctatttgtcctcacaatgtgatattttcatcttttttcacacttcctgtttctcctgagttaatggcatctgtgaaagaggaaaactatttttttaaaaaactctgtcaattatctttaattacacaaaagccgccagaagaactcattattgtttctatcttaactgttttgtttgtaatttctgtatataactagaatcccttggagaagatgacataaatttcttttaaaacccttcactgttggggccaggcacagtgggtcatgcctgtaatcccagcagtttgggaggccaagacaggaggatcacttgagcccaggagttcaagaccagcctgagcaataaagtgaggccccatctctacaacataaataaataaataaataaataaataaaaatacaaaaattagccatgcatagtggcacacacctatagtcccagcttacttgggaggctgaggctggagaatcacttaaacctgagagtttgagactgcagtgagctgtgatcacaacactacactccagcctgggtgacagagaaagatcctgtcaaaaaaaacaaataaaacccttcattattgatggtatggcatcatttatatctgagtttaatggttctatttttccagagataggactacacaattcaggcgcccattgcattggtagctgtacaagtcttgagacagaggctgagaatatgaagtgtcaggtcataagcaaacacataggaatgtgctgccagcccttgaaatggtgtgagaggttatagataatttggtattcataaacatggagcagaggcatgaaaaatgtaaaccataagactgtgccaatataataacaaatttgagggtggatgagttccccagggaaatgggaaaggggtgggcagaaggaaaggaaaaggctaaggatcagactctgggggattcagtggatcatagaaggaggggtcttggggaactaggctgaggcttgggacaactagcactatctgatggggtggtgtcagatgcagccaagtgctaatgggatggatacatcccttcatatctggctaaaaggagctcattggtgaccatagagaaaagggcatccacggacttttgaggatacaagtcagattttagaaaacagaaggatatgaaggcaatgggggcatcatttgagtgggactgttaaaagaatgcaaagaggatgacaaatgaaaaggacagacgtctccatgtagggtatgaaggctttttctagatagagtgaagctatgtatgtttgaagagagcttggatacctgcatttggaaagaggaagataatgcttttgtaaactattaatacaacacaaaactaccatcctatttaatgggtctcttcttagatgattttaaaatttaaagcattgttataaactatagaaaagaaatcatcaaaagattcatcttacaggctttgtcacaaaacaatgggactagaagggtctcaaggtattcatataagctgtacaggcatgtttctaaattaatctggaagataactcttttattttccagatgattaaagaaggctatttggcagcttccccagtgacttatgatactctaataacactcacttccttttgcttaactcaaatataaaagtacagagagatcaaactctccaacgtgccaatcaggaaatgctattttgcttactataaacttagcttatcttataggaccaacaataaagaattatgtgggagccataaactgccatctcctggcaatagtctcctgttattgtgaacattagtagattgaagatgtagtttctcaaagtcacttaagtgttttggggcacggttccagggacattgcgttctgcttgacataaacaatttctgctgtatcaaagacactgccctttagagattaaaggccactttggaaaactagtaagctttcagagtgtaggtacaaaatgaacttgaccattacactagatttttctcctttaattttaaagagcagtaatcatttggaagtattcccagagcccctgcttcaccctcttaggtcatgaaggcattccttactgagaagtggcttagtattgagaaactgctgacaccttggtgagaatactatagaaccacattttggagactgagagggtccacactgtcaggcagttctcactcagccaaaagacatcttccaggcccccctactgcactactttagggattcacacatgcaaaagtgttccccacatatgtgcatttctttttagcaggtttgggttttctgtgaaacgagaacagagaagccagaaactgataggggtgaaactaattgatgaaatcctttatcaacagcaaagaagtttatgttatgggcctttatggtcttcttgttgtttttttttttttttcttttgagacagtctcgcactgtcgcccaggctggagtgtagtggcacgatatcggctcactgcagcctccgcctccagggttcaagcaattctcctgcctcagcctctcgagtagctgagattacaggtgcctgccaccatgcccggctgattttttgtatttttagtagagacgggtttttttgtttgtttgtgtgtttgagacagagtcgtgctctgtcgctcaggctggagtgcagtgacgtgatctcggctcactgcaacctctgcctcctgggttcaagtgattctcctgccccagcctcccaagtagttgggattacaggcacccatcaccacgccctgctaattttcgtatttttttaagtagagacagggttttgccatgttggtcaggctcgtctcaaactcctgacctcaggtgatctgcctgtctcagcctctcaaagtgctgggattacaggtgtgagccaccgcctcttcttttaaaatattccgtggctcccatttctaaaatgattgccaggccagattttcctctttccttgaactctttacttctcctgccaccactgtttatcaaggctcagatcaaggggtctttggaccttgtgtgaaatcatactcaagttggcatctttctgtgaagaacttcgttaggaatgtgggacacattttgttgagttatatttataattcttttctttatgttcccagactattgagaatatttatttatttatttatttaagacagagtctcgctctgttgcccaggctggagtgcagtggtgcaatctcggctcactgcaacctccgcctcctgggttcaagcaattctcctgcctcagcctcccgggcaatatttatgttttttaataaaatttttttccaaagcaaagatcagttttgcattagactattccttgactatacgtacattttatggaggaaaatgtagatttttccagatttcagttaaaggaggaattataacaaggaccagctgctctgaggctgcccctgagctattacttaacctcagcccctctcttctccatagctatttttgttttctatgtaaaatgtctttgcccatttctctcagagtatgtattagcattttccaaagctgtttatgttccctcagtggtcgtcttccacccctgaagcttcttaagtctctatttttactccttagaaacagaaaaggtacatgtggaagatttctaagtttcacatttcaaagttctctttcttttgggaaagaaaaagttggaagtttaaaaatgcctctagaacaaacctatctccacattccatcaactgtataggaggcaggaaagcatgttttatgagcaaaggctttgggagcaggaaatttccattctatgatgtactagctactgccgctgggctttagtttccttatttataaaatggaaatatcaatagcgcttgccttcacagggttggagtgagcattgcacgagataatgcatatgaagggctttagccagtgtcaggcatagagaaggatctcaataaatgttagtgatgatggtggtgatgatgataaaggatttggagtctcaaaaagttgtattgcagcgttacaacataacattttcagataagaaacgagatcacatattctgccaaggttatttgaatttgctatgtggaagggaaaattacttctctgtcacttaatggctgccatatattcttactcagttaggaggtgtgcttacacgtgtttgtgatgtcttgtgtccttgccctgatggtcagaagttttgttttagccctttaaaaaatccaatacagctttcagtattctgcagtgcatgcagtagactttctacaagtaaatgttttaattaaaaaaatcaaattatcatgcaaattatactggtagaaaagattttggccttatgaacatttacaaggcattgatttttaaagtaaaataaattagcaaataaggccttataaactacctatttctggtctatttcctagggactcacctctactcaccattgcttctcttagcactttggctgttacacaatgaaatgaagttaatggtttctaataatgaatgagccatcttcatattagaggtcttggtaccaagcaatagaaaccaactcaggctaacaagagggaatgtactgaaaggaaatgagaggacctacagaactgatgtgaggctggaggaccacacttgaggatgagcaaagagcatgagagctctggcaagttaggggcaggaaccatagccatagtctttgtagcaggaagcatctgctcagcacttggccatggggaaagaaaacccacagtctactttcttctctatgtgggtgacccactccatggtcagagtcctctgagagtgtatgactggccaagctcagataacaggctcacagccaggctataccaggagctgggggtaggggtgtagagataaaaaaaaaaaatctatcattttctgtaatgggagctggtagctgggaccatcctgcctacacagctatacagaaaagaagagagacaatttcccagaaagaaaccaggatactaccaggaaaggggaatggatgctcggcaggcccacagtggcaagtgcctgatattccacactgctaataatctgattctttacatcaggcatagtctgtagtctagccagtctttattaagcctttgtagactttaaaacacagtataagacattccactttgctattcttgtcctatatgtggtctaaagacagtcctccacgtcatcatcctgctctcgtctaagtgggaacagctttctcaagagattagatgggaattcaggagttgagaatattgtagcaccagtattagatactaggatatgctacctttatttatgcataatttccaaataaatagaaataaatttaaagctattatttactgtaaattaaaaccagccaacacagcaccagggagattctgcacattttattaaattggggcctgtataggtataatgtattcagttgccatcaaaggtaatgtttctgacacagtagagggtctggttactttgcaagtcttaggttggttgcttttttgttgttttagaacaccattcaaatttaagatattactctttttgattgattctgtttgcttttatgttctaggggaaaacatatccatttcggggcgcctttccaccagtatggaatcccattgcatatttggattacaataatctgtggaggacaatagataacatggggaaggaggtaaaatgtgtgttcagtttgcacatgacccattactgaaataacaatggcaactgtttaatatccttccatagtgcagggaacattgctctggacaccaatgcatatcatttcccatgtacccaaactgcaaagttggtcgtatttccacttcacaaatggaaaaatgagtgcccagagattatgtaatttactcaagacctcatagcaagggaaccagcataccaacccactctcttatacaaatgcctgtgtgccttcaactctatgctactgagcatttatatgacatatttttgccaagtatctctacttacagttgtctgtctgtctgtaatgccattttagatagtaaaggagagaaggacttgctgccccaaagcttctttacttagtcttaggctctgtaatatcaatttgggacataaaatggttattagctttcaataacaatgatgatgataattgtcatcattataataattacatataaatttgtacatagacatatataatattatcactactattattgttttggcaatggcattaggacacagaatccaaagaactctaccccactccctgtctctatatagaattctatgccaatcacacatttcaacacagagaccaagagacccattttcagaggttttcatgagggccttcccgagaagaggtggcagttaccatcaaacctgagaggggacttcctttctctacagattccaactgatgcaccctgggaggctcaacatgctgacaaatgggacaaaatgaccatgaaagagctcattgacaaaatctgctggacaaagtaagtagacttgaccattcaaaatttactttttatcttcccttctcgtcttttatatcttgccttgaactgcagtgcttttcttaacaacttacagaaaaaaagaggaaacctagtaatctttcagtcaatagcaatgttgagggcacctcaaagtaggttagaacagaaaatgaatctaaaaattaagaaaagtgggtgaatgaagtagaacttcttttaatgaaagcattgtgtgatctgcaataaaatcaataattgtgttttcatattattgaaaggttgcctacaaaagcagtttgaaaagatattttttaaaaatgtggtacatttacaccatggaatactatgcagccataaaaaagaatgaaatcatgtccttttcagggacatggatgaagctggaagccatcattctcagcaaactaacacaggaacagaaaaccaaacatcgcatgttctcactcataagtgggaattgaacattaagaagacatggatgcagggaggggaacaacacacactggagcctgtcaggtggtgggaggagggagagcatcacgatagataactaatgcatgtgggtcttaatacctaggtgatgggttgatgggtgcagcaaaccactatggcacatgtttacctatctaataaacctgcacatgtactccggaatttaaaataaaataaaatggtaatcccatatagatgtggaatactaggaaatgagaggaaagctagtctgtagtaataaaaatgttcaattagaccatgtcttattagtttatgtggggcttactatgtgaaggcaccataccaggcactgaggaatgggggtgaacttcttaggaatagcccctaccctcatggagtttatgtttttctagcaggcaagactgaccttgagcacaattacataatgctaggagagttcctgtaacagggagaaccttacatggtctgagggtacaggaagcattctttgatgaagcaatctttaacctgaaactaaggagttagtgcatcaactaagaatgagccatcggggcaggggggagtcagaaaaggtgaacagtgtagggcgatggtatcttccaggaatgatacacagggacaggagagagaaaggaagaatggatgaagttggggggatagtatctgccaggaataagtcatggggcaggagaaagacaggaagggtggatggtgtggtagaaatcgtaccttccaggagtaacccatagggttgatagtagtggggcagatggtatgatctaagaatgacacacagtgtcaaagggagagagggaaggttggacagtggtggtgggaggagggaatgatatcttccaaaaattacccacaagggcaagaagggagaaagggataatggagaaagatgggtggtgttttaggaaagacccacagaaacaaggcgagatggggactggaagggtggatggcattgggggattttgtcttctaggaatgagccacagggattagggggagataggaaggactgatggggcaggaagatagtatgttccaggtatgatccacaggttcagaggggagaaaagtatagtggatggtgtttgccatggatgaaccaccaggatagtgggggagacagaaaaggttgatggtgtggtgggatggtatcttttatgaatgacccaaaggggcaaagggaaggcaggaaagatggatgttgcggggatatcatccaccaacaacccagaggtgtagtggggagacaggaggtgtagatggtattaccaggatatgtcttccagaaatgagccacaaaggcagggataagataggaagagtgaatggtgtggcctggttgcatcttccaggaatgcccccacagtgttagggagtggggaacaagaatggatccctgtgggggtatggtatcttctaggaatagcccacagagtcaaggggaaacaggcaacattaggtagtgtgtgtgtgtggtggggaaatggggcgggggtggggtggggagaatgaaattttccagctatttctctctctctggggagagaaagggaaggttggtttgtgtggatggagatggtatcttctaggaattacccaaaccagaagggtggatgtcttaggggaaggggaattttccagcaatgacccagagggatggtggggagacaggaaacatagatggtgaggcaagatgatgtattccagaaatgacccacagggcaaggggtagatacaaaggtggatggggtgagggagatggtctcttccagttatgacccacaagggtagaggggacacagatggtgtagatcatttggcaaaatggaattttccaggaatggtccacagggaagagggtacataggaaggtttggtggtgtggcaggatggtatcttccaggaatgagctacactggcagtggtaggggggagaaaggaagggtggatggtgaggggtcatggtttcttccaagaatgactcataggattgtacaggaatgacccagaggggtagcgcagagagaggaaacatgactggtgtggcaggatataccttccaggaatggtctacaggagctaggggatgcagggaagatgggcttgtttgcaggcatggttcttcctggagtaacccaaagggtcaggggtgagacagcaagggtggatattgggccgcggataacttccagcaatgaccaaaagagatgggaggagacaggaagtgtggaaggtgaccaggatggtatttccaggaatgaccctcaagagttgggagagacaagtaggatagatgatttgatggagtggtatcttccaggaatgaaccaaaggggcagaagaaaacatggtacattgtgtttagagagatggaatcttccaggaatgagttaccctggtggtgttttcggggacatggaaagggtggggatagtatcttccaggatgacccacaaggccaaggggggagacaggacagggtggatactgtgtttgtagggggagggcatgttacttctcagggatgtgacacaggcactgtggggacacagagaagggtagatgttttgtggaggaggtggtctcatcccgaaatgacccagagggtttagaaaggtgtagcaggatggtatcttccaggaatgagccacacggttggtggcgggggaagatgggtggtatagagagatggtatcttccaggaatgacccacaggggcaagggggtgacctgaagggtaaaggttgtgaagggggatatcttccagtaatcacccaaaggggtagggggagataggaagaaaagatagtgaggcaggatgatattttctaagaatggtcttcagaatgtgtggggttaagtaaacaggaaaggtggatggtgtaggaagatcgtatcttccaggaatgagccaccgaggttggggtgagacaggtaggtggatggttttgtagaatggtattttccaggaatgagccacagggcagggggtagatataaaggatggatggtatgggggagatggtatcttccaggaatgaactacaaaattgaggaaggaggggaatgatggatgagctaggtggatgggatctgccaggatggcccacagagccaaaagaaagacaaggcagagtggataatgtaggggaaatagtatcttccaggaatatcacacaggcaatgcagggaggcaggaaagggtagatgttttggtgagggagtggtatcatccccaaatgacccagagtggtagaggggagataggatagttgaatgacaggatagtatcttccaggaatgagccacggtgacagtggtgggggtgggagacagtaagagtgtatgtggatggtatcttccacgaatgacccacagaagtcagggaaataagtttaggcaaatggtatctcctaggaatgtgccaaaagggtagtggtggggggagatgggaatggtggatattgtggaagtgatatcatacaggaatgagccagagggggtagtgaggagtcaggaatcatgaatggtgtggcaggatatattttcaaggaatgacccacatgggctaaggggacacagggaatgttggcctgactggggacatggtatcttcctggagtgactcaaagggttgggggaagataagaagggtggatgttgtggggaatacattccaacaatgacacagaaggatggggcgagacacaaagtggttaaggtgaggcaggatggtattttccaggtatgacccacaaggttgggagagtaagaaagatgagtgatggtggggggaaatggtatcttccaggataaccctcaggggtaagggtaaacaggacaaggtggatagtgttgaaggggttatatctttcaggaatgtgactaagtctctggggggaaacagggaagggtagatgttttgtgagggagtgataccaaaatgacccagaggaatagtagggaaataggacagttgcatggcatgtcaggatggtatcttccagaaatgagtcacactggtggtggcggaaagagacaagaaaggtggatgttatcattcaagatgatatcattcaagaattacccagaggaataggggagagacaggaagcctgactggtgtggcagggtatattttctgggaatgagccacaggtgtgggagaagacagtcagggtagatggtttggtggaatgaaatcttccaggaatgacccacagggtcatgggggaaaattgaagggtagacattgtggatggagatatcttccagcaatgacccagagggatgggggagacaggaaatgataatggtgcagcaggatggtatcctccaggattgagccacactggtggggttgtgggggtcatggtatcttccatgaatgacccactggggtcgagggaagactggtagggtagatggtttggcggaatgttattttacaggaatgacccacagggcagaaggtagataggaaggatggatacagtagaagagatggtatgttccagtaatgagctatagaatttggggagggggggaatgatggatgaggtagggagatggtatcttccaggatgacccacagagccaagggggagacaaggcagactgtataatataaggggtatagtatctttcaggagtgtgaaccaagcactgcaaggaggcagggaagggtagatgttttaggaagaaggtggtatcatcccaagataaccaagaggataacaggaaaatagaatggttagatggtgtggcaggatggtatcttccagaaatgagccaaatgacagtggtgggggtggcagaaggtatgggtggatggtatcttccaagaatgattcacagaggcagggggtggcagaaggtatgggtggatggtatcttccaagaatgattcacagaggcagggggagacagggtacattgggtttagagagatggtgtcttccaggaatgagacacctgggtagtagtgggggagacagggtacattgggtttagagagatggtgtcttccagtaatgagacacctgggtagtagtgggggaaaacaggaagggttgaagtgtggggggatgatatcatcctggaatgagccagaggattagtgttgggggggttatatcaggaatgtgacaaaggctctgcggggaaacagggaagcctagatgttttagggacggtgtggtatcaccccgaaatgatcagaggggtagtggggagatacaacggttgcatggcgtggcaggatggtatcttccaggaatgagtcacactatgggtggtgggggagaccatcagggggatgttggctggcatggtatcgttgtggaatgacccagagggacagggcagagagagaaagcatgaatggtgtggcaggatatattttccaggaatgagtcacaggggcagtagggaaacatgaagagtagatggtgaggtgggatggtaccgcccaggaatggtccacaggagctaggggatgcagagaacattggcttgttggcaggcatggtttttcctgtagtgacccaaagggttgggagtggtgggggagataacttccatccacgacccagaggagagggagtagacaggaagtgtggaagatgaccacgatggtatcttccagggatgacccaaaggggcagagggacacagggtggattgtgttttgagagatggtgtcttctaggaatgagccaccctggtggtgcctggggggacacaggaagaggtatgtggagatggcatcttcctggatgacccaaaggggaaagggggagacaaggcaaggtggaagtgttgggggaggtgtgacagtatctttcaggaatgtggtatagtcactgtggggaaacagggaaggctagatgtggttatatcatctcgaaatgacccagaggggtagagggaaataggaaggttgcatggtgtggcaagatggtatcttccaggaatgaggcacactggcagtagtgggggtggagacaggatggaaggtggatgtggatggtattttcctggtgtgacccgcaggggcagtaggtaacagtggattgggtttagagagatggtgtcttccagcaatctgccacaagggtggttagaggtccgggggataccggaagggtggatggtgtagcaggatggtatcttccaggaataaaccctggcaggtgggtgttttgggggaattgtgtcttccaggaatggaccataggggtagatgggagacaggtagggtatgacagaatgatattttccaggcatgacccacagggcaggggatagagaagaaggatgaatgttgcattggagatggtatcttccaggaatgaactacggaattggggaagcgggggaatgatggatgacgtaggggaatgggatcttccaggatggctcagagatcccagagggagtcaaggcagggtaaataatgtaagaggggatagtatctttcaggaatatgacacaggcactatagggtagacgttttggggaggaggcggtatcatcctgaaatgacccggaggggtagtggggaaacaggaaggttggattgtgtggcaggatggtatcttccaggaatgaaccacactggtggtgcttcgagggggacacaggaccggggatgttatctaacaaaatgactgacagggaagagtagatagttctgtgtaggggtatagtatctttcaggaacgtgacacaggcactgcggggagacagggaagggtagatgtcttagggagtgggtggtatcatccagatatgactcaggagtaggggggaaatagaaaggttggatggtgtggcaatatggtatcttccaggaatgaaccacacaggtggtgactgggggaggcaggaaaggtgggtggtgttaggggatggtgtcttctaggaatgacctacaggagaagggggagacagggtggattggctttggagagggccacaggtgcggtggctggggagacaagaagggcagatggtgtggaaggatggtatcttccagaaacaacccacagggatacagggagacaggggtttagagagatggtatcttccaggaatgagccacatgggaagtggtagggagagacaggaaggatggacgttgtggggggtggtattcgggaatgacatagctgggaatgggggaaacaggaaacaggaatgctgtagcaagatacatcttccaggaatgagccacgagggcttgaggggagacattatgattggatagtgttggtacatggtatattcaaggaattagccataggtttagaggggagacagcaagagtagatggtgtagagaggatgatatctgcctctaatggcccacaggtgcacgggggagataggggagattagatagtgttgggggaattatatcttccgggaatgtgacacaggctctggaagagatggtgaaggtggaatttggttgtggggtgggggaggggggaggtaatgatatccccaaatcacccatagtattagggtggcaataggaagattggatggtgtaggcagatggtatctactaggaatgactttcagagtcagtggggacatgtgaagatagaaaatgtgtttgcagagatactgtcttctaggaatgagacacacttgctgaggggaggcagggaagggtgtatgttttgggggcaatggtgccatccagaaatgaaccagaggagtaggggatagacaggaagagtcaatggtatgtggcaggatgctaccttccagaaatgacccacaggtatgtggggagataggaaaggttggatgatgtgggaagaatggtatctttcaagaatgactcaaagttctcaggggaatggggagacagggacgggtagatgatgtacagtgatggaatcttctaggcatagaggacagggacaagcttttgtgaaggccttgaggtgagaaggatattggcatgtttgagcaactgagtggacagtgtagctggaccatagtgatgacaagagcaagtggtataaggggagtttgcaggactggtctagaggctgatagtgcaggatctatgggccacattgaatatttgtcctttctccactgaagatcgttgaaaggttttaagcagagggttttttgagtttggcacttttaaaagccctcattggctatagtgtggaggatacaagaggagatgcaagatgaccaagtaggagccaccactgctatagcctggacatattggtagcctggaccagggctgtggcaatgaagatggagaggagaagatgggtattgaaagaagcttattgatgcttagagagaacctggattagcatacttggagctaactcataatttctttttttttttttaattatactttaagtgctggggtacatgtgtacaacatgcaggtttgttacataggtatccatgtgccatgttggtttgctacacccatcaactcgtcatttacattaggcatttctcctaatgctatccctccctgagccccccatcccctgacaggccctggtgtgtgatgttcccctccctgtgtccatgtgttctcgttgttcaactctcacttatgagtgagaacatgcggtgtttggttttctcttattgtgttactttgctgagaatgatggtttccagtttcatccacgtccctgcaaaggacatgaactcatcctttttttatggctgcatagtattccatggtgtatatgtgccacattttcttcatccagtctattattgatgggcatttgggttggttccaagactttgctattgttaacagtgctgcaataaacatatgtgtgcatgtgtctttatagtagaatgatttataattctttgggtatatacccagtaatgggattactgtgtcaaatggtatttctagttccagatccttgaggaatcaccatactgtcttccataatggttgaactaattgacactcccaccaacattgtaaaagcgttcctatttctccacatcctctccagcatctgttgtttcctgactttttaatggttgccattctaactgtcatgagatggtatctattgtggttttgatttgcatttctctaatgaccagtgatgatgaacattttttcataagttttttggctgcataaatgtcttcttttgagaagtgtctgttcatatcctttgcccattttttgatagggttgtttctttcttgtaaatttgtttaggttcgttgtagattctggatattagccctttgtcagatgggtagattacaaaaattttctcccattctgtaggctgcctgttaattctgataataatttattttgctgtgccaaagctctttagtttaattagatcccatttgtctgttttggcttttgttgctattgcttttggtgttttagttatgaagtctttgtccatccctatgtcctgaatggtattgcctaggttttcttctagggtttttatggttttaagttatacgtttaaatctttaatccatctcgagttaattttcgtataaagtgtaaggaagggatccaatttcagctttctgcatatggctagccagttttcccagcactatttattaaatagggaatcctttccctgttgcttgtttttgtcagtttgtcaaagatcaaatggttgtagatgtgtggtgttatttctgaggcctctgttctgttccattggtctatatatatctgttttggtaccagtaccatgctgttttggttactgtaaccttgtagtatagtttgaagtcaggtaacgtgatgcctccagctttgtcctttttgcttaggattgtcttggctatgcgggctctttttttggttccatatgaagtttaaagtagttttttccaattctgtgaagaaagtcagtggtagcttgatggggatagcactgaatctataaattactttgggcagtatggccattttcgtgatattgattcttcctatccatgagcatggaatgttcttccatttgtttgtgccctcttttattgcgttgagaagtggtttgtagttctccttaaagaggtccttcacatcccttataaattggattcgtaggtatgttattctctttgtagcaattgtgaataggagttcactcatgatttggctctctgtctgttattggtgtataggaatgcttgtgatttttgcacattgattttgtatcctgagactttgctgaagttgcttatcaacttaaggagattttgggctgagacgatggggctttctaaatatataatcatgtcatctgcaaacagagacagtttgacttcctctcttcctaattgaatacctttatttctttctcttgtgtgattggcctggtcagaacttccaatactatgttgaataggagtggtgagagagggcatccttgtgccagttttcaaagggaatgcttccagtttttgctcattcagtatgatattggctgtgggtttgtcataaatagctcttattattttgagatacgttccatcaatacctagtttatggagagtttttagcatgaagggctgttgaattttgtccaaggccttttctgcatctattgagataatcttgtggtttttgtcattggttctgtttatgtgacggattacgtttattgatttgtatatgttgaaccagccttgcatcccaggaaggaagctgacttgatcttggtggatacgctttttgatgtgctgctggatttggtttgctagtattttattgaggattttcgcatcaatgttcatcagggatattggcctgaaattctctttttttgttgtgtctctgccaggttttggtatcaggatgatgctggcctcataaaatgagttagggaggatcccctctttttctattgattggaatagtttcagaaggaatggtaccagctcctccttgtacctctggtagaattcagctgtgaatccatctggtcctagattttttttgttggtaggctattaattactgcctcaatttcagaacctgttattggtctattcagagattcaacttcttcctggtttagtcttgggagggtgtatgtgtccaggaatttatccatttcttctagattttctagtttatttgcatagaggtgtttatagtattctctgttggtagtttgtatttctatgggattggtggtgatatcccctttttctttttttattgtgtatatttgattcttctctcttttctttattagtcttgctagtggtctattttgttgatcttttcaaaaaaccagctcctggattcactgatatttttgaagggttttttgtgtctctgtctccttcagttctgctctgatcttagttatttcttgtcttctgctagcttttgaatttgtttgctcttgcttctctagttcttttaattgtgatattagggtgtcagttttagatcttccctgctttctcttttgggcatttagtgctataaattttcttctacacactgctttaaatgtgtcccagagattctggtacgttgtgtctttgttctcattcgtttcaaagaacatctttatttctgtcttcattttgttaattactcagtagtcattcaagagcaggttgttcagtttccaagtagttgtgcggttttgagtgagtttcttcatcctgagttctaatttgattgcactgtggtctgacagacagttcgttgtgatttctgtacttttacatttgctgaggagtgttttacttccaattatgtggtcattttagagtaagtgtgatgtggtactgagaagaatgtatactctcttgatttggggtggagagttctgtagatgtctgttaggtccacttggtccagagctgaattcaagtcctgaatatccttgttaatttttgtcttgttgatctaatgctgacagtggggtattaaagtctcccaccgttattgtgtgggagtctaagtctctttgtaggtctctaagaacttgctttacgaacctggatgttcctgtattgggtgcatatgtatttaggatagttagctcttctcgttgcattgatccctttacagttatgtaatgcccttctttgtctcttttgacctttgttcgtttaaagtctgttttatcagagactaagattacaacccctgctttttttttttgctttccatctggttggtaaatattcctccatccctttattttgagcctatgtgtgtctttgcatgtgagatgggtcttccaaatacagcacaccgatgggtcttgactctttagccagtttgccagtctgtgtcttttaattggggcatttagcccatttacatttaaggttgatattgttatgtgtgaatttgatcctatcattttgatgctagctggttatttttcccgctagttgatgcagtttcttcatagcatcaatggtctttacaatttggcatgtttttgcagtggctggtactggttgtcctttccatgtttagtgcttccttcaggagctcttgcaaggcaggcctggtggtaacaaaatctctcagcatttgcttgtctgtaaaggattttatttctccttcatttatgaaacttagtttggctggatatgaaattctgggttgaaaattcttttctttaagaatgttgaatattggcccccactctcttctggcttgtagggtttctgctgagagatctgctgttagtctgatgggtcttcctttgtgggtaactcgacctttctgtctggctgcccttaacatttttttccttcatttcaaccttggtgaatctgacaattatgtgtcttggggttgctcttttcgaggaatatctttgtgatgttttctgtatttcctgaatttgaatgttggcctgccttgctaggttagggaaattctcctggataatattctgaagagtgttttccaagttggttccattctccctgtcaatttcaggtataccaatcaaacatagatttggtcttttcacatagtcccgtatttcttggaggctttgtttgtttcttttcactcttttttctctaatcttgtcttctcgctttatttcattaagttgatcttcaattactgatatcctttcctccacttgatcgattcggctgttgaaacttgtgtctgcttcacgaagttcttgtggtgcatttttcagctccatcaggtcatttatgttcttctctacactggttattctagttagcaattcgtctaaccttttttcaaggttcttagcttccttgcattgggttagaacctgctcctttagctcggagtagtttgttattacccaccttctgaagcctacttctgtcaattcatcaaactcattctctgttcagttttgttcccgtgctggcgaggagttgtgatcctttggaagagaagaggcgttctggtttttggaatttttcagcctttctgcactggtttctccccacctttgtggttttatctacctttggtctttgatgttggtgacctatggatggggtttctgtgtggatgtcctttttgttgatgttgatgctattcctttctgcttgttagttttccttctaacaggcccctcagctgcaagtctgttggagtttgctggaggtccactccagatgctgtttgctggggtatcaccagcagaggctacagaacagcaactattgctgcctgatccttcctctggaagctttgtcccaggggggcacccaccagatgccagccagagctctcctgtatgaggtgtctgttggcccctactgggaggtgtctctcagtcaggctacacgggggtcggggcccacttgaggcagtctgtccgttatcagagctcaaacactgtgctgggagaaccactgctctcttcagagctgtcaggcagggacatttaagtctgctgaagctgcacccccagctgccccttcccccaggtgctctggcccaaggagatgggggttttatctataagtccctgactggggctgctgccttttgttcagagatgccctgcccacagaggtggaatctagagaggcagtaggccttgctgagctgtggtggggtccgcccagttcgaacttcctggtggctttgtttacactgtgagcataaaactgcctactcaagcctcagcaatggcagatgcacctctccacaccaagctcgagcattccaggtcgatatcaggctgctgtgctagcagcgaggatttcaagccaatggatattagcttgctgggctccatgggtgtgggacccactgagccaggcaccggagggaatctcctgatctgccagttgtgaagactgtgggaaaagcgcagtatctgcgcaagagtgtaccgttcttcctgggacagtctctcacagcttcccttggctaggaaaaggaaatcccccaaccgcttgcacttcccaggtgaggcgatgccctgccctgcttcggcttgccctccatgagctgcacccactgtccaaccagtcccaatgagatgaaccaggtacctcagttggaaacacagaaatcacccaccttctgcgcggatctcactgggagctgcagaccggagctgtttctgtttggctgtcttgctggacccttggctccttttcaactcataatttcttaagcaggagaaaatgttagtttctccaagagttaaagaatgcattccttcagaaattgaatccttgagagtttttttcaattgcaacagaaaaactttctgaacacactaaatcgtgttgtaaaaacatgacattctctgactcctgtacatattgacacctgacttccacttttgttctatgaacaggactgctaggcggtttgcttatctttttgtgaatatcaatgtgacctctgagcctcacgaagtgtctgccctgtggttcttgtggtatgtgaagcagtgcgggggcaccactcggatattctctgtcaccaatggtggccaggtatggtgtgtatgtgtctgttctgaaacaagagcttcatctgtgattttgctttctcccagggcagtgtctttaatagttgcttcaggattttgaaacatgaataattagcagcatgaaatgatctcaaaagattttctgaaaaaaaaatttctcatttccttttgtcactcctgaaaaggagttcacagataaagaatgtttcattttgaattaattaggttttgagaattaagttccttccttttggtagcaggtaaaattaggctgtttatgtaggagaagctaaattcctaaaataatttccaaaaaattctagaaattgtacaattattgtacttaaaatcatctctgttctagacacaaggtttctgtcccatctgtttatcagagtgattcttttatgttaactgctacagaagggaagtgactgttcttccttctaattcacgcaagtgattatggccactcttgcaatagtaaattctgccttttggattcttagtttttgctacccacttgaatttgcccagtttccatatcatttcctttattaataagtgaattcatttcgttcattggctggacacatggcgaagccagaatcctaattccccagactctgagattctctgcttcaaccctttctgttatccaaagagaatgggtatctctgttctataaatgttgtgcttggatggtatgaggtttaattagtagcagtttacttctaacttaggttctctgagttcctgaattctgagtgcacagtacaaggtatagagtctttctctgccaagtgaattattcttctcctgaggagatcaccggaaatccccaagttcttgtgacaccaagactcattgcccatttgacccttagccttgacaaatgcaggacagttgcattttttaaatgtctttacctacaggcagagatgacagattactccttttagccagtattttactttctgaggtattttgatttacatttgatatttgtttccttcattcagaggagccaggatacttctagccaaattctacatgaccttttggaaaatatggttcagatgattaatctcaaaccatggtcacaatatttttataaagaacttaggcttatcctgtaatttaattcaacaaatactagacctggaggggtggacagtgaacaagacagaaacagttcgtggtctttccaccacactaaaactcaaagtacctcttagaaaacagaccagattataagttaaatggtctgggtttcttgaggaaagacaaatcatgaatttaggtctgaaccactctgggaattttttttcctttttttaatttaatttttgagacagagtcttgctttgttgcctagcctggtctccaactcctgggctcaagcagtccttccgcctcagcctctcaaagtgctaagatcacaggcatgagccaccatgcctagccaggaatattttttataaagaactttggtgttgttattaaaacagtagccagttacaaaagtgcaaaaatcactgcgtggctgcttatgcagttttctggaggagtatgattgaggaatctgttaggaatcttctggctgggcgcggtggctcacacctgtaatcccagcacttttggaggccaaggagggtggatcacctgaggacaggagtttgagaccagcctggctaacatgatgaaaccccatttctgctaaaaatacaaaaattagccaggtgtcatggcacgcacctgtaatcccagctactcgggaggccaaggcaagagaatcacttgaacccaggaggcggaagttacagtgagccaagattgcgccattgcatgccagcttgggcaataagagtgaaactccgtctcaaaaaaaaaaaaaaaaaaagaatcttctataataggctaaaaatatccttctggttcttaccaaaagcattgtgttaaggacttaccttcttagattaagctggaaacatttccatggtgatcgtagcagaaggcagagggtagagcacttctggtcttataagggccgctcaagagaactatttaacaatatctaaaggagcaagcagatgcttagccttcaccctctgcctctgccttgaagcttccagatagttttgcaaaaagttactcaagatctgatattccgaatcttttttttttttttttttttttgagacggagtctagctctgttgcccacgctggagtgcagtggtgcaatctcggctcactgcaacctccgcctcctgggttcaagtggttctcctgcctcagcctcccgaatagctgggattacaggcacgtgccaccacgcctggctaatttttgtaattttagtacagccacagcacccggcccttcttcccattcttagaacatcatttggtggtgactagtaggactagtaggacgtgactatccctaaaagcaccctgtaactttgtctataatatggctctatctgcatccttacctgcctggacaacctcagcccagaacacaggaatcaaaggaaattagaaacttcatcctctggaataagccctgtgcctgccccttctcagggctccctccacaccctgcactctttgacatttgaagcccacagacttgctgatattccccttggtcagggcagcattggcatagtggaacatttcttcgggttctgtgatttttataaacttgtaatggcttttctttgccagaagctgtgcagggaatgatcattgaattgtcttggtcaactctgcctctgtcctaatgaagtcttctgacagttaagtgtgcagacgttagaggtgtggcctgtgactttctggaggttttctaatcagtagccagtaggattttccttccttgggctttcataatgtttcctttcttacctacctcctcctgtaggaacggaagtttgtaggtggatctggtcaagtgagcgaacggataatggacctcctcggagaccaagtgaagctgaaccatcctgtcactcacgttgaccagtcaagtgacaacatcatcatagagacgctgaaccatgaacattatgaggtaactcagtttagtcaaaaggagcatatagtaaataggccttgtgtcttttgcagtttctaaccagatataattcaagcagtagcataattaatgctgacatgtttccgcctcagtcttccaaattaccagccttggttgacctaccttgatctgttttgttgcctcacagttgcctcattttctcattttgtatgtttttactgctcaatgttgtttagaagtgataaagatgatttttcacgcctgccacaaagactgcagctcacatttgaggtaatattttgcttgtgtgtgttttagtgcaaatacgtaattaatgcgatccctccgaccttgactgccaagattcacttcagaccagagcttccagcagagagaaaccagttaattcagcggcttccaatgggagctgtcattaagtgcatgatgtattacaaggaggccttctggaagaagaagggtaggctgctattattcatgtttaaactgtattatatgaagaaatcacagtcttttaggattattgaacagaaggtattgaacagaaacaaagtattttcaaactggtagaaaaaggattagaaatcttggtctgtcaatttcctcatatccttggccacacataatgaccccaagagcacttgttggcaatgggagggaagaaggagatcacatcagtcataaggccaccattgccctgactcctggcatctgtcctgcttcttactttttatgagcagagtgaggtcaacaggcaccatggaaagagcactgcgttgaagttacacattccgggacttcgcttgcttgctagcatcagtctgtagctgtaaagtggtgacagtaatacctaccactacggtgttgtgagaattaaatgaggcaggatcttggacttagaaagctgcccagatatggtggctactgttgataagcattctggttatactcatcggattccctcctcccacctcttccctggattgggtcattccctccaatgcagcccttctctttcctcatgtatgctaggagccagggttatcttaccatttttgtcatgcattggctggtcataagccctttatgtaaaggtgatggagatgggtcattttctgtctgtgggtgaatagacatccttatatattcagtgtgtgtatttaacaagacatgtagggttggggccaagaccaagagtttaagtttttacttcctcttaaaaaatagtttatatatatttatgtgtgtatgggtgtctctgatgagcttgatctcgatctcccattgatttttctcctggttaagattactgtggctgcatgatcattgaagatgaagatgctccaatttcaataaccttggatgacaccaagccagatgggtcactgcctgccatcatggggtaggttagagcagggtgttctgcattttccaaattgtgttgatgtattggtgtggatgctgtcaaagtatattactttggaattaagttcaagcaatgatgaataatgctatcaaaatatataatgtttccatgtgttaaaatattgcagtaatgtttcgtatgtagcacaagaatactgggaaactttactaaaattgacaccattttgaacttgtacccatgtatgtctttctctcatacaaagcttacgtgttgaggatggagtgaaaaaaagcagctagacaggcagtatggtagccacccctgcctacaggcagaatgtccacagccattctgaaatgagaactaaccgctttattctataaaaacattctaaatgtggggtttctcggttttatccttttctccattccagatatctgctacatagcaaatgttagttgttaccctgagatataagacagctgaccaattaggaggcccagttcagaattgagccaggccttgattggatggcatggcagtttttctggtgggtcactctagttatccttcaccagtggtgcttcacttaacctctaaagtgtgcggatgacccagggcctggttctgtgtagggaaaatgagagcttttcccctctcttctcattccggcacatagctgtcctactcgttgggggctggggagtccagagaaggaagtggtgtccccacaaatgaattgctaaggagttccacagcctccctcttgcctgccttttggcctcctcaaaaactatacaaataaaaggcgatttattctaccacactgtaacaaaagaacatagcttcagtagcaatcaagtgacttttagagaccagtggtctcccctttacccctaggaaatgcatagctcttgctcagagggaaaggtgaactcatgcacatcatgtcattgaaggaaaattacaaaggcaaaaggagcagacccacatcccagggaagttagaaagcaggttgtgctgctggttactaatgagacattttataaccacttctctcattgtaacatataagaacaccagcctccctgagaaaggcaggtgcttacaacataatgactgttggaataacacatcctcttcatctctaaccctattgggcagaagaggatataggttgtttgggtagtttgacatcatcttctatatgccagagaaaagcaggaggttcaggtacaggtttcaggagaatgtcggttaagacaaatccaactatgaatggaagagcaattgatatttttcttgccctgggagttagatatagtgatgtcttctgctgtttttgggctttctttttttttttttttttttggaagtggaactcaatattttaatgattttacttaagataaatagtataaaaggaaaatgttaaacggttgtgttctgtggacagtggggctaaaacaaatataaaataataataattggttatagaggaccaagtacagaagatgagagtttccttggaaactggggaataccaaaataatctgtttcttaacttggcgatgtagtcttaaaaattaaagctaccatttattgagcattggttgtgggtgcaagtttttatgtgtacaatgcttttgggctttcttcagctttattattaactaggttagggctcaaataaccttccaggtgttaatggagttatttaggcaattcttagaaagtgatattctaatctctttcatcttgacacttgcctccaccctgctctttgctgatggccacagccacgaaaaccttgaagataggggtggtaattgcccagcactgtgtttgtaataaacttttggaaactagaaaggaccttgtactttagaactgtgaaatgtttccaacacaaagccagcatgtttaatttcctcaataaaacaccaaagtaagttaaagcttatttatccatagttgggattagatcaaagagattatttcattcatgacttgagatttgacagaaataaccaacactaactgccctttgggaagggaactgtaaaaagtatacaagacaagttgactaaaaatgttttcagataaatcatttaatcttttatcagatattgatgattaaaaaaaactatatacatctaaacttactgattcttgcataaacccagaatctaactaaaataattaataacaagctataacttgaggtgttaaatcatgcaaaattatgactatatcccataaagttcaatagttcagatttcctaaatagtccacagctttctctgaaatactattctctacattaacatacatctttgcttctcaaagtgatctcaaataacagccctaaaggaactgccaatccaatttgaggaacactttaatttgtgggtagggagaggaggaaatatctgttttttgcactgatctacctgtccttttggtcttgaataaaagaaatacaaatttaaaaattttttaatggaaaaataatttcattgtcctttagctcatttggatttttgaaagctttctaataatagtataactaaggacttcatgtcacaattcaattcttttaaatatacatgcagttagtaatatcagtataataaatagaatatatttgattaaaggggagcaggcaggttataactgagttttattgagttactttatttggggactatattaggtcagtttccagggaagctgactcagagctggagatctgggtgctggaactttattgggaagtgctctggggatgactacctatggcagaaggattatgcggaacttgagctccaatgttgtcccaacaaaggcctctgccattcccttggaagttctggagctgggtggcccttcagagttgtcttcaaccgcatctaggtcagaacaactctagggaggggtgggaccttgagcgaggcattctctgctgccccgtccaattactggggaaggtttcagctgtgaggtaagagtaacgagtgcctggtcccaaagggagcctggggggcccaccgtggcctccactacagacacatgtttatatttgtttttccagctttgataaagtatttggcagaaggcaacagtcattaccagaataatcatttagcacaacattcattcattcaacatttgatttcctactatatgccaaaaaccatgttaaactttagaagtaaaatattgaataggaggtcacctgtcgtgtaggggatcacagcctagcaggggttttggacacacaggcagaccaaagacaatatggcatttgccctactagaggaggagggtctgagagagttcatttcatgctgaatagctacaggttaagaatacttcagaaagaaagggcagctcttaaaataaacagctgtaacctgatcattcaatgtaacctctctctccagcttcattcttgcccggaaagctgatcgacttgctaagctacataaggaaataaggtaagaatttataactgaaaaatagatgaaaaagttagctttgtattttgtttttgcactgacagtagtagaataacatgaggaaaaacacagtacttcacaaatattctcaaaattccaacaaaccaaccttttgtattttgctacagccctcttgacctagcccttgcccgtgtgcatatattaattttacatgttcgtgtttattttacagtagttaagaggtaggatttccctgagagatggatggataaaaatcatagaaaatattagctgtgaaaaatgctgtagaaaccgaatcccaatcctctttcaaggccataatctttttctaagattctctgacatggactttctaaaaagtatattttaacctgtagcaacttttgtacatgaaaatattcactactgcttatctgggacacagttctgatgttcccttatctgaaagcttcctagtataaaatttattttaggacagtggtttttttttttttctttctttctccctttctcttcctgtcatggtatatttgttttgttttgttttggaatcctttgttcaattaaagtcttacctgaagaggtaagccttttaacatcagagttatttggctgttggagggttgcctctgggtagccctaaatcctctgctagcttttaaagaggtccaatacatacacaaaaatatagacttttctctgaatgtaatttaaaaaattaaacagctaacccattagcagccgttgctttgggagttactctgatgactttagaagtgggggaaaggctgcagaatgagttcctacatgtgcacacggatttgtttatttgaatctcatggtttgcaggtaagctttacatggaagaaactcccagtttcaattagcaggttcttctctgttcactgtaagtggtaaatggttgaatctcaacaatcatgggattcaaacaaccatgagattgtggaatctcatggttgttaaaaataaactctactcactcaatggaggagggatttggggtccagtgatggggaatgatttgttcaagcctccatagctagtgtcttagtgcatttgtgatactgtaacaaagtgcctgaaactgggtaatttatgaagaatagaaatttatttctcacagttctagaggctgggaagtccaagattatgatgccaacagattcaattcagtgtttggtgagaacctgttccgtaggtagcactttctcatggtgccctcacatggcagaaaaggcagaaggaggaaggacaaaaagtgatgaaggtggtatcctcacttggaggaaggcagaagggcagaaagggcctagctagttccctccagcccatttataagggcactaatctattcatgagagcagaatcttcctgatttcatcatttccgcagagaccccacctcaaaataccatcaccttggaggttaagttccaacatttaaattttggagggacacatacattcaaatcatcgcagctagcttgtgacaaaaagtctggagtagcatatagcgcatactttttcattacaccacactaagctgacattttcttttggatttcctgctttccctccttattaatagtaaaataaataccagcctgtaggtagacatttggttatgattccacacagtggctgaacttctcaaaagttcttgtaaggcaaaacccttactaaatatgtcattgacaaaaacagtggttcccagatctgactgcatcaaaatatcccaaaagatgtttggaaaatatgtttttataagacctatagattgtgattgagtaggtttgaggtggggcctgtgtatttgtatttttcaacaagcttttcaggtgattatgataagcaaccagatttagaaaccagtgaataagttcaacgagatgatttgcacagtggcctcttttattcatcacttaggttctgttatttttagagccaaattaatcaatcagtgcattgttttaacatccttgccttacatatcttttccaaaaatttttaattttaaagggaagaagggaaagggaaagataatttcctatgtttgtgtgaacacatccttggctcttctaataatatgaaatacagtaaataatgacttgtaactattataattgtttttaacattcatgaatgaaaactaactacaatgtgggttgattggatttcaggtttcactctgctttaataaaaattttattacacatccagaaagtaagttaagcaggcctggcgcattggctcacacctgtaatcccaacactttgggaggctgaggcaggcagactgcttgagtgcagaggttgaagaccagcttgggcaacatagagaaaccgtctccacaaaaaaataaaaaaattagccaggcctggtgacatgtatctgtagtcccagcaacttgggaggctgaggcgagaggatcacctgagtccagggaggttaaggctgcagtgagccataatcgtgccactgcattccagcttgggtgacagagtgagaccctatctcagaaataataataacagtaataagttaagtactgttgagcttttttagaataatcattgccgatactttcattttctaattaacttgaaatgtctgaattattgcttgtaacacccttgtgaagtaggtgttagaatcagtcatctcttcatagactaggcaaagagtaggctgaggatgggttttgactgaacaaatatttattgagtacctactatgggcagattactcagaagggtaatagccttaccctgctattaattagctgagcaaaatcaaacagatctctgcagctccctgagcctcggtttcctcatctctgaaatgaggggcttgaatcaggctgagagagacagacagacagacagtagtcttgagacttcttcccattcttcttttcctttatgactttttatgtataatgtgagcagctctttgaaggaagccaaacttcctctgactatcctgaaatttaactatccacctaaatatccatctaatgttgcatgacatcatctcaggagtggcatttgtctctcccttaaaccttccatggaaaatggtaacaataagcaaagtttataatctgcctcctcctcctgattttatacatatgaggtgaatgttctggaagttataaaaatggtttaagtgtgaggatttagataaatttataaggttacactttgtcccatgttattcagagaaattgggggcatgtctttaaaatattttctaatgtaattggcaacataaaattgtatatttctaaatctctatttctttattaccagtaagcttgagctccccccgccctgcataattttgtctcttcagcttttaatacttgtcttacagatttgactcaaaccttttgccacatttttaagcaaatatttttccagttgcttgttatcccttaacaaatattttagagcattttcaaatgtttaaactatattaaaactataaaaggtaaataggaaaagtatataactggatcagtgtgaacctatgcaaacaaatccagaaataaaaccattaatttctaaaacaggtgattttagtaaattagacttttaaaaaaattcaccatgagtagttgtgagtttaaaatgtatttcgtttcaaaaagagtttatataagtacaaccactaactttttcagacatgaaaataccatgttctgggctagtcatttagataatgaattatgagaataaccaaaggctgtgtttgaggtaacattagcatattttgcccatccctcagatacactttgaaatactgtggtccacagaccattctatcaagtgacaaattcctagactgaaatgactgtagatactttctgtatagcatatcttatgttatgcttaaaagatgaaatgagctttatatgtttgtaggtaattaaaacacaagtataggatagttaaaagacaccatcacttatactatagacttataaaagggatcattttagaactctacgtattccagaaaagttatatagaatcagttcctaagactggctaaacttaattgaattcatttttcccatttttatctcgagaagatatcatattaggtagtgaaagaggcaaaaatgtaaaaaaagaaaagaataattccattgaatcctcaaattaaatgactactgaggcattgaaagttaatttgagtgcggggattcatggaaatgttcatttgtgcagttacagaaggccatggattttaatttatctgtaataaatctggttgataccaagagctctagaactcactgtatttattctatacccatcagttactccttccctaactttatttttttttttttttggctctgttttataggaagaagaaaatctgtgagctctatgccaaagtgctgggatcccaagaagctttacatgtaagaaactcccagctttaatccctagcaggttcttctctgttcactataagtagtaaagcaaagcatattctgattttttgacagtcttatgaagagagtataaagcgatatgcttaacttggaggataaacttcagcagtcacaaaaggtcattaaaagctggtattaggcgcatggaatttctgacacagcaacttctttgggctgtttaaatgttcactagataactggcagccaattgtaatgagagcctagagctgcagggattatgtcaagaatgggtgagttgggttcctagaacagaagtcctgcccccagtcagtgtcacttacctgctgcacaattaaattccagatatgttatcatttgttggtgaaggcaaagtagtatgtacttgacaagatagactgaatctagagtctcttcccaggtcaaagtcatactaatttgtttttccatgtgtgaactcaattcacaactcatttaggaatatcagtgctttcaatccaccactgaaagcaattaggagaatgaaattacgtctttttgaaaaaaaaaatagaatggctgagcgctctttcaggggcttgtctctaaactgttcaaataataaactttctgaatgtgccagggaaattagagaaggttctctcatgtcccctaggaaatagttttcatcttaattgccgctttttcgtggaattcccatcatacatgtttccagcttagaaaagtggctgggaaaaaagcctttcttagacatttgtttgtcttctgcctcctccctcccaccctttccttagcaataatgcctgatagatggggaagtaaagtctgttattagggactccagagatttgagcagacctttccacaagctgaattgttgatggggtttcctatagacttagctctaaagacttcagaatctgcatggatggatggatacccctctctcccagatactggaatacttcatgtcttccctaatcaagaaaatgggaagagcaaagtatacatgttttgccacatggtacttcacaaaaggccattgcttggtactatcatgtttccccttaagtgagttagaaaaacaggattttctttattttcttaatgtaaactttttgttaaagcaacgatattattgactcgcagcatttcagctttgttttctcttttgtattttcttccccactgaactgcagccagtgcattatgaagagaagaactggtgtgaggagcagtactctgggggctgctacacggcctacttccctcctgggatcatgactcaatatggaaggtattacgcaagcactacgccaattaatccaagacctgtgccaaatttaaaaggaaaagcagagttcaatgcaaattctagaaatagttgtcaaaatccccatttcttatgtcctagataatacttgtatatttctggatgtccatagaaaaataaggatgtcattacatagaacaatagctgtcagcatacagaacaatagcagaacagtggggaggatttcagatgtgaacagtgcttgtgagaatgaagcaagctacagtgtcctccaaggggacttcgtgagctcaacttgacatttagtctcacatgactgccttaggctccttggcaccagtcaacacagaaggacattggatgtgtttatccaacacttctgtcttgccaacagagcagcatcagcagacagtcctcttcaggggaagagtcctcactgtatacagttgagatgtgaggaaatgacatccacgtggggtgggtccaccttgacctagaagccccttgctccatgggagccattatctctatgcttcataggcatagtgtccggtaccttgctcagttataagacttgctcagttacaagagacaccacactcagggaagcccaaagtgatagcctcctaccaggtatttacaattcatttagagtcctcccagcctggatgcagttcactaatgtggggatgggaggggaggcacttttagcataaatggtgttgcctccatagatggcattacaccttcatctggtttccagagaaacagagctagaaagttaatacaaggtcacatttgtccactgaaaaggaggaagtatttattaaccttttcgttacaggagtttttagtctgtttttttttcttcttaattgagtcagatcgcctttgttaacaatagcaggattgatgaactggattagttctggtatcaaagtagaagtctagaagacaagactaagatgaggaatagatgaaacccagggttctggaattggaaaaaggagtgccaacgggttgagatgaaggccatcagggtggggggcaggacatgcagcttgggagagttcatgaaactagctgtggacatggcaggagtcaaagccaaaaagttggaggggacagctgtccattcagtccagcccttctttgtaagaggagacccatttccttgctctcagccagtccccagagaagttcagagaagctaactgtacagaggttgttttcttaaagagacacacccatataatgtctcaggtctctcctttgccagaaatgatagttgacgtccctgtcttcccacctgccactgcagttcctcctgacacactgggagtgcctgcaaagctggatctgtggctgttttcaagaagagtgcaccttcccccgagaaagacaggacagggagaagaatggactgccaacaggaaacagcaaagaaatctgatttggggattgaatacatgttcttatattccagctctggctggcttggaaaagatcaacatcccctttaatgattgatgatctgatggcctgattctccctgacttgaaagttcagatcctctatgcagatccagaaagcaaaaagtggcctttcaccttgggctaagtcatacgggtgttttttaaacagtctgaatttctgtgccttctgcagactaaatgagggcagtgattggctcatttaccctgcccaccttcccaagtaactctgtgtaacctcttggttcccttgaagggtgattcgtcaacccgtgggcaggattttctttgcgggcacagagactgccacaaagtggagcggctacatggaaggggcagttgaggctggagaacgagcagctagggaggtaagcaggaaagcccaggctctctccctcccgagtcacggcaacgtttttggcatctggtcttgctagttcttgacactgatagaatctgtatgtccatttctctgcccctcactcatggggctcatctgtggctagcagggccttgaatctgtagaaactatacagcctcttttcataataccatggtgactttctttcaggtcttaaatggtctcgggaaggtgaccgagaaagatatctgggtacaagaacctgaatcaaaggtaagtttggtgactctgggcactatctctccttagaccaatcatggaacataaaactcacatctcccttcttctagcctccgatttaattatagatgcaactatcccaggggtctccatgcatggatcttgcagtgttttgttcctccttgtcagcatgagttttttgctcatgatctgtgttccttcatctaggacgttccagcggtagaaatcacccacaccttctgggaaaggaacctgccctctgtttctggcctgctgaagatcattggattttccacatcagtaactgccctggggtttgtgctgtacaaatacaagctcctgccacggtcttgaagttctgttcttatgctctctgctcactggttttcaataccaccaagaggaaaatattgacaagtttaaaggctgtgtcattgggccatgtttaagtgtactggatttaactacctttggcttaattccaatcattgttaaagtaaaaacaattcaaagaatcacctaattaatttcagtaagatcaagctccatcttatttgtcagtgtagatcaactcatgttaattgatagaataaagccttgtgatcactttctgaaattcacaaagttaaacgtgatgtgctcatcagaaacaatttctgtgtcctgtttttattcccttcaatgcaaaatacatgatgatttcagaaacaaagcatttgactttctgtctgtggaggtggagtaggtgaaggcccagcctgtaactgtcctttttcttcccttaggcaatggtgaactgtcattacagagcctagaggctcacagcctcctggaggaagcagcctccactttggatcaggaaatagtaaaggaaagcagtgttgggggtagcggcatgcagaccctcagaccagaatggggacatcttgtggtctgctgcctcaggaatctcctgaccacttgtagtccctccgacttctctagacatctagtctcagtgctagcttatttgtatttttcctctttcacttcttatggaggagagtgtttaactgagttagaatgttgaaactgacttgctgtgacttatgtgcagctttccagttgagcagaggaaaatagtggcaggactgtcccccaggaggactccctgcttagctctgtgggagaccaactacgactggcatcttctcttccccctggaaggcagctagacaccaatggatccttgtcagttgtaacattctatttcaacttcaggaaagcagcagttttcttttaatttttcctatgaccataaaattagacatacctctcaacttacatatgtcttcaacatggttacctctgcataaatattagcaaagcatgccaatttctcttaagtactgaaatacatatgataaatttgactgttatttgttgagactatcaaacagaaaagaaattagggctctaatttccttaaagcaagctcacttgctttagttgttaagttttataaaagacatgaaattgagtcattttatatatgaaaactaagttctctatcttaggagtaatgtcggcccacaagggtgcccacctcttgttttccccttttaaaaactcagatttttaaaagccctttccaaaggtttcaactgtaaaatacttctttttacaatgtatcaacatatttttatttaaggggaattaacaattgccagggaaaccagccaacccaagtttattatatcattaaccttatcataaattcaaacctaagttgctggaccctggtgtgaggacataaatcttccaaagttttgcctatcctaagagctgcatttttctactgctctttaccttgcattttagctaatttaggagttttgagaatgtattggatacgctccagtacataaggagttgccgcatattatatcagactgctttgagaaatctcatccctagtctattgcagttgtttctattagcttactgattaactcagtcctgacacaccttttgggaaatgctgatttaaacttcttaactggcaacagttggaacagtaatcagtttgctaacatatttaaagtcttgaatgttgaagaactcatgtgatttacccttttcaactttttggaaaacgatttaatttattctaattagattaaccctattaatctatggattgggtatcaaaatgaatgccagtccagatgtgcctagacacgaaattggagctgaggactctcacgatatgcaagttcatccaacgtgaagataccataagctttttctctgaaccagagaaatgaaagtcagtttaagaggctgatagatcttggccctgttaaggcatccacttcacagttctgaaggctgagtcagccccactccacagttaggccaagaattagattttaaaacttcatctgtctgtcccagttaactgttaaataaggcctcatcctccactgaagagtatggattgaaggattgtgaactatgtttagtgtgattgtgaacttggtgcctaatgttccatgtctgaagtttgccccagtgctacacgttggagtatacctatgtgtgtgctttgccactgaagtaagattttgcctgtatggtactgttttgtttgttaataaagtgcactgccacccccaatgcagac

SEQ ID NO: 736 - DNA, 91918 bp, Homo sapiens; identical to SEQ ID NO: 735

SEQ ID NO: 737 - DNA, 162922 bp, Homo sapiens
attctgtaacttttttttttatttttttcaatttttccttcttttttttttttaagcactagtctgtgctttgcgaacagaatcaagacattaacaaagatcagcttctctgaagaaaagcatttctatagaacaaagacagctacatgtttcgctgccattacacagctccaaagcaggaaaagaaaatatttacaaaatacaaggttttttttttccattttttgtttttgttttttttttcaatgctaaaagggttattcagaattttcaaccttataaatagaagaagcactttatgcatagggatatggtgcattattgtatttttttttaaagaaacaatgacaaaccctttaacttgcaaacagaaaaaaaaatcactaatgttgaaaattgtgaaaaaaccccaaccattaagcagttgtctactatttttatacgattacaaaatggccaaaaaaaaagagtcttctcccccctccccctttttggtgatgtgatcatacaggagacaggcacaaggttaacagagaagggtgaagggggaacaatgggaaccacagctaggaccagacaatgttccacaggcaaggggagcgtgaaagaccaagagtggaactaacaccgacagggatctggatgtgaaggaaacatggcaaagtgaatcagagggaaaaaaaaaaaaaatcacacagggagatggctgctcacttcccacaacccccagtttgcaggggagtgggaatagaggttaagtagtcctaaccctaccttcaaagatcaggataggtggtaaaaatattccaagtggaaggacgggttgtgggtgtgtacatggcatgggagagcagacagggaagggtaccaaggggcatgaggaggggaacctgagcagccacagccaggttactgcagtgaaagagtcaaaacagagaagaccaaatgcagatgaaacaaaaaatcagtctcttaagttctgggtgagaaaggaaaggtgttctgccagctgagcactcggggagagcagctggcagttatggcagagaggctctggtggggatgttccagcacgaaaaaccaaggggacccagccaggagggccacagcagagccaagccacagatgggaggggagggggtaagagtccagagcaccctgccccattccaccctagctcaagaaggccatgctaaactgtagcccgccaggctgttctgccctgcccacaggtgtgagggagggggtggtcatctaagatcagtaagtccagtgattcaacagtgcagaggatgtgccaggaccaggccagcagggtctcatcctgaacttctgtttgccaacgggaggaagtgctcaggtgtgtgacaagaaaacatggaaacaaaaacaaaacaaaaattaaaacaagaaaaaaaaataccaaagtaggatctaaattccttaagttcactaaaaactgtgaaaatttccggcatatgatgtttgaatatcaaacgcagagatttctgaagctttaatgccaatagttagtgagtctgtttagatggctgtctcccgctcatctgtgagtcgggcgctgagctgtggctgctgccaccagatgccgactcttgagggggacaatgggaggcgaggtgggcgctgcctctgtctcccggccagtcttgctgcctgaggtgcgtcgagtgcagcgggctgctcgctcctgtgcatccagctggtcctcacactccgcctggggactgtgcgccagggggaaggtccgccgctcccagggctggacagactgtaggcagacaagttgctctttgaggacccagtcccagccagcctgcttcctgctccaaggccctgccacaaaccttgtggcctggagcctaggaccagtctatctagtgttcctgcgacagtctgggaacacccctcctagggtatacccagacaactgtattgatcatttagcagtgatcaatacagttccactgaacgttgaggagatcaatttaagtgcagccctttgtcccttcaaaagggggaggggatggctaggtccctcttcagcagatgctgccccttcctggttccatcccccaaccatgccaaccccacccaaaggctgcgtcccttacctgttcatccagccccagctctggtgtggaacaacgggtatcctcactggctaagtgtcgcggagtgtcccgagccacaggggtgaggggtgctgagtgcagttccgggctaatggggctcctaggggactgaccatgggagtattctgacaaagagtggctactgctgacatcaggggaggcaggctggggggtggaggggttggcactgcccagctggggggttgtccggccgtctgatgacctgtaggacctgcacaccaaggaatgcaaatctgagtgcctgggaaatgtttacttatgggggtagagggcatgaaaaaagcatccccactggaggagttgaggcaaacaaacaccaacagattttccttaggatccagcaactcccatttcttcccactattctctggaggggtaggtatacaacatttaccatcccaagaaaaaagcatggctgaacaatgccaggtgagtccatagcaaagtgcctagtgaattcaggaggttagggagattcgtgtagactttgaaaactgtagtcaaagaaaaaaaagtaaaagtaagagctcccaaaactttctacttgagaatcccgagggtttctgccactgttaacaataaatggagacagggtagtgatggacgttaagggggggcagtttcttcaagtggcatcacaaagccactgtccaaaggaaggttaacttgtagcgaggccttccaagctccccgggttgaatcaccatgaccccccaactgtcttccaaatgccacagatcatgggaattcagaattacatagtgacttctcagcaaggatctagcacttggctccttatatctccactagttccatgtatctccactagttccaacaaacaccaaggaaattctgagctatttgccactgccagtagatgagtatgatgagcaaccaagaggcagtagcaattccatggactcaagtagggcccaaactccctgtccaccctctctccacaggccctggggacccaagcctgccccatcacctgctgccccgccgctggggtggcacactcgtggtccacagccaccgtgccctctccatctcctcacatttggcatgcagggcggcgaaggctgcgtcggataggtcctcaatctgcaatagagcagcttcatcgatcccctcttttctccaggagttaagaaccagtcccaccccattctaggttcttcccggtcacgacaggaatacaaggagcttgcacttcacacccacaagtcttcaggccatttagggtgtgtgcactcatatgtatgtgtgcatgtgtacacacgtgttcttctaacagaagaaccaggccattacctcttcattctcctcatcaggactccccttcagagactgaagatcaacctcccgccagctgcaaaaccaagaacagacaatcatgagatggcaagcaggctaaaactgggggcagggtcaaagtgtccatgcaaggatgagaatcctgcacctgtgggtgacactgctctctgccgggtaggctctgccctatcacagctcagtctccctaccctgtcaaggcctgtgaaattggccacctactcaaatgcccaagaaggccagaaatgagagaagcggcctagggtaaggctgaggctgagagactgtgacaaacacaagaaaagaaacctgtttaaagaggaccaccactgttcaggaccagctgattgctcccatatggaaatgcatacccagggttgcctaatcttctgtttggcaacaaaagctggaaacaaagatttttatgtgaaatcctgctttgatgttgacaacaaattcagtattttaaaacatactgtatgtgttgacaaaaccggtctctagaccagtaagtgaatggcctaccaggctgtgactgctggttcgtttggtgtattcctataatggaatgagagagaactatatacagaaataatttcgttcttatcagataagaatttctcttaatgagaagacagaaccaaagactagggcccaactcttggtcagaagagaagagggaaaaagggcaatagcaggaagaatggggagaggagccaactattctgagcttctacctgggcgtaaggatttccttgtattgcagtttctctacgcgagttgttgcagcaacagacattgggatgacaatgttgttaatatcaaatgagctctctccccttctcctccttactggctgctgctgtaagataaaaattaagtttaaaaggaaggtacaattttacagacatcaaatcattcatctaagagttaaagcaggatcaccaataaccaagcatctgggtccttgggttgaagctgagtaatgaccatagcagctgctcccacctaggagtcagtctccaacagcaaaaaacctcacggagaaataccaggtggtcatgaggagttagtcccattcataagtcccactggtcaccctcttccttcaagggctcatgcgtaaatttcataggggtgggtacctgggatcttaactgttggggttcctactctatatacacctctattaacctcctctccttttacaatctttatttccttcctttatccccgtttatgacttaagactcatagtggcccctcccctaaaagcaatgcttgaaagcttatgctgaaagaggcccaaaggataggcccatctcaatacatcatctaaccttggttgtcatgaatgcacctccttctcaaagatctgaactcttcagctaaatctgcacccaccatctgcccagtctttatgtgatttcccctcttttgatgattcttggggaaagagctgagagctttctagctgtatcaaaggagatgaatggagggaaactaaagaggagaacctgactatacctcacattcctggtgaaaggaaatttgcttctataggaaatagttgagaagaccaaactcttggaaaaataagacttccaaggatcgaatatcagaggcagaggtaagcatctacagtagctgggagactagggaactaaatggcttagtctcttggatggaggaagaagtctactagctgctgctgcccagatagttaataccctatcctgaaacagagactagcaactgagctgtgagaggccagaaggaaacagtggcataacaaacacgctgccatggcaacaaaacagctggaaaacacctaagaggctgcatttatacctaaaccaccaagtgtggtcagtccacagggaaggggttggaggagtaagaagtcccctataactaacccctctatcctctgttcctggacggtgagataccctttattcatcctatcatcttaggacattctcagagaatgttaaaagtcagcacttcctgggccagagtttcagtcactgtcatttataacttcagatgaccacaatgcccttttcacttcaatttctttctctatcaaatcagatgactgccattgacctcagaaatttaggatatctggttaaccaaaatggttaaacagacttttggggatcttgcctgagttctgtagctgaggattagtgatctcatacccagagacctctgccactgccagatctgtgctgaaattatacatcccactacaagaaatgcatcttaagaaagcctcaagagagacagccttcccagtatcttggtcaagaataaatgtgaaactgctggcagaaacaggtatacactttccctgaaacttcttgggcttgttgttagtaccttcgagaaaaagatactggagcaggttgtgggatggttcaacgggctcttatctcatcctctgcctagacacaccccctattatgttagctactcattaggtctaaattaactactatctcctatttagagccagagatagagagcaggtgatgagaataaaactggttcccaaacttggttgtatatcagaagcaacattaaggagtattttttaaaaaaaaaaaaaaggttctaggactcccccccgctcttttataaaatcagaattttgtttgtttgtttgtttaagagatgaggtctcactatgttgtccaggctggactcaatctcctgggctgaagagatcttcctgagtagctggagctacaggcatgcaatatcacagccagcaacaaatcagatctttagaagtgtctggttggttggttttgttttttaaagctgctgaggtgattctgatgcagctactggcttttgggaagcactgacaaaaacactcgctctcctccctacctttctccagtgtcctctggcttctttacttgatttcaaggagagctggccctttgtatccatgggttcaaccaattgtggattgaaaatatttgggggaaaaaaattgtgtctgtactgaaaaggtacagatttttcttttcattattctctaaacaatacagcatactatttttatagcatttacattgcattaggtattatcagtaatctggagatgatttaaagtatatgggatttaaagcatacacataggttatatgcaaatactatgctattttatattagggacatgagcaacaatagcttttgctatctatgggaggtcctggaaccaatccccactgcagatactgcagatactgagagcctgctgttatctggcctatcttctttctttttttttttttgagacgaagtcttgctgcgacgcccaggcttgagtgcaatggcttgatctccgctcactggaacctccgcttcccagttcaagtgattctcctgcctcagagtagctggaactataggcacatgccaccacgcccagttaatttttgtatttttagtagggatagggtttcaccttattggccaggatggtctcgaactcctgacctcaagtgatccacccgcctcagccgcctccccaagtgctgggattataggtgagcgccactgtgcctggcctatcttcttttacataaatccagagtctttgaaaaaacttggcaatgagagagcctcaggggttagcatagtgctatacacaaaatttttactcaataaatggtaaaaatttcaagtgatccaggcctaagttaacattctccagacacagaaatattgaagtgctcaccaagtcctgaatctctgagttcagattttctatcagaattagtttagactcttttttataaatactttggttatctgaaaccctttgctgctggataactgagtatgtgagggacactacacacctatttagataaaatttgtgggttacgggggtaaagaaagtcgaagagcaaagagaccatttggaaaagattgatttgtaacagcaaagagagaacaatgtgaattcctacctgatcacaggagcctagtgagtccattttatgagcttggaagtttcctgatctaggctctgaaggaacttcctaagttgcctctgcaataccctcacccaggcttagcctgtgtagtgtaatggtaaaagagctggctctacagtcaggctgcctgagtttgaatcataattataaccctcacaagttgccttgacagttttcatgcatataaaatgaaatccacagtaccaacctacatctcaaaaggcattataacatgtaacacatgtaaatcactgatcactggtatgtagtaagtgttcaataaacattacagttgcagacttttacatttaccattacattacattgtaattattatacaaaaaggaccctttgagtaggtccatagcagctacaggtatgtatgttccaagagggcacacttgaggaattaaaatattagaatgaaattaaaggaaatgtgtctggaatagctgtgcaaactgcttccagatggagtgtggtatcgtaaaatctggtgtgtgcatgccaaatgtcctgccatgggggcctgctggatctgtaattctgctctgtatacctaaaaagcatggactctgccttctcccttcccttctcttctggtaccctcacgcctagtgtttattcttagtacttcacctccactcacccagagagtaaaaccaaggaaatcaaacactgcttccaacgcccatgggaatctcccctctacccacccctcctctcttgttcacttcttgggccaacaggattagggccacggaactgttgagtcctgtgtgaaacttagtccaacagatcttgaatagtcacagatcaccttaagagtttgtccctgcatcaagctttctatggatggctcagcataaatccatctctgctatgaaaaacaactcaagaaaaacaacagaaggtcaagtaccatgactttgacttaaaaatggtacagacatacatacatatgtcatgatgagctgagatcctataaatgccctgggctttataacccaccctcacactgtcctctggagccacttgagtgagctgtgacctgcagagggggtgtccggccaaccccacacaggtacttaccgatgtgctggctgtaacctgtgagctagagctggcgggtgcaggggaatctgaggaggtggagagctgtcgcaccaagggactgtgtggaggatggtgggtggctgccaagtagctcgaactgctcatgtctgtgtgatgcttcaacactgcagaagtcaacagaaaagagagaaatacatggctatcttaaccagcgttacttctaacacaagcttggaatggcagcaatacatactaaaggcaaaaatgttttctatgcctagaggataaaaaggtgaagcacactagctgtgggaagtaggggcagggcagaggttgctgtagcagttaagaagtgacctccatttagaagcagtagcgtccctctactctgctttcctagaaagtgaaggacaaagctgggggtaattaagagaagcctaggctgccccagaaagccctgagcaggtgcagttgcaggtagaggtgccatgggcctggccctaccttcacttctctcagatgaatggtctcgcaatctcattttgctgtggtttgggtcatgcacgggtggtggtgggttgagcaagcgctctgcttttggcgctgtcactcgctccaccatgggcacggcccccacatcgtctaagtgctgcctgtgggtcctgtcaggccgggtttggtgatgggacagctctgaagaggggaacagaaaaagagctgtgaaatatgtcctctcaaatattttcttattcgagttccaagctctcgagttctctctaggccaacgccgtatacccagggcagcaggacagtccttcaggactgaagtttctagtaatttgcacaatggctaggataggcacagggagcccagaaccagagaaacatgtcaccaggatacagaagacacctgcccgtagatgaactcaatgccatgccattgctggctgttcactgagcattttgggtcttgctccaagatccatggtgtctagaatagctcccgaagtccatctgagagcatccaagacaagcagaagcagtcactgtgagctgaattttttatcggtcaactgcctctcccaaccccaacatgcatgcaaactacaaatttgagaatataaaaggaatgaaaagtcactgatactctgggggacttcccggctccctgacacttactggctgttgttaggaaggagctgaccaatttgtgcctgtccttacgagctgaatctggcagactgcccggcatgggtgctctgtgcttaagcgataactttttgggaggtttgattttgtcaaaaggcttgttctgccactgagatttcagcatgctctggaaatgcaggcttgtgggaacatctgcaagaaacataaaatgctacaggttagtccaaacacctggcctctctagtgttcaagacctacactccatcctcctttaatttgcccagtggcctgacacttggcagggcaagtgctgtcatatggaagatctgtttacgtgaacattactgaaggtcattcttctatttgcaagcaggtcactttagctttttactttcaagtcccaaagggaaacaaaacaagacacctttttggtttggttgatggagtttttgttcttgtatccttgtttgttgaatttactggtttgaaaacatcctgtttctattctagagatttaaaaacatatttaagcctacttcttttctatcaatataaagttaatcaggatgcaattattcaacaatattcattatctatgttatcaggcactgtactgagtactacatactctctccaaataagaactacataccattctctctttccttcctctgtggctccgccaattcccatcatgagattatcggggatttttagctgactggttaatgttcaatatcacaaatcaacatcttttggactgaattttttatgctgtttcttatctttccattttcttagatttttcccaagaatatatccttgagcaattcctttagaaaaggaatttctagatttaaaccattttcctctcaaacatttaaagctattcaattcttccgtgtattctaatatccagtgctatatttaagagggaatcggattctttcttacttgtaggtggtctggtttttgccttttaagcttctgcaaaaaacaacaacaaacttgtggtattacactgactctacagatcaatttggggacaacttccatgtgttccaccaccaatactgaatctttcaatcgactgacgtggtatctctctctccatctatttacgtttgtcttgattttctcttgacagcgtttagttattgttgacataccggtcttaaatacaatttgttaagtttattcctaagaattagtgttttctgatgggcagaagttggaagagtttgcagggttcagaagaagacaggaagatgagggaaagtctggaacttcttagagatttgttaaatggttttgaccaaaatactgatagaaatacgggcagtgaaggccaggctgacaaaagtctcagatggaaatgattaaagatagtaccttttaaaatttcaacttcagttcttcattactagtatatagaagtacaataaactgctatataatgaccttgtagcctgtgaaactacttcgttatagactttttcttgtttattcagtaggattttctatagacataagtacatcatctacaaatggagactgttttaccttttctttccaatctgtattccttttttacttcttgcctattactctgactggaacctctggtgctgatgtacaacttttagattttccttttcatgttttcaatattctgacatttcaccaccatggatagcggtgtgagtctgttttcaagcttctgcaaagctttccagggatattcaaatctaaaagccagcacatttttcctcacctcccagttcctcctgggaatcggtaaccacttggggcatgctcagaagttcccgccagagtccctatccactgcttcagaatagaatgaaacaccactacttcaaggaagaaggctctggtggggtgagaggacaggaaaggaaaatctaacctagctattccaaaatgagtccaaatttatcacccagacaaatgcccaggtcctatcactactccttctgccctttaattctgggtcaaaaacctcctgtaatcagttcccacctcacagcaacttactcctggcatgtgctttgggctatctttctatttatttcttcacagttatcttgtctttatccatctttcaaaaataattacaaattccagtcactgatagcatgtcttctagaactattagaaatttattttgtgtgtgtgtgtgtgtgtgtgtgtgtgtgtgtgtatatttttttttttttgagacggagtcttgctgtcgcccaggctggagtgcagtggtaccatctcggctcactgcaagctccgcttcccgggttcatgccattctcctgcctcagcctcctgagtaggtgggactacaggcacccgccacctcgcccggctagttttctgtattttcagtagagacggggtttcactgtgttagccaggatggtctcgatctcgacctcgtgatccacctgcctcggcctcccaaagtgctgggattacaggcgtgagccactgcacccggcctgtttaatatattttctaaaagcttatggggttttgggtcccatagagcacagaggatatgctcaatctgaactgaggataagaaggcagggaagagacgtctaaattaacattactgaacccattattatctgccaggcactgtgtgtttatcatcatgcgtgtgccacttaatctttgtaacagttccatgaggcaaacacaattatgcttattttaaagatagggaacaggtgcagaaaggtacattaactatgtccaaggttacatagtttaatgagtaacaaccaactttcaaactcaagattatacaaccctaaagcccatactcttagacaatataccttgaggctactcactgatccagaggatggagaggattctgtagtaaagtcaattatttctcaaattactcccaagaaatagacagtacaaaatattttccaagccagttctgcagagtaaaagaaatttagccactcctgcctatggtatagatgatgaatttcatgacactgaatgttatgccttcgaggactgaatgttaggccttccaggactggaataaaaatctgagttggggaaaaaaaaaaaaaaaaaaagctaacattctcagggatgatttttcccagtgggtaagcaccctcagctccatgattgctgggctttatgacagtgaaacaaattaggaaaactattaaagttttaatgaaaacataacatttgctacctgtccaagtgtaaaaacacagtctctgaggacagtgctgtcttctcaaacatttttcataatcactcttttccacacttaaaaactcagctataccaaatcctaggaaataaagcattgtctagaagcattcggccctgtaaaacaatctgaaagctgggctgagctggaatgtataaaagaggctcaagaaaggagacgaggtcacttctgcccatcccacaatacccctttgtcagcagaagagttactcccacttggcaaaggctgtgtatgttttgtatatatatgtaatggaactccaaaaaacatagattttattttttccttttattttcccccatcgttctcccaaatctgaaaatgaagccaggaaaaaaaaaagggacagggatatgagagacctggttatagtgaaaacagcaatgactagaaacaagtaggcctggattcaggtcctggttctatctcgagtagaaggagaaagcaagaacaaatcattcagctgggctttagttccacctgtgaaatgaggcagtggggctagatcagggctggcaacattctagcattcattctctaaccctcctgttgtactggaggtacaaacacagctgtctttcctgttgtactggagacctcagattcttcccaaacaatacattaaataactccagacagttactgtcaattcatttgaataggcacaagaaaggacatctatttgttactgctagattatatgactgctatgagtctctcaactctaaaatgtttagtcaatgactcttcaactggaactccactcctaaacccttcccctcaactaaatgctcttaagtgcaagttggcacattgtagaacccaagtcatggaacactaccttgtactctccagttgacgtattaagcggaatcaagagcgattcctctttaaacccagtataaacagtttaaggaactccagctgctagactttgttagaagtttgctgtgttgccttttaattgcttccatgttaagagtgaacaggaacccagttatatcccccagtcagtaaaaaaaaaaaaaaaagatatcttaggaattgctggttgagttcatatactaactagtaagtgataatacctaggttctgtgaagagttaaaaatctaaaatagactggatacgggacctgaaagtaagcaaaaaaagggatatgaaatggaagagaacacaccagagatccattcagctagaggtctcctacattccatacccacataggtaaactgctattttcagagaagagggtgctgatccttatcaggtaaataacaggaaaataagacgaattactaatgtcatccttaagttactgtttcctcaaacaaaatgaaagatgaatgagaagaccctgacttcaggatgactagggtctgacattccacgattcacctggctgtctggctccttactttccaccattttctcaggcgcactttttccgggtgttttgtaatgctcacttcttcctcctgctgggaagttgctgtagcctcatgtgcagggtttggcaagctctctcaaaataccacagatcttcatggccagcaggtggtgctcttattaagccccttttataaagttaacaagcttttctccaaggttatatatcctctacatttccaactaaggattaactggatttgattacttgaggtgataaaacaaagcccccttcctgctggaatactaacaggttattataccctagtctctccaccttccacagccaggcgtagagttggctataacacagtccctcaatttctatcacccacacacacttaatgagaggggctgaggtacagtcaaggtgcgaggcacaactccaggatgaaaagcagcagttggttgttattctaacaaactacacaaactggttaggaaacagcactaaaactacttaaaaaaatatctgtcctatggggccagaaaacagctaagtatcacattcaaacaattttctgcctttatgtctggtataaatgtaactatatggaatcaatgaatcaaaatcatttttaaccttgttatgaaaaaaaaaaaagttggaaatcctgccactttaaaacatcttctagagaagaggttgtaagggtggcccagtagtaaaatctaccacacaaatgtttgacctacacagtcgtatgccaagctgctagccttcactgttatttactgctatacaatgatgtacagggaatcccaagacttcagggggtgtgttatttacacgggatattatgtgaatggtgccctttggagttggctatctctgcacccatgggaatcttctgatttccaaatggactgcattctgaatgtggcagttgtttgggtcaaagcaaaattattccaacaggaataatattagacatggtaatcaggtcttcaggtcaaccaactgaggtgtaattaatctacaggcaaatacagtagttaatagagcctacatgtaaaaatatatatatatctccacagtctcataaggagaatttaatgaccaactttttcgtccaaaccccagggccatagctagaagctcttcgtgtgtgtgtgagacatagacagaaaaacaaataggattagatgcaggaaaataaaaaccataaagaccagaaaagggggagtgttccctatctttctttccattccccctcattgctgcctgtagttgctctgaatgatggtgtgggaggtgtaaggtatgcggcagggcagcattcatgtcagatctatagtgtcctgcagtcagcaggacagaaaatgttcaagggaaatggaacctcttagtagagatgctgaatgatggaacaggagctgagagacacacagtctgggtatatctgagggtgggggaggttatttgcaactgtatgtggtaatgctgttgacaaagaaatgactgttctgtttagcaggtgatatccaatgagtgtgcttaagtgtccgggcttcctgtccttcttcaagtatgagactatacaattcaacacagtaattcagagagtaacccaacaaacattcctaagtcttcctagtggcgctgtctgtagccagaatcccaaaaagggtaaaaatctgactcctcttaataatctgtctggaaaggaacttgaaatatagtaaaaggaaggacaggcatcagataatctgggtctgaactgtgaaggcattcaaacccattagccatttagttttagataagccacaaccttaccaagcctgttccttgagcactaacactgaagtaacaccttacaaaatttctgggccgggcatggtggctcatgcctataatcccagcactttaggaagccaagatgggtagatcgcttgggcccaagagtttgagaccagcatgggcaacacggggaaacctcttctctactaaaaatgcaaaaaattagccaggcatggtggtgtgcacctgtagtcccagctacccactgaagtgggagaatcacctgatcctgggaggccgatgctgcaatgagccaaaaaccacaccactgcattctagcctgagtgacagagtgagactctgtcaaaaaaaaaaaaaaaaaaaaaaaaaaaaaaagccaggtgcggtggctcatgcttgtaatcccagcactttgggaggccaagacgggtggatcacgaggtcaggagttcaagaccctcctggccaatatggtgaaacccccatctctactaaaagtacaaaaattagccgggcgtggtggcgcgtgcctgtagtcccagctactcaggaggctgaggcaggagaattgcttgaacttgggaggcggaggttgcagtgacccgagattgcacgactgcactccagcctgggtgacagagcaaaactgtctcaaaagtaaaaaaaaaaaaaaaaaagaattttgaaagcagcatatgagacaaatatgagaagagtactacaaactttaaaatgctatacaaatagtaactgcagttacatgggctacataaatccaatggcaagggaaggtaaaagtcagtgactctggaatctgaagcacagaggaaaatgttttagtgttttccactcattgtgttcaagtttatttattgctccaccagctcctgactatccatgtgttccaggttttctgtttcctttctcttacaagaaatcacatggccacaggaatattacaccacatccttatcacagctagggggttttggtaacaaaagccaaaaatcccggtatctactggatttaggtggccagaaatgcaatcatttgaagaacagatgcagaacaggggattatagttatctaatatttgatcaactgtcaattagaaggattctctctaggacaagggttagcaatgattgtttttataaataaacttttgttgcaacacaatcaggttcatttgttcacatattgtctatggctgcttttgtgctacaatgacagggttgagcagttgtgacatgaactgacatcaattatatggcctgcaaagcctaagatatttaccatatggcccttgaagaaaaagttcaggccgggcgtggtggtttacacctgtaatcccagcactttgagaggccaagatgggtggatcacttgagctcagttcaaaaccagcctgggcaatatagcaagaccccatctttgtagggggcgggaggcggggaagcaggttgtggtggtgcacacttgtagtcccagatacttaggaggctgaagtgggaggactgtttagagcccaggaagtcaaggttgcagtgagctgtgatcactccactgaactccagcttagggcaccgagcaagaccctgtatctaaaaaataaaaattaaaaaaaaaaaaaaaaaaaaaaaaaaacttacagactacctgggagatattatgaagaacagcatggagcccttatcctcagggagattacatcccatcccttccccactccccccgccaccaagacagggtctcactaccgttccccaggctgcagtgcattggctcaatcatggctcactgcggccaagacttcctgggctcagctgatcctcccacctcagcctgctgagtagctgggacgacaggcgtgtgccaccacgcccagttaattcttgtgtttttagtagagatagggttttgccatgttgcccatgctggtctcaaacttctgacctcagatgatgaacccgccacggcctccaaaagtgccaggattacaggtgtgagccactgtgcctggtccctaaaatttaaataacagaaagcaaatacacaaacagccataacataattcattaacatattgataaaacacaatagggtaggtgcagtggctcctgactgtaatcccagcactttagggaggccgaggcgggtggatcacctgaggtcaggagttggagaccagcctggccaacatggtaaaaccccatctctactaaaaatacaaaaaaattagccaggcgtggtggcatacgactgtagtcccagctacttgggaggctgagacaaaactgcttgaacccaggaggtgggggctgcagtgagccaacatcacaccactgcactacagcctgggcaacaaaagcgagactctgtctcaaaacaaaacaacaacaaaaacaaaaacccaccagtgatttgagaggaaattcctaccttctgtaggctgggcacagatcatgagattacgtgaaaattcaatgaaaccaatccagattatgaaagcgctggcttccatctagaatagtggtttcaaaatgtctttgctcatgcacccccatttgatatgtgatttttaaaaaatcataatttcagatagttgtaaagattatatttgaatactacataatgctttaaaaacatttttatcaaaactttggcatgtaaatatatttagcttcattaattgaaaaaaaaaacttcttttaaacttatttagctaatcagactttagatattaactcagtatttattctaagacagacaaggaataggaccatgtaactgagctcagacccatcccagccactcgaagagttagagggaaatctcttagttgcaatcttttagtggtaccctctggtttggtagatctgttgcagtctttttggagaattctaagagaagacttggttgataggagttcctgagttatctctattttatttttaaaattcaaaacttttttgcttaatacctgggagattctccttcaggtgctgagaactcttagaaatgatctctttatttgttgtccccaccatccaagacctttttttttttttttttttttttttgagacagtcttgctctgtcgcccgagctggagtgcagtggcatgatcttgactcactgcgacctctggcctccaggttcaagcgattctcctcccaaataactgggattacagacatatgccaccacgccctgctaatttttgtatttttagtagagaaggggtttcaccatgttggccaggctggtctcgaactcctgatctcatgatccgcccgtcttggcctcccaaagtgctgggattacaagcgtgagccaccacacctggtctcgaactcctgacctcaagtgatctgcctgccttggtctcccaaagtgacgggattaaagacgtgggccacgacaccgagcctcaagatttttacactctggggcaagacccatagtgggactcaatatggccaaaaggaatgctcttcttttgtcaagtgggagaggtacaggtatgggaagggaggtgggaaaggagggctgtcagacacagagatttaacagggaggcaaactttagaaagacagtacaagctaacaacgaagatttgtgcttatctacaccctgcaaagctgtcgcgttaccacataaatgccagtatgaagatattctcctagaacactgccgtccatcctacattatatcatggcacgcacagacaaaacttttttttttttttgagacagagtcttgctctgttatccaggctagagtgcaatggtgcaatcttggctcactgcaacctctgcctcccaggttcaagcaattctcctgccttagcctcccaagtagctgggattacagacaggcacaaccacgactggctaattttttatatttagtagagacggtggtttcaccatgttggtcaggctggtctagaactcctgacctcaggtgatccgtccacctcagcctcccaaagtgctgggattacaggcgtgacccaccacgcctggcccagacaaaacatttttaaagatatactaagcgtattttggaccagattactgtggctagaggcaactgagcccagatccctcctagctacttgaagagttagaaggaaatctcatattaagttgcaaccttttagtggcaccttctggtttggtggatctgttacagtctttttgcaaaattctaagagaagacttggttgacgaaagttgtaccttgaaagtatctgagttgtaactgcaccttggctgattttctttcacctagaagtctctcaagtttctttcattagactttctagtctgtggtctttcttaccatctggaaatgctagaacaggatgaacacaagagtccaactgggaaagacgttccaacagaggggcttcatagtgaatttcgggaggcatggtgttgatgctgcctgaaccacacagtgcgcaggagggattcacatcacagccagggcggattgtgctgttccggtgaacctgtgaaaaaagccaaacaaaactgacaattcagcatctgataaaaagccagctacccatttgttatccccatttgttattgagaagttagctccccatttgttattgcgaagacctttctagatacttgtgtgacactactaaaaggatgtttgattagtttgttaaaagatttccatttgtctaacacactgaccttcaaagtgggtaaggaaacttgcttccttttcattgatgaaatctaactacttgaagctctaagtgcttacctaggtatcaaacttctgacagtttaaaaagatactaaaactgtgctttctgagaacactttataaactctgcatgctttcacgaccttgatggtccgctaagacgaacagttggttcttgattcccaggtgggacattacttgctttcttcagcaaatttatccacctaggagccttcaattaccaaccacacctcttctcttcttttcacacctcttcttcaaaagactttcaggtggtctcaagccaggtggcaagcttccctgaagcttgtaacttaaaagtaacttattaactactctttaacctggcctaaaatccactgttacaaagctcatacctaagtaataaaataacattttgtacagcaaatgctcactttcatagtcttcatgttagattaattccaaagggtagaaattatttccactgaacttcctttgtgcacatgtgggcagaataattgataacctctccaggtaagtccaaagttaaatatgaactaatttaagtcttcaaaagattgaattctgtataaaaactgaacatctacaattttatactttgagcaaatttcaggtcatgctgaatgcaggatccctacattctagtgttaggatgaacaagtctggcatttgccaaagcctaactcataaagtcacctggacacacagccccagaaaaagaaacttgcatgttgaatggcactataagaaggcatcctaggtgcaagctcagtagtagaacaaagacaaaaagcatcaaaactctactagcaaaaactctaacatttactagagctccatttattttcagcagagacatctcgaaagccttttatggatttgtgtaagagaaagatatacataagaacaatgtggtctttatcaacattcccccgacattctattgtaaccacatagagaggtggcacgcaaataaagtcttttaaaggttagactgggcaaatcacacagaactagaagccactgaaagggagtgataccaactaggcatgctacttttgtgtagacaatattaactggtattgttttgggaaaaaaaaaatccctgtatctatgtaatcagagctggctttctggagaggatgacattttgaggtaaagagaaatgagtaggtagagatgaaaatgagatcacacagtgggtgagtgggaggatttaggaaaattggttaggatccaaaaattacactgaaactttcaatattcaaaagagattatctcactccagtaggtatagcaaataaaaaataaaaagagagagactagaaaccaacccatgacatcaactagctctccatatgggacatttaacaacactacattttatggctagagtgtatcacttaagtcaaagtcaatattgggaggccaaggcgggtggatcacttgaggtcaggagtttgagactagcctggccaacatggtgaaaccccgactctactgaaaatagaaacgtcagctgggtgtggtggtgggagcctgtaatctcagctactcgggaggctgaggcaggagaatcgcttgaatctgggaggcagaggttgcagtgagctgagatcacaccactgcactccagcctgggcgacagaatgagactaagtccaaagacaagcaaacaaacaaaaaaacaaaacaacaacaataaaaaaattcaatagatgtggctaggcgtggtggctcacaactgtaatcccaaaactttgaggtgggagagaggattgcttgaagccaggagtctgagactagcctgggcaacacagtaagactccatctcttaaaataaaatttaaaattaaaaaaaaaaaaaaaaaaaaaatttagcccagcatggtattgcatgcctttagtcccagctactcaggaggctgagggagaagaatcgcttaagcccaggagttcaggttatagtgagccatgattgcaccactgcactgcagcctgggaaaaagagtaagatcctgtctccaaaaaaaaaaaaaaaaaaaaaaaaggctgcgcatggtggctcacgcctgtaatcccagtactttgggaggccaaggtgggtggataacctgaggtcaggagttcgagaccagcctggccaacatggtgaaaccccgtctctactaaaaatacaaaaaactgggcatggtggtgggcacctgtaatcccagctactggagaggctggtaagagaatcacttgaacctgggaggcagaggttgcagtgagctgagattgcaccactgcactccagcctggggaacaagagcaaaactccgtctccaaaaaaatttaaaaatttaaaaaaataaaataaagggtagaaattctacttataacttgacaaaagggtaatgtgcacacatgtaacttaaacagtaatctcacttttaaattaaaaactgtaaagtactaatagaacccgaggagtatataaaaatatatttaatacttattttttttttgagacagagtcttgctctgtcacccaggctggagtgcagtggcgcaagtctgccttccaggttcacaccattctcctgcctcagcctctcaagtagctgggactacaggcgcccaccaccacacccagctaatatttttgtatttttttagtagagacagggtttcaccattgttagccaggatggtcttgatctcctgacctcgtgatctgcccgcctcggcctcccaaatgctgggattataggcatgagccaccgcacccggccaaagatatatttaatacttattaaaggatacattttggaaaatttttgaaagaaaacttgaattcatacccatgttgcacaaatccacaccaagaatctatcctgcagacaaacttaagtgtacacacgcacacgctcttccactgaaacaagatgccaaatcatctgcatgaattcatttaagttaaaaaacaacaagaacacacacaatattgtgttttacaataagaaaacaaatttttaaaaatatcacaacagatggtgtgcacgtgtagccctagctatttgggaggctgaggtggctcacttgagcccaggagtgaggagctatagtgatcatgtccactgcactccaggcctgggagacagagtgagtcagtctcttaaaagaaaaaaaaaacaaggatctcctgggctcaagagattcttctgccttagcctaccaagtagctgggattgcaggcatgcaccaccacgcccagctaatcttttatatttttagtagagacggggtttcaccacgttggccaggctggtctcaaactcctgacctcagatgatccacccgtatcagcttcccaaagtgctgggattacaggcgtgagccatcgcgaccggtcccagtcatgaaatcctattggcagaatccaaccacttcataccacctcaactacactcaatctagtccaagtcactatcttttctcaaatgggtttcttcaagcctcctaactgatcctcctcctactggttcttacttccaaatcaatcaacacagtaatcagtgtaaatcttgttttaaaatctcaatcacatcataccaacctcataatcttccaaatgacttctcatctcacgaggaatagaaaccaaacttcttgcatggttcccacaaggtcctatagtatttgtcgcctctatcccctctctctgacttcacctcatttttttgttactctcctagctgacactaccagttactctgatttccttgctatatttctccaagatagcaggcaaccttccagatcacaggcctctgcacttggctcttcaaccactaattccatggtcattctctcacatcgtgtctttttctttaaatgtcagtattcaaagtaactttttttttttttttgagatggagtctcgctgtcgcccaggctggagtgcagtggtgggatctcagctcactgcaagctacgcctcctagcttcatgccattctcctatctcagcctcccgagtagctgggactataggcgcccgccacaacacctgactaatgtttgtattttttgtagagacagggtttcacggtgttagccaggatggtctcgatctcctgacctcgtgatccgcctgcctcagcttcccaaagtgctgggattacagacgtgagccaccgtgtccggcccaaagtaagttttatttagaaatacaagtgaaaggccaggcgcggtggctcacgcctgtattcccagcactttgggaagccaaggcaggtggatcacctgaggttaggagttcaagaccagcctgaccaacatggtgaaacctcatctctactaaaaatacaaaaaattagccgggcatggtggcgggcgcctgtaatcccagctactcgggaggctgaggcagaagaatcgcttgaacccaggaggcagacgttacagtgagctgagatcgcaccactgcactccagcctgggcgacaagagcaaaactccctctcaaaaaaaaaaaaaagtgaaaaaagattatattcttgactgtaacaacaaaaaatgccctggaataagtttaacaagaaatttaagcacaaagcttaaagatattgatattctacaaattaatgcagaatcttaatagacttgaggggggaggggagacaaggcaaaggggatttaaacaaataatctaaaagatacaactgaaagaatgtaaggaaccattccccaaaatttctgataagcaaaaatacaggggagtgatctggcctattacatgttttatagttacagtaattaaaataatctgccctcggttaagaaacagaaaatttaaataaaaacaaaaattgaccaaagtatatatgacagtttattgtttaactaaaataatacttttaaatcagtttaaaaaaacaaaaggaggtattactttttcaacaaatgaatcaggaaaaccaagaggtcatacagaagaaaacggctgcatttctgcctcacaccaaaattaattctaaataaagatttattcattttcattttattttatttttttgatacagagtctcgctctgttgcccaggctagagtgcaatggtgcgatctcggctcactgcaacctccatctccgggttcaagtgattctcctgccttagcctcccaagtaggtgggattacaggcacccaccaccaagcctggctaatttctgtatttttagtagagacgggggtttcgccatgctggcaaggttggtctcaaactcctgacctcaggtaatccacccaccttggcctcccaaagtgctagaataacaagtgtgagccaccgtgcctggccccaaataaagatttaaatataaaaacaaatattatactcaaatctaaaaaaaaaaaaattgtgaagcaatatatagtggttaacagtatgagctgtggagccagactgcctgggtttgaaccttgactccgccacttactagctgtgtggccttaagacaagttactgtgtcttcatctttactaacaggagagtacctgatagagttgttttaaagataaataactcacaacagtatctggctctcgactcttaatcacttttgtaaaaccgtaagtatagctactgatagaacatttaccatcaaacttgatagaacatttaccatcaaagatcttgatttcaaaattctagcttcttaacactgtataatatgatcattgataagtcacatgacatccttaaattttctcacttgttaaaaaggactaataataccaatttcatgggagtgtaggaaagatcaaatgactctgtaactgttaaaacattacacaaatgttagctaaattagtataccgcatgatttctcaacagctggcacttctttgttgtggggcacagtcctgtgcactgtagatatctagcagcatctctgtcctcatggtgcatgtgcctccctactcccccaatttgtgaaaatgagtaattactacagatattgccaaatgtctcctgtgaggacaaaatcactgagaaccatgaggttcaaattacggtcatcccgtctagaaaaattcaaagcacaggctcccattaaatattagtggtgagtcacagtaaacataagactcagtaaaaaaggaaaacaaaaaaaataaaaattaatagtaagaacaaagctctcaaagactattgtcaagaacaagcctgaagagagcttcccctaccaaagatcagataacgttagcatcataaagaaaagactacaatggcttgaaatacctcaaatatgtttcaatcaatgactcacagccccttcatgaaaaacttcagtgactgtccttagaggatagtagaaaactaatttgttattttgaaaattggtaaataaaaaaaaacaacaaatcatgctttcttctgtacaaactgtacctcagggtaaacaaatagttgaaaaggacaattttccctttataaacatattctatctagctaataaaagaaaaacagaaatgatacaagtagaatatcaccattcttcagcttccaatttaacaatgggtccaggcaatgatcaccagtggttgataacaaacagtttagtcattacgtgtcttctgatacaagcataaggcggccaccttgtgttttctcacgaaactaaaactggacttattcacgtttctactagttttcaagaaaaacaagggacagaaaaacatcactgttttttaaatgcactaaaaataagatggattaataaatggaaggatgattgtatgctaaaatgttagtggtagaacctagggagtagctacataggtgttcactgtaaaattcattcaacttcgtatctgaataatttcataacaaaatttggaaaagaaaacagtgacaccacaggacttctgcttctagcagagtaatagtgatcagatttacctttcagtcataaaccagaaaactggacaacaggcagtataacactgagaaataaatggggtggtctctaagactgccctggttttccgtctggaagtacattctagactgcagggcagggagaggatctgaagcagagtataatagcttcactgagttgaggaagcaaattctcactagatcagaattcagagactaaggaaactgaaaattgcaaggcaaaattcttgagaggaggaagctttacagaaaaagagccccagaaatcttcataagatccccctgagtgtttgctaaatattaaaaggtgcatgtaaagggtgaaactatcaggccaggcaagagcaactaggcagctgtgagctgaaatggtttccacagctaacacaagcctgagaggcttttaaactgtgaccagccaaagttgcatagagaattcaagacagaagatcctgctttagttgtggagctagactactaaggtggccaactcctcacctgacctaacaaatgacaaggaatttacctgccagcaaaacaaagcctctttaaaggaagatggcacaatccacatgctacaagcagggaaaattattaattggattttcagcttaaaacataaataaaacattgttagatatgccaagaggcaagaaaatactactatagggataaaatttttaaaagaaagtaggctgtgggaaactaaggtatcagataaatgaagttttctcaacaaataaatcacctatatggatagtttgtatcaaaccaacactctcactaattggaaaagccagatttaaaacacacacacacacacacacactctctctctctctctctctctctctctctctcaaaacataagaaaaatgctgacataatgacaatattgaaagctaagattccagagaggaaaagaacctggccaacatggcgaaaacccatctctactaaaaacacaaaaattagctaggcatggtggcacgtgtctgtaatctcagctacttgctgaggcaggagaatcgcttgaacctgggagatggaggtttcagtgagccaaggatgtgccactgcactccagcctgggcaacagagcgagactccatctcggaaaaaaaaaaaaagaaagaaagaaaaaaaaaagagcagagcttttggtactcttgtagggctgaatggataacactagagacttgaaatgtcaaattatcaataaaaagaggacagggaactaagcatgacacacttccaagtaccaccctcccaaagaaatagctgaagttgtgaatggtaggaggctacaaagctaagtggaaagtctctgaaaagggcagagatgtttctggcagtctcgtgaggagactagaattagatctcaggatatgctaagaggaaaggaggctgggcacagtggctcacacctgtaatcccagcactttgggaggctgaggcgggcagaccacctaaggtcaggagttcgaaaccagcttggccaacatggtgaaaccccgtctctactaaaaatacaaaaattagctgggcatggtagcacgcgcctgtagtcccagctacttggaaggctgaggcaggaaggagaatcatatgaacccgggaggcagacgttgcagtgagccaagatcatgccattgcacttcagcctgggtgacagagcgaggcgaggctctgactccaaaaaaaaaaaaaaaaaaaagagagagagagagagagagagagagagaaaaggaaactgatcaacacatgttctcagctggaactaagagagagaaacagactgttatctttttgagacagagtctagctctgctgcccagactggagtgcagtagcttgatcttgactcactgcaacctctgcctcccagcttcaaaccattcacctgcctcagccacctgtgtagctgccaccacagctggcttttttatttttgagatgaagagattgcaccactgcactccagcctggcgacagagcgagactccatcttgggggaggggagggggacaaaaaacaaacaacaacaacaaaaaatcagcctgtgcaacacagtgagacctgcatctcaataaaataatgagataaaatacttgatacacgaagaaattcccacgttcccttaattaatactgcaatgctatcaattctctttgaaggaattcccaagaaatactcaatttaatacttatgaaggaattaataccaaagtaaaactctattcaccattttctgttaatcatagcatattcgtccaaaacactaaaagaattcttttggctcaaggacaggttataatcatttgcttttgctttgcatttgatattcgttatctaactcatccactgttaacatgtggaaagattttcaaaggtttggcaactctatcacaatcaagcatatcccacaactggctcttgaagatccatcagagtgaagaaacaaaacgtgtaagcttctattttatctcagtctttcaaaatttattttgtatgtgttttataatgtatatataaaacaccgtcataacagtttagaggtaactgttccaagcacagagtgatttctgagtattcttttagtagctttatgtcctaaggtacaattttctacatggcatgcttgctcctttccaaatgtctaactagtatgaaaaagttggttgggcctccaaggtctattgcactctgtcaaggaagaacgtatcaaattattaacttttaatactgactcatattctagttcattagtcctcaaccatggtgtcatgaaactggatttaaataggtggaatcaaaactaggaggcctagaatcatatattaacacctttatttaccctgatgtctacaggaaacctggtcatagccatgagagaatgccctgtacaaaaatgtcactcttcaagtgtgatacaatgggaagaagaggaggactactcggaattctatggaagccagctttaaaatttggcccagagcaatcccccctatgacaacaaggactacaaaattctaaaatgatgccagtacactgccaatttgttaggaaattgctactttttaaaaaattgaaagaaatgctattaagggcaataaaaatttcaagggtatgttagtaataaatgtagccattacctattctactggttattagtacaaaaaaacccagccttttcaaccattcatttccaaacactgatggtttccactgccagactatacacaagtttctaatggtccacagtaaattgagaatgagaacaatgcagtaaattattaataaaactacattcttttcttttttaaaaaaatactatttgtcttatggtttaattataaacataattttacttaaaaaataaaaagcaaccttatttgaaaattggctggtaccaattttattttaataactttattgatctgaaatcttagtacgtttaggttaagttataaacacctacttcacttaggcactgggccaggaaaagaacataatggcatataagaactttccactggagtgcttcttcattcacttagataattactaacatccaccatactagacccctaaagtgatgaaacacacaataaatagcaatataggctattcagtaattacaactagtaattccgtcattttataataaaattatgatttaggaagtactccatgttctccatgagccttactctgatattcacttaccacaccctagtggttattccttagattacatttaaaatattccacattcagagttgtagaggccttagactattatctcctccaggattactactgttagtctgtctttccacctccagtctcttgtgccaatccatcccaaacataatagttacagattggccgggcgcggtggctcacgcctgtaatcccagcactttgggaggccaaggcggatggatcagctgaagtcaggagttcgagaccagcctggccaacatggtgaaaccttgtctctactaaaaatacaaatattagccaggcgtcgtcgtgggtgcctgtgatcccagctactcaggaggctgaggcaggaaaattgcttgaacccgggaggcggaggctgcagtgagctgagattgtgccattgcactccagcctgggtgacagatcaagactccgactcaaaaaaaaaaaaaaaaacaaacaaacaaaaaaaaaaaaaaaaacatgttacagcagatttacctcccccaaaatagcttacaacacttctctgctcaaaaatttaaaacttatagactgaaacccaaatcatcagtttgggcattcaaggcttcctatttatttactgatagatctcatttctctttattcccaacgagtttaacttactgaacactttgttttagtcattgattttaagaagtacaagtgatataacaacagctttttttttttttttttttttttttagatggactctcactctctcaccaggctggagtgctgtggcgagatctcagctcactgcaacctctgacttcttggttcaagcgattctccagccccagcctctcgagtagctgggattacaggcacgtgccaccacgcccagctaatttttgtatttttagtagagatggggtttcatcatgttggccagggtggtcttgatctcctgacctcatgatctgccccaccttggcctcccaaagtgctgggattacaggcatgagccactgtgcctggccagcctttttaagggcaaaagagttactgcactaaacgtgcatctcaattttaagatatattccagccataattcaactaagctgatagccctttaaaaacacagtaattgggctgggtgtggtggctcacgcctgtaatcccagcactttgggaggccgaggcgggtggatcacttgaggtcaggagttcgagaccagtctggccaacacggtgaaacctcatctctactaaaaatacaaaaaatagctgggcgtggtggcgtatgcctgtaaccccagctactcgggagaatgaggcaggagaatcgcttgaacccgggaggaggaggttgcagtgagccgagatcgcaccattgcactccagcctgagcaacagagcaagactccatctcaaagaaaaaacaaaacaaaacaaaacctcaatgagttccctcaagtatgttttatttggttctggaatgcagtagagatcatttaagatgcaggtaaggaaaaaatattaatcacttgctttgtgtgttctgtactctgtactcacaataactgtgaactcactgtcatgtaacaatattagaacataatttacctgttaacttctttgctgtcattagaaagtaagctccatgaagataagggctttgttttccttaccaatgcaacctggctgccctgaataatacggtgggcattcaaaaatgctgttgaataaatctgtctggaaaaccgagcaattcaagatgacagaagacaagatgcttgctcatcagcaaataccactgaggtcatgtcatgagtgaggagccatgtgagacacagaaagcaacctagacagaaggaatggggtgtgtctctaactctggaagaactccagctttctgctagatctagtacatggtatatttcccaaagtcaactaatttctctgtcttatttttcatgcagcttacttttgtgtcaggatgattctgttttagaaagtggcattggaacaaaaggatatttagttttatgcctatctcttgcctaagctaccttttataattttatatgtacattcaaaactacattcgttcttaggcatggatcagaagaaggttggctacttcacatattaaaaaacaaaatccaggaggccaccacatacttcagaaaatttttatacgactcctgatgtcatgccatagtggctggtaaactgccaaaacagaggaagggtgctttattttcatgaggtggcggttttttttttttttttaaaatgtaaaagcattctgtgttaaattcatcaaggaattgacaaaaagctattttcctacacttgacagtaatatactgttttctgacattcctgttatcaactcctctgaaaatcttttagagatatacgactattagtaaaaaaaaaaaaaaaaaaacaaaaaaaaaactgagactgaaatgtcaatatgaaaaccctgccaaataccttattcttatctatttctgctattttgatatttcaggtagagtccgaggaatagacaggaagaaatggtatcgcctgacagtcaattctacaattcttttctttaaagagaacatggcaaacttacacagtacaactgcatactagaataaaacaaggaaagtactgaaaattcaccatgcaaatactaattgttccagcaattctctcatctcccttatttgtcattagcaaatatgttgctagtggctctcttaagaaaaattcccattctctgctctcttttacagcaacattctttgaaaatgttatctacaatggttccctcaattccttctgtggccttgtctcctgaaaccactccaaccatgctttaattcacctttctccctctaccaaaactgctcaccaatgtctgcaacaaccccaccccactaaattcaatggtctcaattctcagccttcatcttactgatcctgtctgtaacaactgacacagacaatccctcctcctcctccctctccaaaacactttctccccttgcctttcacataccacactctcttggtttttcttctactttattcgtcactcccttcccaatcctttcctcatctttcacaggaatgaggaggaatacctaagctctggaatacatcaaagggctaatccatatacctcttctttatctgagctctccagcactctctattccctcctctattgcatttctctctccaggattttttttaattaattaattttttattattattatactttaagttttagggtacatgtgcacaacgtgcaggttagttacatatgtatacgtgtgttttttttgtttgtttttttgtttttttaaaagacagagtctcaatcactctgtcatccaggctggagtgcagtggcacaaccatggttcactgcagtgtcaacctggtgggctcaaatgatcctcccgcctcagcctcctgagcaaatggactacacacgctcgcccacagcaggctttttttttttttaaagatatggggtctcactatgttgcccagactggtctcaaactcctgaacgcaagtgatcctccttcctcagcctcccaaagtgccaggattacaggtatgagccactgtgcctagcctctctccaagatttaatgctataggacacactgcagagttcatttattattttctttctcttaacaactagaatatttcatagggtaagcacttttgtctgttttgtttagtgttgtatacccagtgactagacagatttagctcgttgcaggaagccaataaatatttgttgaaagaatgaatgaacaacaacaaaagtggtaacaataacagccactttgtacgaggaacttatcaaccagacatcccaataagcatgttacatatatttcattgaaccctcaaacaaccctatgagatctctgaggctttggagaggagtggaagtcagggtggttaacatgcaccaaattaccaaactactaagtggtagtaccatgattcaaacccaaggttatcatcttcaaagataatgctcttaattcctgcacagtaccaattttactggaatattattatctcattagttttggaataaaggcaactgctatttgaagagtcagcaatctaaaattccctacagttgtgaattaatctccatttcctttgtgaagacaaacttttttttagtaatatcaatttaaaaactttagtgaagattcctttttttctcaggcagggtctcactctgtcacccaagcttaagtacagtggcacaaatacagctcaaagcagcctcaaccttatgggttcaagcaatcctgcctcggcctcctgaatagctgggactacaggtgtgcaccaccatgcttaatttttaaatactttgtagagatgaaggtctcactatattttccaggctggtattcaattcctaggctcaagcaatcctcctgccttggcctcccgaagtgttgggattacaggcatgagccactgcacatggccaagattcttttttagggcaaaggattctatactgccattttcagtgataacagtgaaggtgagagggcacactattctccttcaaagtgttaagggcagtacttaaactttcagtctctcccatttctattaaaaagctcaagacagtggttttcaaaactagctgcagagtcaccgaggagctttgtgttttctgaaaacaagattccaacatccaactccagagcaaacagggcccaggaacctagtattttataaagctccccagaagaccttggtggttagccaagtttagaaaacaccaaagttggcaagagactaactctatctgagcatctggctcactgcttgacaatgaccaactctcatctgtaccgaccttcttggaaagaggaacgatgctgttgggtcgaacaagcctccgcttcttacagctcagtacaggacgtgtccgggctgccacacaggtgccatcagatgatgaagagacgagattcagtcgttgcttcttatgtaattgttcctcagcatcagagctgtcacctggaatgtggtctgccaagacaggctgaagactatacaaggggaaggaagagtattctcagaacacacaaagaaacaaaataaataaacaacaagaaaacacaaagaaacaaagcctcttatactagttcaacctctatttgctaatgttcagacacaaagaagcattctagagcagaagcaggtctcctcttgatgtctgttaatctacctgtgtgtgcttatgtgtaaggttcttggtgcacattaactacatcatgtctgaaagataaaagtcaataaataaactcaagttctagtgattgagttctcctctacatcaaacacacgagtaaataaagtctagagaactacagttggttagaaaatgatgaattttgcaaatgttaatgggcttccttagaatcagttctatgaaacccgaattttaagggtgttgtacacatcattcacttgtacagaatctccctgaatcttttgttttctcccttgaatcttcataaatacagatttacaaacatagcccttggagatctaatctgtcctaagcagaggaggttaatataagcacttctgaggaattcctgcaagattaaaacaataataattcacagtaactgtagtgtcttttattttactccatgcccactccattttagtaggtaaaaggaaaatatacaattaattaaaatgcactgcttcattatacagtgaagattaaaaatgttactaagtgataaggcttccgcttctttaaaccagggtcagtcctggctaaagagaactaagagctccaaaacacctttacaagtctactaagtgtaggaagtagaagagctaaaacttacgtgttaataactccattgacaggtctgagtgctccacatgatttggtagacagtgactctgaaatatgaccaataataggggcaccatggttttccaatggctgagaaacagactcaatctgattaagaaaaaggaaaaaagaaattaacatgtacccaagcgcacccctgcctgaaaagcaccaccacttcatttgcacaaagcacctaaaacttctgatgatcaatttgaaaaacacaacttgaatgactgaagaaaaagaaaataagagaatcagtggtcaggtatgatggctcgcaactataattgcagcactttgggaggccaaggcaggaggatcgcttgagaccaggagttttgagaccagcctgggcaacacagcgagacctcatctctaattaaaaagagagagagagaggttgacagagagaaggagaatattatattagcttttgctttggggggaagagggatgaggaatccaaatgtacagactaaaagtaagtacctattgacaggaaaatgacctcaataattctatggaacagaagcttagcaaaacaattacacagtaacataagctttcaactaatgatcaagaaggatatactaacatcagtatcaagatgactaagaggaaatttaaatgtagttaatatctgcttaactctaacagagtatgctagaagcttgttttctaaaaactatgctttgtttaaaaatatacacacaggccggggatggtggctcatgactgtaaccccagtattttgagaggcaaaggtaggaggatctcttgagcccaggggttcaagaccagcctgggcaacatgacaaaaccccatctctacaacaaaaaaatacaaaattagccgggcatggtggtgcgtgcatgtagtcccagctactcaggaggctgaggtgggaggaggatcacctgagccaggaggcagaggctgcagtgagccatgatcatgccactgcactccagcctgggtgacagagtgagaccctgtctcaatgaataaataaataaataaacacacacacacatttttccctgacagaaaacaaagttaataaaatctcaatgaatctaattatctgatgctatcagatactaactattgtctttagagtattcaaatcaaatatgtttagaatataaaatgaaataacagatgagaaagaatagaaaaagtgtgatttgcagtattcaaaacaaattatatatttactaggctcaaaacggataggaacagtatgaatgccagtcatatagcacctctgaggtataggcaataaagcaacagatgcagctatccctcagttctagcaattgttgaactatcccagaaaggctatgggtctttgactccttactttatttttttgagatgaagtctcgctatcccgcccaagctggagtgcagtggcatgatagcagctcaccgtagcctccacctccctggttcaagcgattctcctgctttggcctcctgagtagctgggattacaggcacacactaccatgctcatgtaatttttgtatttttagtagagatggggtttcaccatgttggccaggctgttcttgaacttctgacctcaactgatctgccctcctcggcctcccaaaatgctgggattataggcgtgtgagccaccacacctaacctgtctccttacacttgaactgactctggggcacgctgaagttctctttcctataaaagctttcaaggtaaatattcctataaatgcttcctacaaatgctttcaaggtaaatattttgaggctgaaattctacttttcaatactgatttcttttgtctttatacccccaaggataaaacaccaaaggactgaacctgaaagtagtcctagacaagcatcaaaaagaacagactgaggctgggtgtggtggctcatgcctgtaatcccagcactttgggaggctgaagcaggcagatcacctgaggtcaggagttcgagaccaacctagccaacatggtaaaatcccatttctactaaaaatacaaaattagttgggcatggtggcgcctgtctgtaatcccagctcctccgggaggctgaggcacaagaatcacttgaacccaggaagtggaggttgcagtgagccaaatcacgccactgcactgcagcctgggaaagagagagagagagactgtctccaaaacaaaacaaaacaaaaaacaaacaaaaacaaaaaacagattgggaagataatctaaaagttttaatacaaattatcctaaaatacagatcaaactatatacacagacaagtcatataagtatgctacaatgagtgaacaccgagaaaaggctgtcttttttgttggatatcctgtacatctactaagatatcacaaacatcttgaacaattgtcaatgctatcaaaaattacagtaaatctggcatagacacattgccttaagctctatgcagatttcccttggaaagaaacacggtattaagcagcaagagctataaggatattcctatcttctgacaaaatattctaaccaatttttaaaaatctaccctaaaggagtaactcaacaaacacagccccaaaaatcttattcacaaaggtggtcactgcaatgatatctatcaataatctaaatgttgtaagcattataactatagttatcagttgtggtacaccaaatcaaaatattaaaaagaatcataaaggatatttcttctcttatggaagaagagatttcaagagaaaaaaataatagtttaatatagttgtagtgactaaaaatatacatacacagataacaacaagacaaagagtgttacagttgtaaaactattctgaaattttctttacattttaggtaatagttttatattaaaaagaaacccccataaaaccaaataccctcctgaatgctagtaaggatttactacacaggggaaacctcaaaaaggctaaacaaatatggtatgacaaagaacaagaaaaatcaaaagaatttaagattcaggttggtattaactaacagatgtataacttcaggcatgttataggtattctagatttcagaagttctggtttagatgaaaaagtttcctttcaatagaaaaatgctgtttaaaaatgctgtttgtttttatttcggcattaaattatggcagtgatttgatttatatatggtatatataatttatatggtatatttgatttatatatggtatatataatttatatggtagtgccttcacgtgttctagaaggtactacgtttaagtaacgggttgactgactctccatttgattaagtttttctggtagggattatgagatttaactgcaagaacacttgtcaagataaaatgttgccattctctaacaaagtctcatttcaaaacatttatctttcttatacaaagtctaaagaagaatatgtcaagtaaaatcaccagtaatgtcacgatccatatagctaactactactgctataacagcctgtcttgtttctcatgtctgcaggtgtatatatttaaatgctattcagctttaacatgaatgttattgattttcttatagaaacctgaatcttcctggagtaattcagcccccaaatcaaaattgaagtcaacaggcaacacattattaacatggaaatgttgtcaagaacatagaggtatacagaggtcaagagcataaacatcagaaagggactgtggctggcctgcattcccagccacaaaaaagaaagcactggatactcaggaaggatctacttcagatcttgggaaattctgtaatcaagctagtatccaacagcaggcatttggacatgtcctgcaacccatcatcaatgcaaagagcttaaaatattaatcccaatcacagtgttccatttggaaaaagaaaaacataacacacaaacacatgtaatttcacctagctccttaaatgcaggcactctcccttgagaaaaaatgaacatttcctatcctgcagtctaaaaggctgcaaatgcagaggataaacattaacaaacacttaagaaatattaaatccgcatactaatttcagcttattactactgcagtggtttacatcattagtgtttttagaaaactaaagcatgactgagatatctgctatccaataggcaactgcaaaaaggatgaaagaacttaagactctcctacctagaaaataaggattatcactgaagcttccatttgaattttatttgatgttgagatgaactcagggtttatgcatcccacagccagaaagaaagagtagaaaagctaaagtggtagacagagtgcctctgtaatcccctcctctccaaagcagggccctaggggattatcttttggagtaatcttacagttaaaggtagcaaggagggttgctgaattgctccccccacccctccccccgccccgattgaaagggccaggtgtacagcataaaattactaacatagcaatgagattcaaatttgttattcacataaagcaggcatctcattcattactccactctgggccagatcaagtaagcgtgacaaagaggccttgaatgaaaagctaaaactaaatagtttttacgggggtcgttttttctagggtctaagaaccaatgtctactagatttgtttcaccaaaaagtagagagggttaaggggtaaaaacagagagccacacacttaaaagcacacaataaaattaaactctacctgcaaatatgtatttttactttattcaattaatgccatgtcacacctgcttgcaatgtcattttttaaatgtatcacattcgtttggctagaaaagtcaacagttcagttttggttagttattccctttctgacaaacattaaaatggaaagaaaatgctaactgggtgacaggaatttaacttattcctgggttaaaatagtttttgactttgtatgattgatttcatgtctcaagcccaccccacccccatttcaatgatactgagcatagtttcgcttaaattcaccaaaatattgctggcctataaatagtatactagccatttccattagctagcaccatggccataaaattgtactaaacaagaagtggaatgttctgaaaattccattttcactaagttattgcctaggctttaatttctgcctatgtggggctatgtgcctcactttccggcttctgcaggttgaggataaaagaaaatctataaaattacattataacaattttgaactcatttttttaaagttttgattagcataatgctgttactaatccaatggttcctaagcctaagatttatgtttaccaacacttgaaaataactatctagaatttaaagaaatatagcaaatgcaaaaatgcatcttaaattcttattgttcaacttatttatccatagcccaatttattataaaagacctaacttgtcagtgttttctaacactgtgggtcaaatatttcttggccaatatctgtccctttaccttctatcccaaaacccttgtcaggccaatgaactactcactgtccctagagactgcaaaacttcaaagaaaggaagagtattcctacttacaccaatggaatgaagatgtatcttggactgtgtaaaaagaaacagcaatagcttacatttttagcatgcctttcttctgagaaagcattagctcttcacttaatagtacacttgtttttctcatcacttctgtaaagtaggatgagcaaggaaagggtaaaggagcaggatcattttacaaacagaaactaacacacaaataatgtgttacttgttaattgccatagaagcaatgtttttcgctaaacaaaaccctccttaacgtcaaatctagtattttaaaaaatatttatccaagaaggagattttaaaaaatatatacatgtgtctgctcatcggtgcaaaaaaatacaggaaagataagccaaaacgtactgaaattgctaacctacaggacgttgagtgagaaaaggatataaagaagaatgtatagcttttttagaaccacagtaatgtttcccatacaaaaataaaaattaacaatgcggggtggggaaaacagggaaggctagaattgaatactgtagtaacaaatgaacctaactgtattacaaaacaacataaccatactgaaagatttggtggaaggaaataactaacctacgtaacttcagaaaactgtattttgactgcataacagttaacatactgtacaaaaatattgtactctagttagcaaatgtgtttttcacaggggtactagatgacaactgtgagactatacgggtactaggattaaacgagtatcaataaggaagggggaaggctgctgtgttgaactggtatgaacttacggttttttatatatatatacaggttaagtagatacagaaatatagatgtgtgtgtatgcacctgtgagcatagatacatatgtttccttgctttgccttttgagacatcctagaagcagtgacacttacgaagtaacaatgagcacaactagtactcagattttagttcctaataaaaggaacctgagctgaagtaggcaaaatacaagaggaacctggaacatctagtattagaaagtatttcaaaatataagcggtacatgctaaaaggacacaggagccaatctgaaagagcgcccaatacccaaagttgagataactggagcaactgtataaacagtaataggttataatccattaaataaaataaatatccatgggaccatcctgatattcacaactgagtcaatgaatgagtaaataaatgaggggggaagacacctcttcctaacagaattccatttaatgcaggtaggaagtagaacaaccaccctttagtaaacaacacagcaataattgctgtaggaaaaagtcatcagtgaacaataaaattatgagtaaaaatataatgagcaacagaatatttacatagtgtctccctataagacagtcatttattccagccagggcaaaatggcaaaaccttgtcactacaaaaaacataaaaatgtgccaggcatggtggcacatgcctgtgatcccagctacttgggaggctgagagatgggaggatagctgagccagggaggtgaaggctggagtggtgattgcgacactgcactccagcctgggtgacaaagtgagaccctatctctaaataaataaataaataaataaataaataaataaataaatattgtcagttattacaaagggaaaaatgctaattttacagaggagaaagctgtcaggcaccaccttaaccaagggaacaaacctatcatcactattagaaagacaagtcaaaatcatgaaccccctgtggtgtagagaagggtacagtatcttctgtggcattcctgtaaaacaatgcgtaacctctaataatgagaaaacaccaatttgtggaacgctatacaaaataactgaccagaaatcttgtatccaagtaatgaaatacaaaaactgagaactctcacatattgaaggacatttagagatgcaaaaactaaaagcaatgatagattctggacaacagaaaggacattaataagaaaactaataatacagaaattcaaataaagtatgtctattactttgtataagttcaatgttaatttcaatgttaatttcgtggttctgataattaacgattattgtgacaagatgtgttaagattagagaaagctccgtacggagactctgtactactatttcaacacacacacactctctctttctttctgacacaatctcgctgttgaccaggctggaatgcagtggcacaatcttggctcattgcaacctctgcctcctgggttcaagtgattcttgtgcctcagcctcccgagtagctgggattacaggcgcacaccaccacacctggctaatttttgtatttttagtagagacggggtttcaccatgttggccaggctggtctcaaatttctgtcctcaggtgatctgcccacctctgcctcccaaagtgctgggattttaggtcaccgtgcccagcctaaaatcatattttaaaagaatgaagaaaaaatgtatctagcattaataaaacaaacttcattcatacataaatctgtacagtctacaggttcctatcagttacagtactcacttaagataaatatagaatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccg

SEQ ID NO: 738 - DNA, 162816 bp, Homo sapiens
attctgtaacttttttttttatttttttcaatttttccttcttttttttttttaagcactagtctgtgctttgcgaacagaatcaagacattaacaaagatcagcttctctgaagaaaagcatttctatagaacaaagacagctacatgtttcgctgccattacacagctccaaagcaggaaaagaaaatatttacaaaatacaaggttttttttttccattttttgtttttgttttttttttcaatgctaaaagggttattcagaattttcaaccttataaatagaagaagcactttatgcatagggatatggtgcattattgtatttttttttaaagaaacaatgacaaaccctttaacttgcaaacagaaaaaaaaatcactaatgttgaaaattgtgaaaaaaccccaaccattaagcagttgtctactatttttatacgattacaaaatggccaaaaaaaaagagtcttctcccccctccccctttttggtgatgtgatcatacaggagacaggcacaaggttaacagagaagggtgaagggggaacaatgggaaccacagctaggaccagacaatgttccacaggcaaggggagcgtgaaagaccaagagtggaactaacaccgacagggatctggatgtgaaggaaacatggcaaagtgaatcagagggaaaaaaaaaaaaaatcacacagggagatggctgctcacttcccacaacccccagtttgcaggggagtgggaatagaggttaagtagtcctaaccctaccttcaaagatcaggataggtggtaaaaatattccaagtggaaggacgggttgtgggtgtgtacatggcatgggagagcagacagggaagggtaccaaggggcatgaggaggggaacctgagcagccacagccaggttactgcagtgaaagagtcaaaacagagaagaccaaatgcagatgaaacaaaaaatcagtctcttaagttctgggtgagaaaggaaaggtgttctgccagctgagcactcggggagagcagctggcagttatggcagagaggctctggtggggatgttccagcacgaaaaaccaaggggacccagccaggagggccacagcagagccaagccacagatgggaggggagggggtaagagtccagagcaccctgccccattccaccctagctcaagaaggccatgctaaactgtagcccgccaggctgttctgccctgcccacaggtgtgagggagggggtggtcatctaagatcagtaagtccagtgattcaacagtgcagaggatgtgccaggaccaggccagcagggtctcatcctgaacttctgtttgccaacgggaggaagtgctcaggtgtgtgacaagaaaacatggaaacaaaaacaaaacaaaaattaaaacaagaaaaaaaaataccaaagtaggatctaaattccttaagttcactaaaaactgtgaaaatttccggcatatgatgtttgaatatcaaacgcagagatttctgaagctttaatgccaatagttagtgagtctgtttagatggctgtctcccgctcatctgtgagtcgggcgctgagctgtggctgctgccaccagatgccgactcttgagggggacaatgggaggcgaggtgggcgctgcctctgtctcccggccagtcttgctgcctgaggtgcgtcgagtgcagcgggctgctcgctcctgtgcatccagctggtcctcacactccgcctggggactgtgcgccagggggaaggtccgccgctcccagggctggacagactgtaggcagacaagttgctctttgaggacccagtcccagccagcctgcttcctgctccaaggccctgccacaaaccttgtggcctggagcctaggaccagtctatctagtgttcctgcgacagtctgggaacacccctcctagggtatacccagacaactgtattgatcatttagcagtgatcaatacagttccactgaacgttgaggagatcaatttaagtgcagccctttgtcccttcaaaagggggaggggatggctaggtccctcttcagcagatgctgccccttcctggttccatcccccaaccatgccaaccccacccaaaggctgcgtcccttacctgttcatccagccccagctctggtgtggaacaacgggtatcctcactggctaagtgtcgcggagtgtcccgagccacaggggtgaggggtgctgagtgcagttccgggctaatggggctcctaggggactgaccatgggagtattctgacaaagagtggctactgctgacatcaggggaggcaggctggggggtggaggggttggcactgcccagctggggggttgtccggccgtctgatgacctgtaggacctgcacaccaaggaatgcaaatctgagtgcctgggaaatgtttacttatgggggtagagggcatgaaaaaagcatccccactggaggagttgaggcaaacaaacaccaacagattttccttaggatccagcaactcccatttcttcccactattctctggaggggtaggtatacaacatttaccatcccaagaaaaaagcatggctgaacaatgccaggtgagtccatagcaaagtgcctagtgaattcaggaggttagggagattcgtgtagactttgaaaactgtagtcaaagaaaaaaaagtaaaagtaagagctcccaaaactttctacttgagaatcccgagggtttctgccactgttaacaataaatggagacagggtagtgatggacgttaagggggggcagtttcttcaagtggcatcacaaagccactgtccaaaggaaggttaacttgtagcgaggccttccaagctccccgggttgaatcaccatgaccccccaactgtcttccaaatgccacagatcatgggaattcagaattacatagtgacttctcagcaaggatctagcacttggctccttatatctccactagttccatgtatctccactagttccaacaaacaccaaggaaattctgagctatttgccactgccagtagatgagtatgatgagcaaccaagaggcagtagcaattccatggactcaagtagggcccaaactccctgtccaccctctctccacaggccctggggacccaagcctgccccatcacctgctgccccgccgctggggtggcacactcgtggtccacagccaccgtgccctctccatctcctcacatttggcatgcagggcggcgaaggctgcgtcggataggtcctcaatctgcaatagagcagcttcatcgatcccctcttttctccaggagttaagaaccagtcccaccccattctaggttcttcccggtcacgacaggaatacaaggagcttgcacttcacacccacaagtcttcaggccatttagggtgtgtgcactcatatgtatgtgtgcatgtgtacacacgtgttcttctaacagaagaaccaggccattacctcttcattctcctcatcaggactccccttcagagactgaagatcaacctcccgccagctgcaaaaccaagaacagacaatcatgagatggcaagcaggctaaaactgggggcagggtcaaagtgtccatgcaaggatgagaatcctgcacctgtgggtgacactgctctctgccgggtaggctctgccctatcacagctcagtctccctaccctgtcaaggcctgtgaaattggccacctactcaaatgcccaagaaggccagaaatgagagaagcggcctagggtaaggctgaggctgagagactgtgacaaacacaagaaaagaaacctgtttaaagaggaccaccactgttcaggaccagctgattgctcccatatggaaatgcatacccagggttgcctaatcttctgtttggcaacaaaagctggaaacaaagatttttatgtgaaatcctgctttgatgttgacaacaaattcagtattttaaaacatactgtatgtgttgacaaaaccggtctctagaccagtaagtgaatggcctaccaggctgtgactgctggttcgtttggtgtattcctataatggaatgagagagaactatatacagaaataatttcgttcttatcagataagaatttctcttaatgagaagacagaaccaaagactagggcccaactcttggtcagaagagaagagggaaaaagggcaatagcaggaagaatggggagaggagccaactattctgagcttctacctgggcgtaaggatttccttgtattgcagtttctctacgcgagttgttgcagcaacagacattgggatgacaatgttgttaatatcaaatgagctctctccccttctcctccttactggctgctgctgtaagataaaaattaagtttaaaaggaaggtacaattttacagacatcaaatcattcatctaagagttaaagcaggatcaccaataaccaagcatctgggtccttgggttgaagctgagtaatgaccatagcagctgctcccacctaggagtcagtctccaacagcaaaaaacctcacggagaaataccaggtggtcatgaggagttagtcccattcataagtcccactggtcaccctcttccttcaagggctcatgcgtaaatttcataggggtgggtacctgggatcttaactgttggggttcctactctatatacacctctattaacctcctctccttttacaatctttatttccttcctttatccccgtttatgacttaagactcatagtggcccctcccctaaaagcaatgcttgaaagcttatgctgaaagaggcccaaaggataggcccatctcaatacatcatctaaccttggttgtcatgaatgcacctccttctcaaagatctgaactcttcagctaaatctgcacccaccatctgcccagtctttatgtgatttcccctcttttgatgattcttggggaaagagctgagagctttctagctgtatcaaaggagatgaatggagggaaactaaagaggagaacctgactatacctcacattcctggtgaaaggaaatttgcttctataggaaatagttgagaagaccaaactcttggaaaaataagacttccaaggatcgaatatcagaggcagaggtaagcatctacagtagctgggagactagggaactaaatggcttagtctcttggatggaggaagaagtctactagctgctgctgcccagatagttaataccctatcctgaaacagagactagcaactgagctgtgagaggccagaaggaaacagtggcataacaaacacgctgccatggcaacaaaacagctggaaaacacctaagaggctgcatttatacctaaaccaccaagtgtggtcagtccacagggaaggggttggaggagtaagaagtcccctataactaacccctctatcctctgttcctggacggtgagataccctttattcatcctatcatcttaggacattctcagagaatgttaaaagtcagcacttcctgggccagagtttcagtcactgtcatttataacttcagatgaccacaatgcccttttcacttcaatttctttctctatcaaatcagatgactgccattgacctcagaaatttaggatatctggttaaccaaaatggttaaacagacttttggggatcttgcctgagttctgtagctgaggattagtgatctcatacccagagacctctgccactgccagatctgtgctgaaattatacatcccactacaagaaatgcatcttaagaaagcctcaagagagacagccttcccagtatcttggtcaagaataaatgtgaaactgctggcagaaacaggtatacactttccctgaaacttcttgggcttgttgttagtaccttcgagaaaaagatactggagcaggttgtgggatggttcaacgggctcttatctcatcctctgcctagacacaccccctattatgttagctactcattaggtctaaattaactactatctcctatttagagccagagatagagagcaggtgatgagaataaaactggttcccaaacttggttgtatatcagaagcaacattaaggagtattttttaaaaaaaaaaaaaaggttctaggactcccccccgctcttttataaaatcagaattttgtttgtttgtttgtttaagagatgaggtctcactatgttgtccaggctggactcaatctcctgggctgaagagatcttcctgagtagctggagctacaggcatgcaatatcacagccagcaacaaatcagatctttagaagtgtctggttggttggttttgttttttaaagctgctgaggtgattctgatgcagctactggcttttgggaagcactgacaaaaacactcgctctcctccctacctttctccagtgtcctctggcttctttacttgatttcaaggagagctggccctttgtatccatgggttcaaccaattgtggattgaaaatatttgggggaaaaaaattgtgtctgtactgaaaaggtacagatttttcttttcattattctctaaacaatacagcatactatttttatagcatttacattgcattaggtattatcagtaatctggagatgatttaaagtatatgggatttaaagcatacacataggttatatgcaaatactatgctattttatattagggacatgagcaacaatagcttttgctatctatgggaggtcctggaaccaatccccactgcagatactgcagatactgagagcctgctgttatctggcctatcttctttctttttttttttttgagacgaagtcttgctgcgacgcccaggcttgagtgcaatggcttgatctccgctcactggaacctccgcttcccagttcaagtgattctcctgcctcagagtagctggaactataggcacatgccaccacgcccagttaatttttgtatttttagtagggatagggtttcaccttattggccaggatggtctcgaactcctgacctcaagtgatccacccgcctcagccgcctccccaagtgctgggattataggtgagcgccactgtgcctggcctatcttcttttacataaatccagagtctttgaaaaaacttggcaatgagagagcctcaggggttagcatagtgctatacacaaaatttttactcaataaatggtaaaaatttcaagtgatccaggcctaagttaacattctccagacacagaaatattgaagtgctcaccaagtcctgaatctctgagttcagattttctatcagaattagtttagactcttttttataaatactttggttatctgaaaccctttgctgctggataactgagtatgtgagggacactacacacctatttagataaaatttgtgggttacgggggtaaagaaagtcgaagagcaaagagaccatttggaaaagattgatttgtaacagcaaagagagaacaatgtgaattcctacctgatcacaggagcctagtgagtccattttatgagcttggaagtttcctgatctaggctctgaaggaacttcctaagttgcctctgcaataccctcacccaggcttagcctgtgtagtgtaatggtaaaagagctggctctacagtcaggctgcctgagtttgaatcataattataaccctcacaagttgccttgacagttttcatgcatataaaatgaaatccacagtaccaacctacatctcaaaaggcattataacatgtaacacatgtaaatcactgatcactggtatgtagtaagtgttcaataaacattacagttgcagacttttacatttaccattacattacattgtaattattatacaaaaaggaccctttgagtaggtccatagcagctacaggtatgtatgttccaagagggcacacttgaggaattaaaatattagaatgaaattaaaggaaatgtgtctggaatagctgtgcaaactgcttccagatggagtgtggtatcgtaaaatctggtgtgtgcatgccaaatgtcctgccatgggggcctgctggatctgtaattctgctctgtatacctaaaaagcatggactctgccttctcccttcccttctcttctggtaccctcacgcctagtgtttattcttagtacttcacctccactcacccagagagtaaaaccaaggaaatcaaacactgcttccaacgcccatgggaatctcccctctacccacccctcctctcttgttcacttcttgggccaacaggattagggccacggaactgttgagtcctgtgtgaaacttagtccaacagatcttgaatagtcacagatcaccttaagagtttgtccctgcatcaagctttctatggatggctcagcataaatccatctctgctatgaaaaacaactcaagaaaaacaacagaaggtcaagtaccatgactttgacttaaaaatggtacagacatacatacatatgtcatgatgagctgagatcctataaatgccctgggctttataacccaccctcacactgtcctctggagccacttgagtgagctgtgacctgcagagggggtgtccggccaaccccacacaggtacttaccgatgtgctggctgtaacctgtgagctagagctggcgggtgcaggggaatctgaggaggtggagagctgtcgcaccaagggactgtgtggaggatggtgggtggctgccaagtagctcgaactgctcatgtctgtgtgatgcttcaacactgcagaagtcaacagaaaagagagaaatacatggctatcttaaccagcgttacttctaacacaagcttggaatggcagcaatacatactaaaggcaaaaatgttttctatgcctagaggataaaaaggtgaagcacactagctgtgggaagtaggggcagggcagaggttgctgtagcagttaagaagtgacctccatttagaagcagtagcgtccctctactctgctttcctagaaagtgaaggacaaagctgggggtaattaagagaagcctaggctgccccagaaagccctgagcaggtgcagttgcaggtagaggtgccatgggcctggccctaccttcacttctctcagatgaatggtctcgcaatctcattttgctgtggtttgggtcatgcacgggtggtggtgggttgagcaagcgctctgcttttggcgctgtcactcgctccaccatgggcacggcccccacatcgtctaagtgctgcctgtgggtcctgtcaggccgggtttggtgatgggacagctctgaagaggggaacagaaaaagagctgtgaaatatgtcctctcaaatattttcttattcgagttccaagctctcgagttctctctaggccaacgccgtatacccagggcagcaggacagtccttcaggactgaagtttctagtaatttgcacaatggctaggataggcacagggagcccagaaccagagaaacatgtcaccaggatacagaagacacctgcccgtagatgaactcaatgccatgccattgctggctgttcactgagcattttgggtcttgctccaagatccatggtgtctagaatagctcccgaagtccatctgagagcatccaagacaagcagaagcagtcactgtgagctgaattttttatcggtcaactgcctctcccaaccccaacatgcatgcaaactacaaatttgagaatataaaaggaatgaaaagtcactgatactctgggggacttcccggctccctgacacttactggctgttgttaggaaggagctgaccaatttgtgcctgtccttacgagctgaatctggcagactgcccggcatgggtgctctgtgcttaagcgataactttttgggaggtttgattttgtcaaaaggcttgttctgccactgagatttcagcatgctctggaaatgcaggcttgtgggaacatctgcaagaaacataaaatgctacaggttagtccaaacacctggcctctctagtgttcaagacctacactccatcctcctttaatttgcccagtggcctgacacttggcagggcaagtgctgtcatatggaagatctgtttacgtgaacattactgaaggtcattcttctatttgcaagcaggtcactttagctttttactttcaagtcccaaagggaaacaaaacaagacacctttttggtttggttgatggagtttttgttcttgtatccttgtttgttgaatttactggtttgaaaacatcctgtttctattctagagatttaaaaacatatttaagcctacttcttttctatcaatataaagttaatcaggatgcaattattcaacaatattcattatctatgttatcaggcactgtactgagtactacatactctctccaaataagaactacataccattctctctttccttcctctgtggctccgccaattcccatcatgagattatcggggatttttagctgactggttaatgttcaatatcacaaatcaacatcttttggactgaattttttatgctgtttcttatctttccattttcttagatttttcccaagaatatatccttgagcaattcctttagaaaaggaatttctagatttaaaccattttcctctcaaacatttaaagctattcaattcttccgtgtattctaatatccagtgctatatttaagagggaatcggattctttcttacttgtaggtggtctggtttttgccttttaagcttctgcaaaaaacaacaacaaacttgtggtattacactgactctacagatcaatttggggacaacttccatgtgttccaccaccaatactgaatctttcaatcgactgacgtggtatctctctctccatctatttacgtttgtcttgattttctcttgacagcgtttagttattgttgacataccggtcttaaatacaatttgttaagtttattcctaagaattagtgttttctgatgggcagaagttggaagagtttgcagggttcagaagaagacaggaagatgagggaaagtctggaacttcttagagatttgttaaatggttttgaccaaaatactgatagaaatacgggcagtgaaggccaggctgacaaaagtctcagatggaaatgattaaagatagtaccttttaaaatttcaacttcagttcttcattactagtatatagaagtacaataaactgctatataatgaccttgtagcctgtgaaactacttcgttatagactttttcttgtttattcagtaggattttctatagacataagtacatcatctacaaatggagactgttttaccttttctttccaatctgtattccttttttacttcttgcctattactctgactggaacctctggtgctgatgtacaacttttagattttccttttcatgttttcaatattctgacatttcaccaccatggatagcggtgtgagtctgttttcaagcttctgcaaagctttccagggatattcaaatctaaaagccagcacatttttcctcacctcccagttcctcctgggaatcggtaaccacttggggcatgctcagaagttcccgccagagtccctatccactgcttcagaatagaatgaaacaccactacttcaaggaagaaggctctggtggggtgagaggacaggaaaggaaaatctaacctagctattccaaaatgagtccaaatttatcacccagacaaatgcccaggtcctatcactactccttctgccctttaattctgggtcaaaaacctcctgtaatcagttcccacctcacagcaacttactcctggcatgtgctttgggctatctttctatttatttcttcacagttatcttgtctttatccatctttcaaaaataattacaaattccagtcactgatagcatgtcttctagaactattagaaatttattttgtgtgtgtgtgtgtgtgtgtgtgtgtgtgtgtgtatatttttttttttttgagacggagtcttgctgtcgcccaggctggagtgcagtggtaccatctcggctcactgcaagctccgcttcccgggttcatgccattctcctgcctcagcctcctgagtaggtgggactacaggcacccgccacctcgcccggctagttttctgtattttcagtagagacggggtttcactgtgttagccaggatggtctcgatctcgacctcgtgatccacctgcctcggcctcccaaagtgctgggattacaggcgtgagccactgcacccggcctgtttaatatattttctaaaagcttatggggttttgggtcccatagagcacagaggatatgctcaatctgaactgaggataagaaggcagggaagagacgtctaaattaacattactgaacccattattatctgccaggcactgtgtgtttatcatcatgcgtgtgccacttaatctttgtaacagttccatgaggcaaacacaattatgcttattttaaagatagggaacaggtgcagaaaggtacattaactatgtccaaggttacatagtttaatgagtaacaaccaactttcaaactcaagattatacaaccctaaagcccatactcttagacaatataccttgaggctactcactgatccagaggatggagaggattctgtagtaaagtcaattatttctcaaattactcccaagaaatagacagtacaaaatattttccaagccagttctgcagagtaaaagaaatttagccactcctgcctatggtatagatgatgaatttcatgacactgaatgttatgccttcgaggactgaatgttaggccttccaggactggaataaaaatctgagttggggaaaaaaaaaaaaaaaaaaagctaacattctcagggatgatttttcccagtgggtaagcaccctcagctccatgattgctgggctttatgacagtgaaacaaattaggaaaactattaaagttttaatgaaaacataacatttgctacctgtccaagtgtaaaaacacagtctctgaggacagtgctgtcttctcaaacatttttcataatcactcttttccacacttaaaaactcagctataccaaatcctaggaaataaagcattgtctagaagcattcggccctgtaaaacaatctgaaagctgggctgagctggaatgtataaaagaggctcaagaaaggagacgaggtcacttctgcccatcccacaatacccctttgtcagcagaagagttactcccacttggcaaaggctgtgtatgttttgtatatatatgtaatggaactccaaaaaacatagattttattttttccttttattttcccccatcgttctcccaaatctgaaaatgaagccaggaaaaaaaaaagggacagggatatgagagacctggttatagtgaaaacagcaatgactagaaacaagtaggcctggattcaggtcctggttctatctcgagtagaaggagaaagcaagaacaaatcattcagctgggctttagttccacctgtgaaatgaggcagtggggctagatcagggctggcaacattctagcattcattctctaaccctcctgttgtactggaggtacaaacacagctgtctttcctgttgtactggagacctcagattcttcccaaacaatacattaaataactccagacagttactgtcaattcatttgaataggcacaagaaaggacatctatttgttactgctagattatatgactgctatgagtctctcaactctaaaatgtttagtcaatgactcttcaactggaactccactcctaaacccttcccctcaactaaatgctcttaagtgcaagttggcacattgtagaacccaagtcatggaacactaccttgtactctccagttgacgtattaagcggaatcaagagcgattcctctttaaacccagtataaacagtttaaggaactccagctgctagactttgttagaagtttgctgtgttgccttttaattgcttccatgttaagagtgaacaggaacccagttatatcccccagtcagtaaaaaaaaaaaaaaaagatatcttaggaattgctggttgagttcatatactaactagtaagtgataatacctaggttctgtgaagagttaaaaatctaaaatagactggatacgggacctgaaagtaagcaaaaaaagggatatgaaatggaagagaacacaccagagatccattcagctagaggtctcctacattccatacccacataggtaaactgctattttcagagaagagggtgctgatccttatcaggtaaataacaggaaaataagacgaattactaatgtcatccttaagttactgtttcctcaaacaaaatgaaagatgaatgagaagaccctgacttcaggatgactagggtctgacattccacgattcacctggctgtctggctccttactttccaccattttctcaggcgcactttttccgggtgttttgtaatgctcacttcttcctcctgctgggaagttgctgtagcctcatgtgcagggtttggcaagctctctcaaaataccacagatcttcatggccagcaggtggtgctcttattaagccccttttataaagttaacaagcttttctccaaggttatatatcctctacatttccaactaaggattaactggatttgattacttgaggtgataaaacaaagcccccttcctgctggaatactaacaggttattataccctagtctctccaccttccacagccaggcgtagagttggctataacacagtccctcaatttctatcacccacacacacttaatgagaggggctgaggtacagtcaaggtgcgaggcacaactccaggatgaaaagcagcagttggttgttattctaacaaactacacaaactggttaggaaacagcactaaaactacttaaaaaaatatctgtcctatggggccagaaaacagctaagtatcacattcaaacaattttctgcctttatgtctggtataaatgtaactatatggaatcaatgaatcaaaatcatttttaaccttgttatgaaaaaaaaaaaagttggaaatcctgccactttaaaacatcttctagagaagaggttgtaagggtggcccagtagtaaaatctaccacacaaatgtttgacctacacagtcgtatgccaagctgctagccttcactgttatttactgctatacaatgatgtacagggaatcccaagacttcagggggtgtgttatttacacgggatattatgtgaatggtgccctttggagttggctatctctgcacccatgggaatcttctgatttccaaatggactgcattctgaatgtggcagttgtttgggtcaaagcaaaattattccaacaggaataatattagacatggtaatcaggtcttcaggtcaaccaactgaggtgtaattaatctacaggcaaatacagtagttaatagagcctacatgtaaaaatatatatatatctccacagtctcataaggagaatttaatgaccaactttttcgtccaaaccccagggccatagctagaagctcttcgtgtgtgtgtgagacatagacagaaaaacaaataggattagatgcaggaaaataaaaaccataaagaccagaaaagggggagtgttccctatctttctttccattccccctcattgctgcctgtagttgctctgaatgatggtgtgggaggtgtaaggtatgcggcagggcagcattcatgtcagatctatagtgtcctgcagtcagcaggacagaaaatgttcaagggaaatggaacctcttagtagagatgctgaatgatggaacaggagctgagagacacacagtctgggtatatctgagggtgggggaggttatttgcaactgtatgtggtaatgctgttgacaaagaaatgactgttctgtttagcaggtgatatccaatgagtgtgcttaagtgtccgggcttcctgtccttcttcaagtatgagactatacaattcaacacagtaattcagagagtaacccaacaaacattcctaagtcttcctagtggcgctgtctgtagccagaatcccaaaaagggtaaaaatctgactcctcttaataatctgtctggaaaggaacttgaaatatagtaaaaggaaggacaggcatcagataatctgggtctgaactgtgaaggcattcaaacccattagccatttagttttagataagccacaaccttaccaagcctgttccttgagcactaacactgaagtaacaccttacaaaatttctgggccgggcatggtggctcatgcctataatcccagcactttaggaagccaagatgggtagatcgcttgggcccaagagtttgagaccagcatgggcaacacggggaaacctcttctctactaaaaatgcaaaaaattagccaggcatggtggtgtgcacctgtagtcccagctacccactgaagtgggagaatcacctgatcctgggaggccgatgctgcaatgagccaaaaaccacaccactgcattctagcctgagtgacagagtgagactctgtcaaaaaaaaaaaaaaaaaaaaaaaaaaaaaaagccaggtgcggtggctcatgcttgtaatcccagcactttgggaggccaagacgggtggatcacgaggtcaggagttcaagaccctcctggccaatatggtgaaacccccatctctactaaaagtacaaaaattagccgggcgtggtggcgcgtgcctgtagtcccagctactcaggaggctgaggcaggagaattgcttgaacttgggaggcggaggttgcagtgacccgagattgcacgactgcactccagcctgggtgacagagcaaaactgtctcaaaagtaaaaaaaaaaaaaaaaaagaattttgaaagcagcatatgagacaaatatgagaagagtactacaaactttaaaatgctatacaaatagtaactgcagttacatgggctacataaatccaatggcaagggaaggtaaaagtcagtgactctggaatctgaagcacagaggaaaatgttttagtgttttccactcattgtgttcaagtttatttattgctccaccagctcctgactatccatgtgttccaggttttctgtttcctttctcttacaagaaatcacatggccacaggaatattacaccacatccttatcacagctagggggttttggtaacaaaagccaaaaatcccggtatctactggatttaggtggccagaaatgcaatcatttgaagaacagatgcagaacaggggattatagttatctaatatttgatcaactgtcaattagaaggattctctctaggacaagggttagcaatgattgtttttataaataaacttttgttgcaacacaatcaggttcatttgttcacatattgtctatggctgcttttgtgctacaatgacagggttgagcagttgtgacatgaactgacatcaattatatggcctgcaaagcctaagatatttaccatatggcccttgaagaaaaagttcaggccgggcgtggtggtttacacctgtaatcccagcactttgagaggccaagatgggtggatcacttgagctcagttcaaaaccagcctgggcaatatagcaagaccccatctttgtagggggcgggaggcggggaagcaggttgtggtggtgcacacttgtagtcccagatacttaggaggctgaagtgggaggactgtttagagcccaggaagtcaaggttgcagtgagctgtgatcactccactgaactccagcttagggcaccgagcaagaccctgtatctaaaaaataaaaattaaaaaaaaaaaaaaaaaaaaaaaaaaacttacagactacctgggagatattatgaagaacagcatggagcccttatcctcagggagattacatcccatcccttccccactccccccgccaccaagacagggtctcactaccgttccccaggctgcagtgcattggctcaatcatggctcactgcggccaagacttcctgggctcagctgatcctcccacctcagcctgctgagtagctgggacgacaggcgtgtgccaccacgcccagttaattcttgtgtttttagtagagatagggttttgccatgttgcccatgctggtctcaaacttctgacctcagatgatgaacccgccacggcctccaaaagtgccaggattacaggtgtgagccactgtgcctggtccctaaaatttaaataacagaaagcaaatacacaaacagccataacataattcattaacatattgataaaacacaatagggtaggtgcagtggctcctgactgtaatcccagcactttagggaggccgaggcgggtggatcacctgaggtcaggagttggagaccagcctggccaacatggtaaaaccccatctctactaaaaatacaaaaaaattagccaggcgtggtggcatacgactgtagtcccagctacttgggaggctgagacaaaactgcttgaacccaggaggtgggggctgcagtgagccaacatcacaccactgcactacagcctgggcaacaaaagcgagactctgtctcaaaacaaaacaacaacaaaaacaaaaacccaccagtgatttgagaggaaattcctaccttctgtaggctgggcacagatcatgagattacgtgaaaattcaatgaaaccaatccagattatgaaagcgctggcttccatctagaatagtggtttcaaaatgtctttgctcatgcacccccatttgatatgtgatttttaaaaaatcataatttcagatagttgtaaagattatatttgaatactacataatgctttaaaaacatttttatcaaaactttggcatgtaaatatatttagcttcattaattgaaaaaaaaaacttcttttaaacttatttagctaatcagactttagatattaactcagtatttattctaagacagacaaggaataggaccatgtaactgagctcagacccatcccagccactcgaagagttagagggaaatctcttagttgcaatcttttagtggtaccctctggtttggtagatctgttgcagtctttttggagaattctaagagaagacttggttgataggagttcctgagttatctctattttatttttaaaattcaaaacttttttgcttaatacctgggagattctccttcaggtgctgagaactcttagaaatgatctctttatttgttgtccccaccatccaagacctttttttttttttttttttttttttgagacagtcttgctctgtcgcccgagctggagtgcagtggcatgatcttgactcactgcgacctctggcctccaggttcaagcgattctcctcccaaataactgggattacagacatatgccaccacgccctgctaatttttgtatttttagtagagaaggggtttcaccatgttggccaggctggtctcgaactcctgatctcatgatccgcccgtcttggcctcccaaagtgctgggattacaagcgtgagccaccacacctggtctcgaactcctgacctcaagtgatctgcctgccttggtctcccaaagtgacgggattaaagacgtgggccacgacaccgagcctcaagatttttacactctggggcaagacccatagtgggactcaatatggccaaaaggaatgctcttcttttgtcaagtgggagaggtacaggtatgggaagggaggtgggaaaggagggctgtcagacacagagatttaacagggaggcaaactttagaaagacagtacaagctaacaacgaagatttgtgcttatctacaccctgcaaagctgtcgcgttaccacataaatgccagtatgaagatattctcctagaacactgccgtccatcctacattatatcatggcacgcacagacaaaacttttttttttttttgagacagagtcttgctctgttatccaggctagagtgcaatggtgcaatcttggctcactgcaacctctgcctcccaggttcaagcaattctcctgccttagcctcccaagtagctgggattacagacaggcacaaccacgactggctaattttttatatttagtagagacggtggtttcaccatgttggtcaggctggtctagaactcctgacctcaggtgatccgtccacctcagcctcccaaagtgctgggattacaggcgtgacccaccacgcctggcccagacaaaacatttttaaagatatactaagcgtattttggaccagattactgtggctagaggcaactgagcccagatccctcctagctacttgaagagttagaaggaaatctcatattaagttgcaaccttttagtggcaccttctggtttggtggatctgttacagtctttttgcaaaattctaagagaagacttggttgacgaaagttgtaccttgaaagtatctgagttgtaactgcaccttggctgattttctttcacctagaagtctctcaagtttctttcattagactttctagtctgtggtctttcttaccatctggaaatgctagaacaggatgaacacaagagtccaactgggaaagacgttccaacagaggggcttcatagtgaatttcgggaggcatggtgttgatgctgcctgaaccacacagtgcgcaggagggattcacatcacagccagggcggattgtgctgttccggtgaacctgtgaaaaaagccaaacaaaactgacaattcagcatctgataaaaagccagctacccatttgttatccccatttgttattgagaagttagctccccatttgttattgcgaagacctttctagatacttgtgtgacactactaaaaggatgtttgattagtttgttaaaagatttccatttgtctaacacactgaccttcaaagtgggtaaggaaacttgcttccttttcattgatgaaatctaactacttgaagctctaagtgcttacctaggtatcaaacttctgacagtttaaaaagatactaaaactgtgctttctgagaacactttataaactctgcatgctttcacgaccttgatggtccgctaagacgaacagttggttcttgattcccaggtgggacattacttgctttcttcagcaaatttatccacctaggagccttcaattaccaaccacacctcttctcttcttttcacacctcttcttcaaaagactttcaggtggtctcaagccaggtggcaagcttccctgaagcttgtaacttaaaagtaacttattaactactctttaacctggcctaaaatccactgttacaaagctcatacctaagtaataaaataacattttgtacagcaaatgctcactttcatagtcttcatgttagattaattccaaagggtagaaattatttccactgaacttcctttgtgcacatgtgggcagaataattgataacctctccaggtaagtccaaagttaaatatgaactaatttaagtcttcaaaagattgaattctgtataaaaactgaacatctacaattttatactttgagcaaatttcaggtcatgctgaatgcaggatccctacattctagtgttaggatgaacaagtctggcatttgccaaagcctaactcataaagtcacctggacacacagccccagaaaaagaaacttgcatgttgaatggcactataagaaggcatcctaggtgcaagctcagtagtagaacaaagacaaaaagcatcaaaactctactagcaaaaactctaacatttactagagctccatttattttcagcagagacatctcgaaagccttttatggatttgtgtaagagaaagatatacataagaacaatgtggtctttatcaacattcccccgacattctattgtaaccacatagagaggtggcacgcaaataaagtcttttaaaggttagactgggcaaatcacacagaactagaagccactgaaagggagtgataccaactaggcatgctacttttgtgtagacaatattaactggtattgttttgggaaaaaaaaaatccctgtatctatgtaatcagagctggctttctggagaggatgacattttgaggtaaagagaaatgagtaggtagagatgaaaatgagatcacacagtgggtgagtgggaggatttaggaaaattggttaggatccaaaaattacactgaaactttcaatattcaaaagagattatctcactccagtaggtatagcaaataaaaaataaaaagagagagactagaaaccaacccatgacatcaactagctctccatatgggacatttaacaacactacattttatggctagagtgtatcacttaagtcaaagtcaatattgggaggccaaggcgggtggatcacttgaggtcaggagtttgagactagcctggccaacatggtgaaaccccgactctactgaaaatagaaacgtcagctgggtgtggtggtgggagcctgtaatctcagctactcgggaggctgaggcaggagaatcgcttgaatctgggaggcagaggttgcagtgagctgagatcacaccactgcactccagcctgggcgacagaatgagactaagtccaaagacaagcaaacaaacaaaaaaacaaaacaacaacaataaaaaaattcaatagatgtggctaggcgtggtggctcacaactgtaatcccaaaactttgaggtgggagagaggattgcttgaagccaggagtctgagactagcctgggcaacacagtaagactccatctcttaaaataaaatttaaaattaaaaaaaaaaaaaaaaaaaaaatttagcccagcatggtattgcatgcctttagtcccagctactcaggaggctgagggagaagaatcgcttaagcccaggagttcaggttatagtgagccatgattgcaccactgcactgcagcctgggaaaaagagtaagatcctgtctccaaaaaaaaaaaaaaaaaaaaaaaaggctgcgcatggtggctcacgcctgtaatcccagtactttgggaggccaaggtgggtggataacctgaggtcaggagttcgagaccagcctggccaacatggtgaaaccccgtctctactaaaaatacaaaaaactgggcatggtggtgggcacctgtaatcccagctactggagaggctggtaagagaatcacttgaacctgggaggcagaggttgcagtgagctgagattgcaccactgcactccagcctggggaacaagagcaaaactccgtctccaaaaaaatttaaaaatttaaaaaaataaaataaagggtagaaattctacttataacttgacaaaagggtaatgtgcacacatgtaacttaaacagtaatctcacttttaaattaaaaactgtaaagtactaatagaacccgaggagtatataaaaatatatttaatacttattttttttttgagacagagtcttgctctgtcacccaggctggagtgcagtggcgcaagtctgccttccaggttcacaccattctcctgcctcagcctctcaagtagctgggactacaggcgcccaccaccacacccagctaatatttttgtatttttttagtagagacagggtttcaccattgttagccaggatggtcttgatctcctgacctcgtgatctgcccgcctcggcctcccaaatgctgggattataggcatgagccaccgcacccggccaaagatatatttaatacttattaaaggatacattttggaaaatttttgaaagaaaacttgaattcatacccatgttgcacaaatccacaccaagaatctatcctgcagacaaacttaagtgtacacacgcacacgctcttccactgaaacaagatgccaaatcatctgcatgaattcatttaagttaaaaaacaacaagaacacacacaatattgtgttttacaataagaaaacaaatttttaaaaatatcacaacagatggtgtgcacgtgtagccctagctatttgggaggctgaggtggctcacttgagcccaggagtgaggagctatagtgatcatgtccactgcactccaggcctgggagacagagtgagtcagtctcttaaaagaaaaaaaaaacaaggatctcctgggctcaagagattcttctgccttagcctaccaagtagctgggattgcaggcatgcaccaccacgcccagctaatcttttatatttttagtagagacggggtttcaccacgttggccaggctggtctcaaactcctgacctcagatgatccacccgtatcagcttcccaaagtgctgggattacaggcgtgagccatcgcgaccggtcccagtcatgaaatcctattggcagaatccaaccacttcataccacctcaactacactcaatctagtccaagtcactatcttttctcaaatgggtttcttcaagcctcctaactgatcctcctcctactggttcttacttccaaatcaatcaacacagtaatcagtgtaaatcttgttttaaaatctcaatcacatcataccaacctcataatcttccaaatgacttctcatctcacgaggaatagaaaccaaacttcttgcatggttcccacaaggtcctatagtatttgtcgcctctatcccctctctctgacttcacctcatttttttgttactctcctagctgacactaccagttactctgatttccttgctatatttctccaagatagcaggcaaccttccagatcacaggcctctgcacttggctcttcaaccactaattccatggtcattctctcacatcgtgtctttttctttaaatgtcagtattcaaagtaactttttttttttttttgagatggagtctcgctgtcgcccaggctggagtgcagtggtgggatctcagctcactgcaagctacgcctcctagcttcatgccattctcctatctcagcctcccgagtagctgggactataggcgcccgccacaacacctgactaatgtttgtattttttgtagagacagggtttcacggtgttagccaggatggtctcgatctcctgacctcgtgatccgcctgcctcagcttcccaaagtgctgggattacagacgtgagccaccgtgtccggcccaaagtaagttttatttagaaatacaagtgaaaggccaggcgcggtggctcacgcctgtattcccagcactttgggaagccaaggcaggtggatcacctgaggttaggagttcaagaccagcctgaccaacatggtgaaacctcatctctactaaaaatacaaaaaattagccgggcatggtggcgggcgcctgtaatcccagctactcgggaggctgaggcagaagaatcgcttgaacccaggaggcagacgttacagtgagctgagatcgcaccactgcactccagcctgggcgacaagagcaaaactccctctcaaaaaaaaaaaaaagtgaaaaaagattatattcttgactgtaacaacaaaaaatgccctggaataagtttaacaagaaatttaagcacaaagcttaaagatattgatattctacaaattaatgcagaatcttaatagacttgaggggggaggggagacaaggcaaaggggatttaaacaaataatctaaaagatacaactgaaagaatgtaaggaaccattccccaaaatttctgataagcaaaaatacaggggagtgatctggcctattacatgttttatagttacagtaattaaaataatctgccctcggttaagaaacagaaaatttaaataaaaacaaaaattgaccaaagtatatatgacagtttattgtttaactaaaataatacttttaaatcagtttaaaaaaacaaaaggaggtattactttttcaacaaatgaatcaggaaaaccaagaggtcatacagaagaaaacggctgcatttctgcctcacaccaaaattaattctaaataaagatttattcattttcattttattttatttttttgatacagagtctcgctctgttgcccaggctagagtgcaatggtgcgatctcggctcactgcaacctccatctccgggttcaagtgattctcctgccttagcctcccaagtaggtgggattacaggcacccaccaccaagcctggctaatttctgtatttttagtagagacgggggtttcgccatgctggcaaggttggtctcaaactcctgacctcaggtaatccacccaccttggcctcccaaagtgctagaataacaagtgtgagccaccgtgcctggccccaaataaagatttaaatataaaaacaaatattatactcaaatctaaaaaaaaaaaaattgtgaagcaatatatagtggttaacagtatgagctgtggagccagactgcctgggtttgaaccttgactccgccacttactagctgtgtggccttaagacaagttactgtgtcttcatctttactaacaggagagtacctgatagagttgttttaaagataaataactcacaacagtatctggctctcgactcttaatcacttttgtaaaaccgtaagtatagctactgatagaacatttaccatcaaacttgatagaacatttaccatcaaagatcttgatttcaaaattctagcttcttaacactgtataatatgatcattgataagtcacatgacatccttaaattttctcacttgttaaaaaggactaataataccaatttcatgggagtgtaggaaagatcaaatgactctgtaactgttaaaacattacacaaatgttagctaaattagtataccgcatgatttctcaacagctggcacttctttgttgtggggcacagtcctgtgcactgtagatatctagcagcatctctgtcctcatggtgcatgtgcctccctactcccccaatttgtgaaaatgagtaattactacagatattgccaaatgtctcctgtgaggacaaaatcactgagaaccatgaggttcaaattacggtcatcccgtctagaaaaattcaaagcacaggctcccattaaatattagtggtgagtcacagtaaacataagactcagtaaaaaaggaaaacaaaaaaaataaaaattaatagtaagaacaaagctctcaaagactattgtcaagaacaagcctgaagagagcttcccctaccaaagatcagataacgttagcatcataaagaaaagactacaatggcttgaaatacctcaaatatgtttcaatcaatgactcacagccccttcatgaaaaacttcagtgactgtccttagaggatagtagaaaactaatttgttattttgaaaattggtaaataaaaaaaaacaacaaatcatgctttcttctgtacaaactgtacctcagggtaaacaaatagttgaaaaggacaattttccctttataaacatattctatctagctaataaaagaaaaacagaaatgatacaagtagaatatcaccattcttcagcttccaatttaacaatgggtccaggcaatgatcaccagtggttgataacaaacagtttagtcattacgtgtcttctgatacaagcataaggcggccaccttgtgttttctcacgaaactaaaactggacttattcacgtttctactagttttcaagaaaaacaagggacagaaaaacatcactgttttttaaatgcactaaaaataagatggattaataaatggaaggatgattgtatgctaaaatgttagtggtagaacctagggagtagctacataggtgttcactgtaaaattcattcaacttcgtatctgaataatttcataacaaaatttggaaaagaaaacagtgacaccacaggacttctgcttctagcagagtaatagtgatcagatttacctttcagtcataaaccagaaaactggacaacaggcagtataacactgagaaataaatggggtggtctctaagactgccctggttttccgtctggaagtacattctagactgcagggcagggagaggatctgaagcagagtataatagcttcactgagttgaggaagcaaattctcactagatcagaattcagagactaaggaaactgaaaattgcaaggcaaaattcttgagaggaggaagctttacagaaaaagagccccagaaatcttcataagatccccctgagtgtttgctaaatattaaaaggtgcatgtaaagggtgaaactatcaggccaggcaagagcaactaggcagctgtgagctgaaatggtttccacagctaacacaagcctgagaggcttttaaactgtgaccagccaaagttgcatagagaattcaagacagaagatcctgctttagttgtggagctagactactaaggtggccaactcctcacctgacctaacaaatgacaaggaatttacctgccagcaaaacaaagcctctttaaaggaagatggcacaatccacatgctacaagcagggaaaattattaattggattttcagcttaaaacataaataaaacattgttagatatgccaagaggcaagaaaatactactatagggataaaatttttaaaagaaagtaggctgtgggaaactaaggtatcagataaatgaagttttctcaacaaataaatcacctatatggatagtttgtatcaaaccaacactctcactaattggaaaagccagatttaaaacacacacacacacacacacactctctctctctctctctctctctctctctctcaaaacataagaaaaatgctgacataatgacaatattgaaagctaagattccagagaggaaaagaacctggccaacatggcgaaaacccatctctactaaaaacacaaaaattagctaggcatggtggcacgtgtctgtaatctcagctacttgctgaggcaggagaatcgcttgaacctgggagatggaggtttcagtgagccaaggatgtgccactgcactccagcctgggcaacagagcgagactccatctcggaaaaaaaaaaaaagaaagaaagaaaaaaaaaagagcagagcttttggtactcttgtagggctgaatggataacactagagacttgaaatgtcaaattatcaataaaaagaggacagggaactaagcatgacacacttccaagtaccaccctcccaaagaaatagctgaagttgtgaatggtaggaggctacaaagctaagtggaaagtctctgaaaagggcagagatgtttctggcagtctcgtgaggagactagaattagatctcaggatatgctaagaggaaaggaggctgggcacagtggctcacacctgtaatcccagcactttgggaggctgaggcgggcagaccacctaaggtcaggagttcgaaaccagcttggccaacatggtgaaaccccgtctctactaaaaatacaaaaattagctgggcatggtagcacgcgcctgtagtcccagctacttggaaggctgaggcaggaaggagaatcatatgaacccgggaggcagacgttgcagtgagccaagatcatgccattgcacttcagcctgggtgacagagcgaggcgaggctctgactccaaaaaaaaaaaaaaaaaaaagagagagagagagagagagagagagagaaaaggaaactgatcaacacatgttctcagctggaactaagagagagaaacagactgttatctttttgagacagagtctagctctgctgcccagactggagtgcagtagcttgatcttgactcactgcaacctctgcctcccagcttcaaaccattcacctgcctcagccacctgtgtagctgccaccacagctggcttttttatttttgagatgaagagattgcaccactgcactccagcctggcgacagagcgagactccatcttgggggaggggagggggacaaaaaacaaacaacaacaacaaaaaatcagcctgtgcaacacagtgagacctgcatctcaataaaataatgagataaaatacttgatacacgaagaaattcccacgttcccttaattaatactgcaatgctatcaattctctttgaaggaattcccaagaaatactcaatttaatacttatgaaggaattaataccaaagtaaaactctattcaccattttctgttaatcatagcatattcgtccaaaacactaaaagaattcttttggctcaaggacaggttataatcatttgcttttgctttgcatttgatattcgttatctaactcatccactgttaacatgtggaaagattttcaaaggtttggcaactctatcacaatcaagcatatcccacaactggctcttgaagatccatcagagtgaagaaacaaaacgtgtaagcttctattttatctcagtctttcaaaatttattttgtatgtgttttataatgtatatataaaacaccgtcataacagtttagaggtaactgttccaagcacagagtgatttctgagtattcttttagtagctttatgtcctaaggtacaattttctacatggcatgcttgctcctttccaaatgtctaactagtatgaaaaagttggttgggcctccaaggtctattgcactctgtcaaggaagaacgtatcaaattattaacttttaatactgactcatattctagttcattagtcctcaaccatggtgtcatgaaactggatttaaataggtggaatcaaaactaggaggcctagaatcatatattaacacctttatttaccctgatgtctacaggaaacctggtcatagccatgagagaatgccctgtacaaaaatgtcactcttcaagtgtgatacaatgggaagaagaggaggactactcggaattctatggaagccagctttaaaatttggcccagagcaatcccccctatgacaacaaggactacaaaattctaaaatgatgccagtacactgccaatttgttaggaaattgctactttttaaaaaattgaaagaaatgctattaagggcaataaaaatttcaagggtatgttagtaataaatgtagccattacctattctactggttattagtacaaaaaaacccagccttttcaaccattcatttccaaacactgatggtttccactgccagactatacacaagtttctaatggtccacagtaaattgagaatgagaacaatgcagtaaattattaataaaactacattcttttcttttttaaaaaaatactatttgtcttatggtttaattataaacataattttacttaaaaaataaaaagcaaccttatttgaaaattggctggtaccaattttattttaataactttattgatctgaaatcttagtacgtttaggttaagttataaacacctacttcacttaggcactgggccaggaaaagaacataatggcatataagaactttccactggagtgcttcttcattcacttagataattactaacatccaccatactagacccctaaagtgatgaaacacacaataaatagcaatataggctattcagtaattacaactagtaattccgtcattttataataaaattatgatttaggaagtactccatgttctccatgagccttactctgatattcacttaccacaccctagtggttattccttagattacatttaaaatattccacattcagagttgtagaggccttagactattatctcctccaggattactactgttagtctgtctttccacctccagtctcttgtgccaatccatcccaaacataatagttacagattggccgggcgcggtggctcacgcctgtaatcccagcactttgggaggccaaggcggatggatcagctgaagtcaggagttcgagaccagcctggccaacatggtgaaaccttgtctctactaaaaatacaaatattagccaggcgtcgtcgtgggtgcctgtgatcccagctactcaggaggctgaggcaggaaaattgcttgaacccgggaggcggaggctgcagtgagctgagattgtgccattgcactccagcctgggtgacagatcaagactccgactcaaaaaaaaaaaaaaaaacaaacaaacaaaaaaaaaaaaaaaaacatgttacagcagatttacctcccccaaaatagcttacaacacttctctgctcaaaaatttaaaacttatagactgaaacccaaatcatcagtttgggcattcaaggcttcctatttatttactgatagatctcatttctctttattcccaacgagtttaacttactgaacactttgttttagtcattgattttaagaagtacaagtgatataacaacagctttttttttttttttttttttttttagatggactctcactctctcaccaggctggagtgctgtggcgagatctcagctcactgcaacctctgacttcttggttcaagcgattctccagccccagcctctcgagtagctgggattacaggcacgtgccaccacgcccagctaatttttgtatttttagtagagatggggtttcatcatgttggccagggtggtcttgatctcctgacctcatgatctgccccaccttggcctcccaaagtgctgggattacaggcatgagccactgtgcctggccagcctttttaagggcaaaagagttactgcactaaacgtgcatctcaattttaagatatattccagccataattcaactaagctgatagccctttaaaaacacagtaattgggctgggtgtggtggctcacgcctgtaatcccagcactttgggaggccgaggcgggtggatcacttgaggtcaggagttcgagaccagtctggccaacacggtgaaacctcatctctactaaaaatacaaaaaatagctgggcgtggtggcgtatgcctgtaaccccagctactcgggagaatgaggcaggagaatcgcttgaacccgggaggaggaggttgcagtgagccgagatcgcaccattgcactccagcctgagcaacagagcaagactccatctcaaagaaaaaacaaaacaaaacaaaacctcaatgagttccctcaagtatgttttatttggttctggaatgcagtagagatcatttaagatgcaggtaaggaaaaaatattaatcacttgctttgtgtgttctgtactctgtactcacaataactgtgaactcactgtcatgtaacaatattagaacataatttacctgttaacttctttgctgtcattagaaagtaagctccatgaagataagggctttgttttccttaccaatgcaacctggctgccctgaataatacggtgggcattcaaaaatgctgttgaataaatctgtctggaaaaccgagcaattcaagatgacagaagacaagatgcttgctcatcagcaaataccactgaggtcatgtcatgagtgaggagccatgtgagacacagaaagcaacctagacagaaggaatggggtgtgtctctaactctggaagaactccagctttctgctagatctagtacatggtatatttcccaaagtcaactaatttctctgtcttatttttcatgcagcttacttttgtgtcaggatgattctgttttagaaagtggcattggaacaaaaggatatttagttttatgcctatctcttgcctaagctaccttttataattttatatgtacattcaaaactacattcgttcttaggcatggatcagaagaaggttggctacttcacatattaaaaaacaaaatccaggaggccaccacatacttcagaaaatttttatacgactcctgatgtcatgccatagtggctggtaaactgccaaaacagaggaagggtgctttattttcatgaggtggcggttttttttttttttttaaaatgtaaaagcattctgtgttaaattcatcaaggaattgacaaaaagctattttcctacacttgacagtaatatactgttttctgacattcctgttatcaactcctctgaaaatcttttagagatatacgactattagtaaaaaaaaaaaaaaaaaaacaaaaaaaaaactgagactgaaatgtcaatatgaaaaccctgccaaataccttattcttatctatttctgctattttgatatttcaggtagagtccgaggaatagacaggaagaaatggtatcgcctgacagtcaattctacaattcttttctttaaagagaacatggcaaacttacacagtacaactgcatactagaataaaacaaggaaagtactgaaaattcaccatgcaaatactaattgttccagcaattctctcatctcccttatttgtcattagcaaatatgttgctagtggctctcttaagaaaaattcccattctctgctctcttttacagcaacattctttgaaaatgttatctacaatggttccctcaattccttctgtggccttgtctcctgaaaccactccaaccatgctttaattcacctttctccctctaccaaaactgctcaccaatgtctgcaacaaccccaccccactaaattcaatggtctcaattctcagccttcatcttactgatcctgtctgtaacaactgacacagacaatccctcctcctcctccctctccaaaacactttctccccttgcctttcacataccacactctcttggtttttcttctactttattcgtcactcccttcccaatcctttcctcatctttcacaggaatgaggaggaatacctaagctctggaatacatcaaagggctaatccatatacctcttctttatctgagctctccagcactctctattccctcctctattgcatttctctctccaggattttttttaattaattaattttttattattattatactttaagttttagggtacatgtgcacaacgtgcaggttagttacatatgtatacgtgtgttttttttgtttgtttttttgtttttttaaaagacagagtctcaatcactctgtcatccaggctggagtgcagtggcacaaccatggttcactgcagtgtcaacctggtgggctcaaatgatcctcccgcctcagcctcctgagcaaatggactacacacgctcgcccacagcaggctttttttttttttaaagatatggggtctcactatgttgcccagactggtctcaaactcctgaacgcaagtgatcctccttcctcagcctcccaaagtgccaggattacaggtatgagccactgtgcctagcctctctccaagatttaatgctataggacacactgcagagttcatttattattttctttctcttaacaactagaatatttcatagggtaagcacttttgtctgttttgtttagtgttgtatacccagtgactagacagatttagctcgttgcaggaagccaataaatatttgttgaaagaatgaatgaacaacaacaaaagtggtaacaataacagccactttgtacgaggaacttatcaaccagacatcccaataagcatgttacatatatttcattgaaccctcaaacaaccctatgagatctctgaggctttggagaggagtggaagtcagggtggttaacatgcaccaaattaccaaactactaagtggtagtaccatgattcaaacccaaggttatcatcttcaaagataatgctcttaattcctgcacagtaccaattttactggaatattattatctcattagttttggaataaaggcaactgctatttgaagagtcagcaatctaaaattccctacagttgtgaattaatctccatttcctttgtgaagacaaacttttttttagtaatatcaatttaaaaactttagtgaagattcctttttttctcaggcagggtctcactctgtcacccaagcttaagtacagtggcacaaatacagctcaaagcagcctcaaccttatgggttcaagcaatcctgcctcggcctcctgaatagctgggactacaggtgtgcaccaccatgcttaatttttaaatactttgtagagatgaaggtctcactatattttccaggctggtattcaattcctaggctcaagcaatcctcctgccttggcctcccgaagtgttgggattacaggcatgagccactgcacatggccaagattcttttttagggcaaaggattctatactgccattttcagtgataacagtgaaggtgagagggcacactattctccttcaaagtgttaagggcagtacttaaactttcagtctctcccatttctattaaaaagctcaagacagtggttttcaaaactagctgcagagtcaccgaggagctttgtgttttctgaaaacaagattccaacatccaactccagagcaaacagggcccaggaacctagtattttataaagctccccagaagaccttggtggttagccaagtttagaaaacaccaaagttggcaagagactaactctatctgagcatctggctcactgcttgacaatgaccaactctcatctgtaccgaccttcttggaaagaggaacgatgctgttgggtcgaacaagcctccgcttcttacagctcagtacaggacgtgtccgggctgccacacaggtgccatcagatgatgaagagacgagattcagtcgttgcttcttatgtaattgttcctcagcatcagagctgtcacctggaatgtggtctgccaagacaggctgaagactatacaaggggaaggaagagtattctcagaacacacaaagaaacaaaataaataaacaacaagaaaacacaaagaaacaaagcctcttatactagttcaacctctatttgctaatgttcagacacaaagaagcattctagagcagaagcaggtctcctcttgatgtctgttaatctacctgtgtgtgcttatgtgtaaggttcttggtgcacattaactacatcatgtctgaaagataaaagtcaataaataaactcaagttctagtgattgagttctcctctacatcaaacacacgagtaaataaagtctagagaactacagttggttagaaaatgatgaattttgcaaatgttaatgggcttccttagaatcagttctatgaaacccgaattttaagggtgttgtacacatcattcacttgtacagaatctccctgaatcttttgttttctcccttgaatcttcataaatacagatttacaaacatagcccttggagatctaatctgtcctaagcagaggaggttaatataagcacttctgaggaattcctgcaagattaaaacaataataattcacagtaactgtagtgtcttttattttactccatgcccactccattttagtaggtaaaaggaaaatatacaattaattaaaatgcactgcttcattatacagtgaagattaaaaatgttactaagtgataaggcttccgcttctttaaaccagggtcagtcctggctaaagagaactaagagctccaaaacacctttacaagtctactaagtgtaggaagtagaagagctaaaacttacgtgttaataactccattgacaggtctgagtgctccacatgatttggtagacagtgactctgaaatatgaccaataataggggcaccatggttttccaatggctgagaaacagactcaatctgattaagaaaaaggaaaaaagaaattaacatgtacccaagcgcacccctgcctgaaaagcaccaccacttcatttgcacaaagcacctaaaacttctgatgatcaatttgaaaaacacaacttgaatgactgaagaaaaagaaaataagagaatcagtggtcaggtatgatggctcgcaactataattgcagcactttgggaggccaaggcaggaggatcgcttgagaccaggagttttgagaccagcctgggcaacacagcgagacctcatctctaattaaaaagagagagagagaggttgacagagagaaggagaatattatattagcttttgctttggggggaagagggatgaggaatccaaatgtacagactaaaagtaagtacctattgacaggaaaatgacctcaataattctatggaacagaagcttagcaaaacaattacacagtaacataagctttcaactaatgatcaagaaggatatactaacatcagtatcaagatgactaagaggaaatttaaatgtagttaatatctgcttaactctaacagagtatgctagaagcttgttttctaaaaactatgctttgtttaaaaatatacacacaggccggggatggtggctcatgactgtaaccccagtattttgagaggcaaaggtaggaggatctcttgagcccaggggttcaagaccagcctgggcaacatgacaaaaccccatctctacaacaaaaaaatacaaaattagccgggcatggtggtgcgtgcatgtagtcccagctactcaggaggctgaggtgggaggaggatcacctgagccaggaggcagaggctgcagtgagccatgatcatgccactgcactccagcctgggtgacagagtgagaccctgtctcaatgaataaataaataaataaacacacacacacatttttccctgacagaaaacaaagttaataaaatctcaatgaatctaattatctgatgctatcagatactaactattgtctttagagtattcaaatcaaatatgtttagaatataaaatgaaataacagatgagaaagaatagaaaaagtgtgatttgcagtattcaaaacaaattatatatttactaggctcaaaacggataggaacagtatgaatgccagtcatatagcacctctgaggtataggcaataaagcaacagatgcagctatccctcagttctagcaattgttgaactatcccagaaaggctatgggtctttgactccttactttatttttttgagatgaagtctcgctatcccgcccaagctggagtgcagtggcatgatagcagctcaccgtagcctccacctccctggttcaagcgattctcctgctttggcctcctgagtagctgggattacaggcacacactaccatgctcatgtaatttttgtatttttagtagagatggggtttcaccatgttggccaggctgttcttgaacttctgacctcaactgatctgccctcctcggcctcccaaaatgctgggattataggcgtgtgagccaccacacctaacctgtctccttacacttgaactgactctggggcacgctgaagttctctttcctataaaagctttcaaggtaaatattcctataaatgcttcctacaaatgctttcaaggtaaatattttgaggctgaaattctacttttcaatactgatttcttttgtctttatacccccaaggataaaacaccaaaggactgaacctgaaagtagtcctagacaagcatcaaaaagaacagactgaggctgggtgtggtggctcatgcctgtaatcccagcactttgggaggctgaagcaggcagatcacctgaggtcaggagttcgagaccaacctagccaacatggtaaaatcccatttctactaaaaatacaaaattagttgggcatggtggcgcctgtctgtaatcccagctcctccgggaggctgaggcacaagaatcacttgaacccaggaagtggaggttgcagtgagccaaatcacgccactgcactgcagcctgggaaagagagagagagagactgtctccaaaacaaaacaaaacaaaaaacaaacaaaaacaaaaaacagattgggaagataatctaaaagttttaatacaaattatcctaaaatacagatcaaactatatacacagacaagtcatataagtatgctacaatgagtgaacaccgagaaaaggctgtcttttttgttggatatcctgtacatctactaagatatcacaaacatcttgaacaattgtcaatgctatcaaaaattacagtaaatctggcatagacacattgccttaagctctatgcagatttcccttggaaagaaacacggtattaagcagcaagagctataaggatattcctatcttctgacaaaatattctaaccaatttttaaaaatctaccctaaaggagtaactcaacaaacacagccccaaaaatcttattcacaaaggtggtcactgcaatgatatctatcaataatctaaatgttgtaagcattataactatagttatcagttgtggtacaccaaatcaaaatattaaaaagaatcataaaggatatttcttctcttatggaagaagagatttcaagagaaaaaaataatagtttaatatagttgtagtgactaaaaatatacatacacagataacaacaagacaaagagtgttacagttgtaaaactattctgaaattttctttacattttaggtaatagttttatattaaaaagaaacccccataaaaccaaataccctcctgaatgctagtaaggatttactacacaggggaaacctcaaaaaggctaaacaaatatggtatgacaaagaacaagaaaaatcaaaagaatttaagattcaggttggtattaactaacagatgtataacttcaggcatgttataggtattctagatttcagaagttctggtttagatgaaaaagtttcctttcaatagaaaaatgctgtttaaaaatgctgtttgtttttatttcggcattaaattatggcagtgatttgatttatatatggtatatataatttatatggtatatttgatttatatatggtatatataatttatatggtagtgccttcacgtgttctagaaggtactacgtttaagtaacgggttgactgactctccatttgattaagtttttctggtagggattatgagatttaactgcaagaacacttgtcaagataaaatgttgccattctctaacaaagtctcatttcaaaacatttatctttcttatacaaagtctaaagaagaatatgtcaagtaaaatcaccagtaatgtcacgatccatatagctaactactactgctataacagcctgtcttgtttctcatgtctgcaggtgtatatatttaaatgctattcagctttaacatgaatgttattgattttcttatagaaacctgaatcttcctggagtaattcagcccccaaatcaaaattgaagtcaacaggcaacacattattaacatggaaatgttgtcaagaacatagaggtatacagaggtcaagagcataaacatcagaaagggactgtggctggcctgcattcccagccacaaaaaagaaagcactggatactcaggaaggatctacttcagatcttgggaaattctgtaatcaagctagtatccaacagcaggcatttggacatgtcctgcaacccatcatcaatgcaaagagcttaaaatattaatcccaatcacagtgttccatttggaaaaagaaaaacataacacacaaacacatgtaatttcacctagctccttaaatgcaggcactctcccttgagaaaaaatgaacatttcctatcctgcagtctaaaaggctgcaaatgcagaggataaacattaacaaacacttaagaaatattaaatccgcatactaatttcagcttattactactgcagtggtttacatcattagtgtttttagaaaactaaagcatgactgagatatctgctatccaataggcaactgcaaaaaggatgaaagaacttaagactctcctacctagaaaataaggattatcactgaagcttccatttgaattttatttgatgttgagatgaactcagggtttatgcatcccacagccagaaagaaagagtagaaaagctaaagtggtagacagagtgcctctgtaatcccctcctctccaaagcagggccctaggggattatcttttggagtaatcttacagttaaaggtagcaaggagggttgctgaattgctccccccacccctccccccgccccgattgaaagggccaggtgtacagcataaaattactaacatagcaatgagattcaaatttgttattcacataaagcaggcatctcattcattactccactctgggccagatcaagtaagcgtgacaaagaggccttgaatgaaaagctaaaactaaatagtttttacgggggtcgttttttctagggtctaagaaccaatgtctactagatttgtttcaccaaaaagtagagagggttaaggggtaaaaacagagagccacacacttaaaagcacacaataaaattaaactctacctgcaaatatgtatttttactttattcaattaatgccatgtcacacctgcttgcaatgtcattttttaaatgtatcacattcgtttggctagaaaagtcaacagttcagttttggttagttattccctttctgacaaacattaaaatggaaagaaaatgctaactgggtgacaggaatttaacttattcctgggttaaaatagtttttgactttgtatgattgatttcatgtctcaagcccaccccacccccatttcaatgatactgagcatagtttcgcttaaattcaccaaaatattgctggcctataaatagtatactagccatttccattagctagcaccatggccataaaattgtactaaacaagaagtggaatgttctgaaaattccattttcactaagttattgcctaggctttaatttctgcctatgtggggctatgtgcctcactttccggcttctgcaggttgaggataaaagaaaatctataaaattacattataacaattttgaactcatttttttaaagttttgattagcataatgctgttactaatccaatggttcctaagcctaagatttatgtttaccaacacttgaaaataactatctagaatttaaagaaatatagcaaatgcaaaaatgcatcttaaattcttattgttcaacttatttatccatagcccaatttattataaaagacctaacttgtcagtgttttctaacactgtgggtcaaatatttcttggccaatatctgtccctttaccttctatcccaaaacccttgtcaggccaatgaactactcactgtccctagagactgcaaaacttcaaagaaaggaagagtattcctacttacaccaatggaatgaagatgtatcttggactgtgtaaaaagaaacagcaatagcttacatttttagcatgcctttcttctgagaaagcattagctcttcacttaatagtacacttgtttttctcatcacttctgtaaagtaggatgagcaaggaaagggtaaaggagcaggatcattttacaaacagaaactaacacacaaataatgtgttacttgttaattgccatagaagcaatgtttttcgctaaacaaaaccctccttaacgtcaaatctagtattttaaaaaatatttatccaagaaggagattttaaaaaatatatacatgtgtctgctcatcggtgcaaaaaaatacaggaaagataagccaaaacgtactgaaattgctaacctacaggacgttgagtgagaaaaggatataaagaagaatgtatagcttttttagaaccacagtaatgtttcccatacaaaaataaaaattaacaatgcggggtggggaaaacagggaaggctagaattgaatactgtagtaacaaatgaacctaactgtattacaaaacaacataaccatactgaaagatttggtggaaggaaataactaacctacgtaacttcagaaaactgtattttgactgcataacagttaacatactgtacaaaaatattgtactctagttagcaaatgtgtttttcacaggggtactagatgacaactgtgagactatacgggtactaggattaaacgagtatcaataaggaagggggaaggctgctgtgttgaactggtatgaacttacggttttttatatatatatacaggttaagtagatacagaaatatagatgtgtgtgtatgcacctgtgagcatagatacatatgtttccttgctttgccttttgagacatcctagaagcagtgacacttacgaagtaacaatgagcacaactagtactcagattttagttcctaataaaaggaacctgagctgaagtaggcaaaatacaagaggaacctggaacatctagtattagaaagtatttcaaaatataagcggtacatgctaaaaggacacaggagccaatctgaaagagcgcccaatacccaaagttgagataactggagcaactgtataaacagtaataggttataatccattaaataaaataaatatccatgggaccatcctgatattcacaactgagtcaatgaatgagtaaataaatgaggggggaagacacctcttcctaacagaattccatttaatgcaggtaggaagtagaacaaccaccctttagtaaacaacacagcaataattgctgtaggaaaaagtcatcagtgaacaataaaattatgagtaaaaatataatgagcaacagaatatttacatagtgtctccctataagacagtcatttattccagccagggcaaaatggcaaaaccttgtcactacaaaaaacataaaaatgtgccaggcatggtggcacatgcctgtgatcccagctacttgggaggctgagagatgggaggatagctgagccagggaggtgaaggctggagtggtgattgcgacactgcactccagcctgggtgacaaagtgagaccctatctctaaataaataaataaataaataaataaataaataaataaatattgtcagttattacaaagggaaaaatgctaattttacagaggagaaagctgtcaggcaccaccttaaccaagggaacaaacctatcatcactattagaaagacaagtcaaaatcatgaaccccctgtggtgtagagaagggtacagtatcttctgtggcattcctgtaaaacaatgcgtaacctctaataatgagaaaacaccaatttgtggaacgctatacaaaataactgaccagaaatcttgtatccaagtaatgaaatacaaaaactgagaactctcacatattgaaggacatttagagatgcaaaaactaaaagcaatgatagattctggacaacagaaaggacattaataagaaaactaataatacagaaattcaaataaagtatgtctattactttgtataagttcaatgttaatttcaatgttaatttcgtggttctgataattaacgattattgtgacaagatgtgttaagattagagaaagctccgtacggagactctgtactactatttcaacacacacacactctctctttctttctgacacaatctcgctgttgaccaggctggaatgcagtggcacaatcttggctcattgcaacctctgcctcctgggttcaagtgattcttgtgcctcagcctcccgagtagctgggattacaggcgcacaccaccacacctggctaatttttgtatttttagtagagacggggtttcaccatgttggccaggctggtctcaaatttctgtcctcaggtgatctgcccacctctgcctcccaaagtgctgggattttaggtcaccgtgcccagcctaaaatcatattttaaaagaatgaagaaaaaatgtatctagcattaataaaacaaacttcattcatacataaatctgtacagtctacaggttcctatcagttacagtactcacttaagataaatatagaatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggagga

SEQ ID NO: 739 - DNA, 195390 bp, Homo sapiens
attctgtaacttttttttttatttttttcaatttttccttcttttttttttttaagcactagtctgtgctttgcgaacagaatcaagacattaacaaagatcagcttctctgaagaaaagcatttctatagaacaaagacagctacatgtttcgctgccattacacagctccaaagcaggaaaagaaaatatttacaaaatacaaggttttttttttccattttttgtttttgttttttttttcaatgctaaaagggttattcagaattttcaaccttataaatagaagaagcactttatgcatagggatatggtgcattattgtatttttttttaaagaaacaatgacaaaccctttaacttgcaaacagaaaaaaaaatcactaatgttgaaaattgtgaaaaaaccccaaccattaagcagttgtctactatttttatacgattacaaaatggccaaaaaaaaagagtcttctcccccctccccctttttggtgatgtgatcatacaggagacaggcacaaggttaacagagaagggtgaagggggaacaatgggaaccacagctaggaccagacaatgttccacaggcaaggggagcgtgaaagaccaagagtggaactaacaccgacagggatctggatgtgaaggaaacatggcaaagtgaatcagagggaaaaaaaaaaaaaatcacacagggagatggctgctcacttcccacaacccccagtttgcaggggagtgggaatagaggttaagtagtcctaaccctaccttcaaagatcaggataggtggtaaaaatattccaagtggaaggacgggttgtgggtgtgtacatggcatgggagagcagacagggaagggtaccaaggggcatgaggaggggaacctgagcagccacagccaggttactgcagtgaaagagtcaaaacagagaagaccaaatgcagatgaaacaaaaaatcagtctcttaagttctgggtgagaaaggaaaggtgttctgccagctgagcactcggggagagcagctggcagttatggcagagaggctctggtggggatgttccagcacgaaaaaccaaggggacccagccaggagggccacagcagagccaagccacagatgggaggggagggggtaagagtccagagcaccctgccccattccaccctagctcaagaaggccatgctaaactgtagcccgccaggctgttctgccctgcccacaggtgtgagggagggggtggtcatctaagatcagtaagtccagtgattcaacagtgcagaggatgtgccaggaccaggccagcagggtctcatcctgaacttctgtttgccaacgggaggaagtgctcaggtgtgtgacaagaaaacatggaaacaaaaacaaaacaaaaattaaaacaagaaaaaaaaataccaaagtaggatctaaattccttaagttcactaaaaactgtgaaaatttccggcatatgatgtttgaatatcaaacgcagagatttctgaagctttaatgccaatagttagtgagtctgtttagatggctgtctcccgctcatctgtgagtcgggcgctgagctgtggctgctgccaccagatgccgactcttgagggggacaatgggaggcgaggtgggcgctgcctctgtctcccggccagtcttgctgcctgaggtgcgtcgagtgcagcgggctgctcgctcctgtgcatccagctggtcctcacactccgcctggggactgtgcgccagggggaaggtccgccgctcccagggctggacagactgtaggcagacaagttgctctttgaggacccagtcccagccagcctgcttcctgctccaaggccctgccacaaaccttgtggcctggagcctaggaccagtctatctagtgttcctgcgacagtctgggaacacccctcctagggtatacccagacaactgtattgatcatttagcagtgatcaatacagttccactgaacgttgaggagatcaatttaagtgcagccctttgtcccttcaaaagggggaggggatggctaggtccctcttcagcagatgctgccccttcctggttccatcccccaaccatgccaaccccacccaaaggctgcgtcccttacctgttcatccagccccagctctggtgtggaacaacgggtatcctcactggctaagtgtcgcggagtgtcccgagccacaggggtgaggggtgctgagtgcagttccgggctaatggggctcctaggggactgaccatgggagtattctgacaaagagtggctactgctgacatcaggggaggcaggctggggggtggaggggttggcactgcccagctggggggttgtccggccgtctgatgacctgtaggacctgcacaccaaggaatgcaaatctgagtgcctgggaaatgtttacttatgggggtagagggcatgaaaaaagcatccccactggaggagttgaggcaaacaaacaccaacagattttccttaggatccagcaactcccatttcttcccactattctctggaggggtaggtatacaacatttaccatcccaagaaaaaagcatggctgaacaatgccaggtgagtccatagcaaagtgcctagtgaattcaggaggttagggagattcgtgtagactttgaaaactgtagtcaaagaaaaaaaagtaaaagtaagagctcccaaaactttctacttgagaatcccgagggtttctgccactgttaacaataaatggagacagggtagtgatggacgttaagggggggcagtttcttcaagtggcatcacaaagccactgtccaaaggaaggttaacttgtagcgaggccttccaagctccccgggttgaatcaccatgaccccccaactgtcttccaaatgccacagatcatgggaattcagaattacatagtgacttctcagcaaggatctagcacttggctccttatatctccactagttccatgtatctccactagttccaacaaacaccaaggaaattctgagctatttgccactgccagtagatgagtatgatgagcaaccaagaggcagtagcaattccatggactcaagtagggcccaaactccctgtccaccctctctccacaggccctggggacccaagcctgccccatcacctgctgccccgccgctggggtggcacactcgtggtccacagccaccgtgccctctccatctcctcacatttggcatgcagggcggcgaaggctgcgtcggataggtcctcaatctgcaatagagcagcttcatcgatcccctcttttctccaggagttaagaaccagtcccaccccattctaggttcttcccggtcacgacaggaatacaaggagcttgcacttcacacccacaagtcttcaggccatttagggtgtgtgcactcatatgtatgtgtgcatgtgtacacacgtgttcttctaacagaagaaccaggccattacctcttcattctcctcatcaggactccccttcagagactgaagatcaacctcccgccagctgcaaaaccaagaacagacaatcatgagatggcaagcaggctaaaactgggggcagggtcaaagtgtccatgcaaggatgagaatcctgcacctgtgggtgacactgctctctgccgggtaggctctgccctatcacagctcagtctccctaccctgtcaaggcctgtgaaattggccacctactcaaatgcccaagaaggccagaaatgagagaagcggcctagggtaaggctgaggctgagagactgtgacaaacacaagaaaagaaacctgtttaaagaggaccaccactgttcaggaccagctgattgctcccatatggaaatgcatacccagggttgcctaatcttctgtttggcaacaaaagctggaaacaaagatttttatgtgaaatcctgctttgatgttgacaacaaattcagtattttaaaacatactgtatgtgttgacaaaaccggtctctagaccagtaagtgaatggcctaccaggctgtgactgctggttcgtttggtgtattcctataatggaatgagagagaactatatacagaaataatttcgttcttatcagataagaatttctcttaatgagaagacagaaccaaagactagggcccaactcttggtcagaagagaagagggaaaaagggcaatagcaggaagaatggggagaggagccaactattctgagcttctacctgggcgtaaggatttccttgtattgcagtttctctacgcgagttgttgcagcaacagacattgggatgacaatgttgttaatatcaaatgagctctctccccttctcctccttactggctgctgctgtaagataaaaattaagtttaaaaggaaggtacaattttacagacatcaaatcattcatctaagagttaaagcaggatcaccaataaccaagcatctgggtccttgggttgaagctgagtaatgaccatagcagctgctcccacctaggagtcagtctccaacagcaaaaaacctcacggagaaataccaggtggtcatgaggagttagtcccattcataagtcccactggtcaccctcttccttcaagggctcatgcgtaaatttcataggggtgggtacctgggatcttaactgttggggttcctactctatatacacctctattaacctcctctccttttacaatctttatttccttcctttatccccgtttatgacttaagactcatagtggcccctcccctaaaagcaatgcttgaaagcttatgctgaaagaggcccaaaggataggcccatctcaatacatcatctaaccttggttgtcatgaatgcacctccttctcaaagatctgaactcttcagctaaatctgcacccaccatctgcccagtctttatgtgatttcccctcttttgatgattcttggggaaagagctgagagctttctagctgtatcaaaggagatgaatggagggaaactaaagaggagaacctgactatacctcacattcctggtgaaaggaaatttgcttctataggaaatagttgagaagaccaaactcttggaaaaataagacttccaaggatcgaatatcagaggcagaggtaagcatctacagtagctgggagactagggaactaaatggcttagtctcttggatggaggaagaagtctactagctgctgctgcccagatagttaataccctatcctgaaacagagactagcaactgagctgtgagaggccagaaggaaacagtggcataacaaacacgctgccatggcaacaaaacagctggaaaacacctaagaggctgcatttatacctaaaccaccaagtgtggtcagtccacagggaaggggttggaggagtaagaagtcccctataactaacccctctatcctctgttcctggacggtgagataccctttattcatcctatcatcttaggacattctcagagaatgttaaaagtcagcacttcctgggccagagtttcagtcactgtcatttataacttcagatgaccacaatgcccttttcacttcaatttctttctctatcaaatcagatgactgccattgacctcagaaatttaggatatctggttaaccaaaatggttaaacagacttttggggatcttgcctgagttctgtagctgaggattagtgatctcatacccagagacctctgccactgccagatctgtgctgaaattatacatcccactacaagaaatgcatcttaagaaagcctcaagagagacagccttcccagtatcttggtcaagaataaatgtgaaactgctggcagaaacaggtatacactttccctgaaacttcttgggcttgttgttagtaccttcgagaaaaagatactggagcaggttgtgggatggttcaacgggctcttatctcatcctctgcctagacacaccccctattatgttagctactcattaggtctaaattaactactatctcctatttagagccagagatagagagcaggtgatgagaataaaactggttcccaaacttggttgtatatcagaagcaacattaaggagtattttttaaaaaaaaaaaaaaggttctaggactcccccccgctcttttataaaatcagaattttgtttgtttgtttgtttaagagatgaggtctcactatgttgtccaggctggactcaatctcctgggctgaagagatcttcctgagtagctggagctacaggcatgcaatatcacagccagcaacaaatcagatctttagaagtgtctggttggttggttttgttttttaaagctgctgaggtgattctgatgcagctactggcttttgggaagcactgacaaaaacactcgctctcctccctacctttctccagtgtcctctggcttctttacttgatttcaaggagagctggccctttgtatccatgggttcaaccaattgtggattgaaaatatttgggggaaaaaaattgtgtctgtactgaaaaggtacagatttttcttttcattattctctaaacaatacagcatactatttttatagcatttacattgcattaggtattatcagtaatctggagatgatttaaagtatatgggatttaaagcatacacataggttatatgcaaatactatgctattttatattagggacatgagcaacaatagcttttgctatctatgggaggtcctggaaccaatccccactgcagatactgcagatactgagagcctgctgttatctggcctatcttctttctttttttttttttgagacgaagtcttgctgcgacgcccaggcttgagtgcaatggcttgatctccgctcactggaacctccgcttcccagttcaagtgattctcctgcctcagagtagctggaactataggcacatgccaccacgcccagttaatttttgtatttttagtagggatagggtttcaccttattggccaggatggtctcgaactcctgacctcaagtgatccacccgcctcagccgcctccccaagtgctgggattataggtgagcgccactgtgcctggcctatcttcttttacataaatccagagtctttgaaaaaacttggcaatgagagagcctcaggggttagcatagtgctatacacaaaatttttactcaataaatggtaaaaatttcaagtgatccaggcctaagttaacattctccagacacagaaatattgaagtgctcaccaagtcctgaatctctgagttcagattttctatcagaattagtttagactcttttttataaatactttggttatctgaaaccctttgctgctggataactgagtatgtgagggacactacacacctatttagataaaatttgtgggttacgggggtaaagaaagtcgaagagcaaagagaccatttggaaaagattgatttgtaacagcaaagagagaacaatgtgaattcctacctgatcacaggagcctagtgagtccattttatgagcttggaagtttcctgatctaggctctgaaggaacttcctaagttgcctctgcaataccctcacccaggcttagcctgtgtagtgtaatggtaaaagagctggctctacagtcaggctgcctgagtttgaatcataattataaccctcacaagttgccttgacagttttcatgcatataaaatgaaatccacagtaccaacctacatctcaaaaggcattataacatgtaacacatgtaaatcactgatcactggtatgtagtaagtgttcaataaacattacagttgcagacttttacatttaccattacattacattgtaattattatacaaaaaggaccctttgagtaggtccatagcagctacaggtatgtatgttccaagagggcacacttgaggaattaaaatattagaatgaaattaaaggaaatgtgtctggaatagctgtgcaaactgcttccagatggagtgtggtatcgtaaaatctggtgtgtgcatgccaaatgtcctgccatgggggcctgctggatctgtaattctgctctgtatacctaaaaagcatggactctgccttctcccttcccttctcttctggtaccctcacgcctagtgtttattcttagtacttcacctccactcacccagagagtaaaaccaaggaaatcaaacactgcttccaacgcccatgggaatctcccctctacccacccctcctctcttgttcacttcttgggccaacaggattagggccacggaactgttgagtcctgtgtgaaacttagtccaacagatcttgaatagtcacagatcaccttaagagtttgtccctgcatcaagctttctatggatggctcagcataaatccatctctgctatgaaaaacaactcaagaaaaacaacagaaggtcaagtaccatgactttgacttaaaaatggtacagacatacatacatatgtcatgatgagctgagatcctataaatgccctgggctttataacccaccctcacactgtcctctggagccacttgagtgagctgtgacctgcagagggggtgtccggccaaccccacacaggtacttaccgatgtgctggctgtaacctgtgagctagagctggcgggtgcaggggaatctgaggaggtggagagctgtcgcaccaagggactgtgtggaggatggtgggtggctgccaagtagctcgaactgctcatgtctgtgtgatgcttcaacactgcagaagtcaacagaaaagagagaaatacatggctatcttaaccagcgttacttctaacacaagcttggaatggcagcaatacatactaaaggcaaaaatgttttctatgcctagaggataaaaaggtgaagcacactagctgtgggaagtaggggcagggcagaggttgctgtagcagttaagaagtgacctccatttagaagcagtagcgtccctctactctgctttcctagaaagtgaaggacaaagctgggggtaattaagagaagcctaggctgccccagaaagccctgagcaggtgcagttgcaggtagaggtgccatgggcctggccctaccttcacttctctcagatgaatggtctcgcaatctcattttgctgtggtttgggtcatgcacgggtggtggtgggttgagcaagcgctctgcttttggcgctgtcactcgctccaccatgggcacggcccccacatcgtctaagtgctgcctgtgggtcctgtcaggccgggtttggtgatgggacagctctgaagaggggaacagaaaaagagctgtgaaatatgtcctctcaaatattttcttattcgagttccaagctctcgagttctctctaggccaacgccgtatacccagggcagcaggacagtccttcaggactgaagtttctagtaatttgcacaatggctaggataggcacagggagcccagaaccagagaaacatgtcaccaggatacagaagacacctgcccgtagatgaactcaatgccatgccattgctggctgttcactgagcattttgggtcttgctccaagatccatggtgtctagaatagctcccgaagtccatctgagagcatccaagacaagcagaagcagtcactgtgagctgaattttttatcggtcaactgcctctcccaaccccaacatgcatgcaaactacaaatttgagaatataaaaggaatgaaaagtcactgatactctgggggacttcccggctccctgacacttactggctgttgttaggaaggagctgaccaatttgtgcctgtccttacgagctgaatctggcagactgcccggcatgggtgctctgtgcttaagcgataactttttgggaggtttgattttgtcaaaaggcttgttctgccactgagatttcagcatgctctggaaatgcaggcttgtgggaacatctgcaagaaacataaaatgctacaggttagtccaaacacctggcctctctagtgttcaagacctacactccatcctcctttaatttgcccagtggcctgacacttggcagggcaagtgctgtcatatggaagatctgtttacgtgaacattactgaaggtcattcttctatttgcaagcaggtcactttagctttttactttcaagtcccaaagggaaacaaaacaagacacctttttggtttggttgatggagtttttgttcttgtatccttgtttgttgaatttactggtttgaaaacatcctgtttctattctagagatttaaaaacatatttaagcctacttcttttctatcaatataaagttaatcaggatgcaattattcaacaatattcattatctatgttatcaggcactgtactgagtactacatactctctccaaataagaactacataccattctctctttccttcctctgtggctccgccaattcccatcatgagattatcggggatttttagctgactggttaatgttcaatatcacaaatcaacatcttttggactgaattttttatgctgtttcttatctttccattttcttagatttttcccaagaatatatccttgagcaattcctttagaaaaggaatttctagatttaaaccattttcctctcaaacatttaaagctattcaattcttccgtgtattctaatatccagtgctatatttaagagggaatcggattctttcttacttgtaggtggtctggtttttgccttttaagcttctgcaaaaaacaacaacaaacttgtggtattacactgactctacagatcaatttggggacaacttccatgtgttccaccaccaatactgaatctttcaatcgactgacgtggtatctctctctccatctatttacgtttgtcttgattttctcttgacagcgtttagttattgttgacataccggtcttaaatacaatttgttaagtttattcctaagaattagtgttttctgatgggcagaagttggaagagtttgcagggttcagaagaagacaggaagatgagggaaagtctggaacttcttagagatttgttaaatggttttgaccaaaatactgatagaaatacgggcagtgaaggccaggctgacaaaagtctcagatggaaatgattaaagatagtaccttttaaaatttcaacttcagttcttcattactagtatatagaagtacaataaactgctatataatgaccttgtagcctgtgaaactacttcgttatagactttttcttgtttattcagtaggattttctatagacataagtacatcatctacaaatggagactgttttaccttttctttccaatctgtattccttttttacttcttgcctattactctgactggaacctctggtgctgatgtacaacttttagattttccttttcatgttttcaatattctgacatttcaccaccatggatagcggtgtgagtctgttttcaagcttctgcaaagctttccagggatattcaaatctaaaagccagcacatttttcctcacctcccagttcctcctgggaatcggtaaccacttggggcatgctcagaagttcccgccagagtccctatccactgcttcagaatagaatgaaacaccactacttcaaggaagaaggctctggtggggtgagaggacaggaaaggaaaatctaacctagctattccaaaatgagtccaaatttatcacccagacaaatgcccaggtcctatcactactccttctgccctttaattctgggtcaaaaacctcctgtaatcagttcccacctcacagcaacttactcctggcatgtgctttgggctatctttctatttatttcttcacagttatcttgtctttatccatctttcaaaaataattacaaattccagtcactgatagcatgtcttctagaactattagaaatttattttgtgtgtgtgtgtgtgtgtgtgtgtgtgtgtgtgtatatttttttttttttgagacggagtcttgctgtcgcccaggctggagtgcagtggtaccatctcggctcactgcaagctccgcttcccgggttcatgccattctcctgcctcagcctcctgagtaggtgggactacaggcacccgccacctcgcccggctagttttctgtattttcagtagagacggggtttcactgtgttagccaggatggtctcgatctcgacctcgtgatccacctgcctcggcctcccaaagtgctgggattacaggcgtgagccactgcacccggcctgtttaatatattttctaaaagcttatggggttttgggtcccatagagcacagaggatatgctcaatctgaactgaggataagaaggcagggaagagacgtctaaattaacattactgaacccattattatctgccaggcactgtgtgtttatcatcatgcgtgtgccacttaatctttgtaacagttccatgaggcaaacacaattatgcttattttaaagatagggaacaggtgcagaaaggtacattaactatgtccaaggttacatagtttaatgagtaacaaccaactttcaaactcaagattatacaaccctaaagcccatactcttagacaatataccttgaggctactcactgatccagaggatggagaggattctgtagtaaagtcaattatttctcaaattactcccaagaaatagacagtacaaaatattttccaagccagttctgcagagtaaaagaaatttagccactcctgcctatggtatagatgatgaatttcatgacactgaatgttatgccttcgaggactgaatgttaggccttccaggactggaataaaaatctgagttggggaaaaaaaaaaaaaaaaaaagctaacattctcagggatgatttttcccagtgggtaagcaccctcagctccatgattgctgggctttatgacagtgaaacaaattaggaaaactattaaagttttaatgaaaacataacatttgctacctgtccaagtgtaaaaacacagtctctgaggacagtgctgtcttctcaaacatttttcataatcactcttttccacacttaaaaactcagctataccaaatcctaggaaataaagcattgtctagaagcattcggccctgtaaaacaatctgaaagctgggctgagctggaatgtataaaagaggctcaagaaaggagacgaggtcacttctgcccatcccacaatacccctttgtcagcagaagagttactcccacttggcaaaggctgtgtatgttttgtatatatatgtaatggaactccaaaaaacatagattttattttttccttttattttcccccatcgttctcccaaatctgaaaatgaagccaggaaaaaaaaaagggacagggatatgagagacctggttatagtgaaaacagcaatgactagaaacaagtaggcctggattcaggtcctggttctatctcgagtagaaggagaaagcaagaacaaatcattcagctgggctttagttccacctgtgaaatgaggcagtggggctagatcagggctggcaacattctagcattcattctctaaccctcctgttgtactggaggtacaaacacagctgtctttcctgttgtactggagacctcagattcttcccaaacaatacattaaataactccagacagttactgtcaattcatttgaataggcacaagaaaggacatctatttgttactgctagattatatgactgctatgagtctctcaactctaaaatgtttagtcaatgactcttcaactggaactccactcctaaacccttcccctcaactaaatgctcttaagtgcaagttggcacattgtagaacccaagtcatggaacactaccttgtactctccagttgacgtattaagcggaatcaagagcgattcctctttaaacccagtataaacagtttaaggaactccagctgctagactttgttagaagtttgctgtgttgccttttaattgcttccatgttaagagtgaacaggaacccagttatatcccccagtcagtaaaaaaaaaaaaaaaagatatcttaggaattgctggttgagttcatatactaactagtaagtgataatacctaggttctgtgaagagttaaaaatctaaaatagactggatacgggacctgaaagtaagcaaaaaaagggatatgaaatggaagagaacacaccagagatccattcagctagaggtctcctacattccatacccacataggtaaactgctattttcagagaagagggtgctgatccttatcaggtaaataacaggaaaataagacgaattactaatgtcatccttaagttactgtttcctcaaacaaaatgaaagatgaatgagaagaccctgacttcaggatgactagggtctgacattccacgattcacctggctgtctggctccttactttccaccattttctcaggcgcactttttccgggtgttttgtaatgctcacttcttcctcctgctgggaagttgctgtagcctcatgtgcagggtttggcaagctctctcaaaataccacagatcttcatggccagcaggtggtgctcttattaagccccttttataaagttaacaagcttttctccaaggttatatatcctctacatttccaactaaggattaactggatttgattacttgaggtgataaaacaaagcccccttcctgctggaatactaacaggttattataccctagtctctccaccttccacagccaggcgtagagttggctataacacagtccctcaatttctatcacccacacacacttaatgagaggggctgaggtacagtcaaggtgcgaggcacaactccaggatgaaaagcagcagttggttgttattctaacaaactacacaaactggttaggaaacagcactaaaactacttaaaaaaatatctgtcctatggggccagaaaacagctaagtatcacattcaaacaattttctgcctttatgtctggtataaatgtaactatatggaatcaatgaatcaaaatcatttttaaccttgttatgaaaaaaaaaaaagttggaaatcctgccactttaaaacatcttctagagaagaggttgtaagggtggcccagtagtaaaatctaccacacaaatgtttgacctacacagtcgtatgccaagctgctagccttcactgttatttactgctatacaatgatgtacagggaatcccaagacttcagggggtgtgttatttacacgggatattatgtgaatggtgccctttggagttggctatctctgcacccatgggaatcttctgatttccaaatggactgcattctgaatgtggcagttgtttgggtcaaagcaaaattattccaacaggaataatattagacatggtaatcaggtcttcaggtcaaccaactgaggtgtaattaatctacaggcaaatacagtagttaatagagcctacatgtaaaaatatatatatatctccacagtctcataaggagaatttaatgaccaactttttcgtccaaaccccagggccatagctagaagctcttcgtgtgtgtgtgagacatagacagaaaaacaaataggattagatgcaggaaaataaaaaccataaagaccagaaaagggggagtgttccctatctttctttccattccccctcattgctgcctgtagttgctctgaatgatggtgtgggaggtgtaaggtatgcggcagggcagcattcatgtcagatctatagtgtcctgcagtcagcaggacagaaaatgttcaagggaaatggaacctcttagtagagatgctgaatgatggaacaggagctgagagacacacagtctgggtatatctgagggtgggggaggttatttgcaactgtatgtggtaatgctgttgacaaagaaatgactgttctgtttagcaggtgatatccaatgagtgtgcttaagtgtccgggcttcctgtccttcttcaagtatgagactatacaattcaacacagtaattcagagagtaacccaacaaacattcctaagtcttcctagtggcgctgtctgtagccagaatcccaaaaagggtaaaaatctgactcctcttaataatctgtctggaaaggaacttgaaatatagtaaaaggaaggacaggcatcagataatctgggtctgaactgtgaaggcattcaaacccattagccatttagttttagataagccacaaccttaccaagcctgttccttgagcactaacactgaagtaacaccttacaaaatttctgggccgggcatggtggctcatgcctataatcccagcactttaggaagccaagatgggtagatcgcttgggcccaagagtttgagaccagcatgggcaacacggggaaacctcttctctactaaaaatgcaaaaaattagccaggcatggtggtgtgcacctgtagtcccagctacccactgaagtgggagaatcacctgatcctgggaggccgatgctgcaatgagccaaaaaccacaccactgcattctagcctgagtgacagagtgagactctgtcaaaaaaaaaaaaaaaaaaaaaaaaaaaaaaagccaggtgcggtggctcatgcttgtaatcccagcactttgggaggccaagacgggtggatcacgaggtcaggagttcaagaccctcctggccaatatggtgaaacccccatctctactaaaagtacaaaaattagccgggcgtggtggcgcgtgcctgtagtcccagctactcaggaggctgaggcaggagaattgcttgaacttgggaggcggaggttgcagtgacccgagattgcacgactgcactccagcctgggtgacagagcaaaactgtctcaaaagtaaaaaaaaaaaaaaaaaagaattttgaaagcagcatatgagacaaatatgagaagagtactacaaactttaaaatgctatacaaatagtaactgcagttacatgggctacataaatccaatggcaagggaaggtaaaagtcagtgactctggaatctgaagcacagaggaaaatgttttagtgttttccactcattgtgttcaagtttatttattgctccaccagctcctgactatccatgtgttccaggttttctgtttcctttctcttacaagaaatcacatggccacaggaatattacaccacatccttatcacagctagggggttttggtaacaaaagccaaaaatcccggtatctactggatttaggtggccagaaatgcaatcatttgaagaacagatgcagaacaggggattatagttatctaatatttgatcaactgtcaattagaaggattctctctaggacaagggttagcaatgattgtttttataaataaacttttgttgcaacacaatcaggttcatttgttcacatattgtctatggctgcttttgtgctacaatgacagggttgagcagttgtgacatgaactgacatcaattatatggcctgcaaagcctaagatatttaccatatggcccttgaagaaaaagttcaggccgggcgtggtggtttacacctgtaatcccagcactttgagaggccaagatgggtggatcacttgagctcagttcaaaaccagcctgggcaatatagcaagaccccatctttgtagggggcgggaggcggggaagcaggttgtggtggtgcacacttgtagtcccagatacttaggaggctgaagtgggaggactgtttagagcccaggaagtcaaggttgcagtgagctgtgatcactccactgaactccagcttagggcaccgagcaagaccctgtatctaaaaaataaaaattaaaaaaaaaaaaaaaaaaaaaaaaaaacttacagactacctgggagatattatgaagaacagcatggagcccttatcctcagggagattacatcccatcccttccccactccccccgccaccaagacagggtctcactaccgttccccaggctgcagtgcattggctcaatcatggctcactgcggccaagacttcctgggctcagctgatcctcccacctcagcctgctgagtagctgggacgacaggcgtgtgccaccacgcccagttaattcttgtgtttttagtagagatagggttttgccatgttgcccatgctggtctcaaacttctgacctcagatgatgaacccgccacggcctccaaaagtgccaggattacaggtgtgagccactgtgcctggtccctaaaatttaaataacagaaagcaaatacacaaacagccataacataattcattaacatattgataaaacacaatagggtaggtgcagtggctcctgactgtaatcccagcactttagggaggccgaggcgggtggatcacctgaggtcaggagttggagaccagcctggccaacatggtaaaaccccatctctactaaaaatacaaaaaaattagccaggcgtggtggcatacgactgtagtcccagctacttgggaggctgagacaaaactgcttgaacccaggaggtgggggctgcagtgagccaacatcacaccactgcactacagcctgggcaacaaaagcgagactctgtctcaaaacaaaacaacaacaaaaacaaaaacccaccagtgatttgagaggaaattcctaccttctgtaggctgggcacagatcatgagattacgtgaaaattcaatgaaaccaatccagattatgaaagcgctggcttccatctagaatagtggtttcaaaatgtctttgctcatgcacccccatttgatatgtgatttttaaaaaatcataatttcagatagttgtaaagattatatttgaatactacataatgctttaaaaacatttttatcaaaactttggcatgtaaatatatttagcttcattaattgaaaaaaaaaacttcttttaaacttatttagctaatcagactttagatattaactcagtatttattctaagacagacaaggaataggaccatgtaactgagctcagacccatcccagccactcgaagagttagagggaaatctcttagttgcaatcttttagtggtaccctctggtttggtagatctgttgcagtctttttggagaattctaagagaagacttggttgataggagttcctgagttatctctattttatttttaaaattcaaaacttttttgcttaatacctgggagattctccttcaggtgctgagaactcttagaaatgatctctttatttgttgtccccaccatccaagacctttttttttttttttttttttttttgagacagtcttgctctgtcgcccgagctggagtgcagtggcatgatcttgactcactgcgacctctggcctccaggttcaagcgattctcctcccaaataactgggattacagacatatgccaccacgccctgctaatttttgtatttttagtagagaaggggtttcaccatgttggccaggctggtctcgaactcctgatctcatgatccgcccgtcttggcctcccaaagtgctgggattacaagcgtgagccaccacacctggtctcgaactcctgacctcaagtgatctgcctgccttggtctcccaaagtgacgggattaaagacgtgggccacgacaccgagcctcaagatttttacactctggggcaagacccatagtgggactcaatatggccaaaaggaatgctcttcttttgtcaagtgggagaggtacaggtatgggaagggaggtgggaaaggagggctgtcagacacagagatttaacagggaggcaaactttagaaagacagtacaagctaacaacgaagatttgtgcttatctacaccctgcaaagctgtcgcgttaccacataaatgccagtatgaagatattctcctagaacactgccgtccatcctacattatatcatggcacgcacagacaaaacttttttttttttttgagacagagtcttgctctgttatccaggctagagtgcaatggtgcaatcttggctcactgcaacctctgcctcccaggttcaagcaattctcctgccttagcctcccaagtagctgggattacagacaggcacaaccacgactggctaattttttatatttagtagagacggtggtttcaccatgttggtcaggctggtctagaactcctgacctcaggtgatccgtccacctcagcctcccaaagtgctgggattacaggcgtgacccaccacgcctggcccagacaaaacatttttaaagatatactaagcgtattttggaccagattactgtggctagaggcaactgagcccagatccctcctagctacttgaagagttagaaggaaatctcatattaagttgcaaccttttagtggcaccttctggtttggtggatctgttacagtctttttgcaaaattctaagagaagacttggttgacgaaagttgtaccttgaaagtatctgagttgtaactgcaccttggctgattttctttcacctagaagtctctcaagtttctttcattagactttctagtctgtggtctttcttaccatctggaaatgctagaacaggatgaacacaagagtccaactgggaaagacgttccaacagaggggcttcatagtgaatttcgggaggcatggtgttgatgctgcctgaaccacacagtgcgcaggagggattcacatcacagccagggcggattgtgctgttccggtgaacctgtgaaaaaagccaaacaaaactgacaattcagcatctgataaaaagccagctacccatttgttatccccatttgttattgagaagttagctccccatttgttattgcgaagacctttctagatacttgtgtgacactactaaaaggatgtttgattagtttgttaaaagatttccatttgtctaacacactgaccttcaaagtgggtaaggaaacttgcttccttttcattgatgaaatctaactacttgaagctctaagtgcttacctaggtatcaaacttctgacagtttaaaaagatactaaaactgtgctttctgagaacactttataaactctgcatgctttcacgaccttgatggtccgctaagacgaacagttggttcttgattcccaggtgggacattacttgctttcttcagcaaatttatccacctaggagccttcaattaccaaccacacctcttctcttcttttcacacctcttcttcaaaagactttcaggtggtctcaagccaggtggcaagcttccctgaagcttgtaacttaaaagtaacttattaactactctttaacctggcctaaaatccactgttacaaagctcatacctaagtaataaaataacattttgtacagcaaatgctcactttcatagtcttcatgttagattaattccaaagggtagaaattatttccactgaacttcctttgtgcacatgtgggcagaataattgataacctctccaggtaagtccaaagttaaatatgaactaatttaagtcttcaaaagattgaattctgtataaaaactgaacatctacaattttatactttgagcaaatttcaggtcatgctgaatgcaggatccctacattctagtgttaggatgaacaagtctggcatttgccaaagcctaactcataaagtcacctggacacacagccccagaaaaagaaacttgcatgttgaatggcactataagaaggcatcctaggtgcaagctcagtagtagaacaaagacaaaaagcatcaaaactctactagcaaaaactctaacatttactagagctccatttattttcagcagagacatctcgaaagccttttatggatttgtgtaagagaaagatatacataagaacaatgtggtctttatcaacattcccccgacattctattgtaaccacatagagaggtggcacgcaaataaagtcttttaaaggttagactgggcaaatcacacagaactagaagccactgaaagggagtgataccaactaggcatgctacttttgtgtagacaatattaactggtattgttttgggaaaaaaaaaatccctgtatctatgtaatcagagctggctttctggagaggatgacattttgaggtaaagagaaatgagtaggtagagatgaaaatgagatcacacagtgggtgagtgggaggatttaggaaaattggttaggatccaaaaattacactgaaactttcaatattcaaaagagattatctcactccagtaggtatagcaaataaaaaataaaaagagagagactagaaaccaacccatgacatcaactagctctccatatgggacatttaacaacactacattttatggctagagtgtatcacttaagtcaaagtcaatattgggaggccaaggcgggtggatcacttgaggtcaggagtttgagactagcctggccaacatggtgaaaccccgactctactgaaaatagaaacgtcagctgggtgtggtggtgggagcctgtaatctcagctactcgggaggctgaggcaggagaatcgcttgaatctgggaggcagaggttgcagtgagctgagatcacaccactgcactccagcctgggcgacagaatgagactaagtccaaagacaagcaaacaaacaaaaaaacaaaacaacaacaataaaaaaattcaatagatgtggctaggcgtggtggctcacaactgtaatcccaaaactttgaggtgggagagaggattgcttgaagccaggagtctgagactagcctgggcaacacagtaagactccatctcttaaaataaaatttaaaattaaaaaaaaaaaaaaaaaaaaaatttagcccagcatggtattgcatgcctttagtcccagctactcaggaggctgagggagaagaatcgcttaagcccaggagttcaggttatagtgagccatgattgcaccactgcactgcagcctgggaaaaagagtaagatcctgtctccaaaaaaaaaaaaaaaaaaaaaaaaggctgcgcatggtggctcacgcctgtaatcccagtactttgggaggccaaggtgggtggataacctgaggtcaggagttcgagaccagcctggccaacatggtgaaaccccgtctctactaaaaatacaaaaaactgggcatggtggtgggcacctgtaatcccagctactggagaggctggtaagagaatcacttgaacctgggaggcagaggttgcagtgagctgagattgcaccactgcactccagcctggggaacaagagcaaaactccgtctccaaaaaaatttaaaaatttaaaaaaataaaataaagggtagaaattctacttataacttgacaaaagggtaatgtgcacacatgtaacttaaacagtaatctcacttttaaattaaaaactgtaaagtactaatagaacccgaggagtatataaaaatatatttaatacttattttttttttgagacagagtcttgctctgtcacccaggctggagtgcagtggcgcaagtctgccttccaggttcacaccattctcctgcctcagcctctcaagtagctgggactacaggcgcccaccaccacacccagctaatatttttgtatttttttagtagagacagggtttcaccattgttagccaggatggtcttgatctcctgacctcgtgatctgcccgcctcggcctcccaaatgctgggattataggcatgagccaccgcacccggccaaagatatatttaatacttattaaaggatacattttggaaaatttttgaaagaaaacttgaattcatacccatgttgcacaaatccacaccaagaatctatcctgcagacaaacttaagtgtacacacgcacacgctcttccactgaaacaagatgccaaatcatctgcatgaattcatttaagttaaaaaacaacaagaacacacacaatattgtgttttacaataagaaaacaaatttttaaaaatatcacaacagatggtgtgcacgtgtagccctagctatttgggaggctgaggtggctcacttgagcccaggagtgaggagctatagtgatcatgtccactgcactccaggcctgggagacagagtgagtcagtctcttaaaagaaaaaaaaaacaaggatctcctgggctcaagagattcttctgccttagcctaccaagtagctgggattgcaggcatgcaccaccacgcccagctaatcttttatatttttagtagagacggggtttcaccacgttggccaggctggtctcaaactcctgacctcagatgatccacccgtatcagcttcccaaagtgctgggattacaggcgtgagccatcgcgaccggtcccagtcatgaaatcctattggcagaatccaaccacttcataccacctcaactacactcaatctagtccaagtcactatcttttctcaaatgggtttcttcaagcctcctaactgatcctcctcctactggttcttacttccaaatcaatcaacacagtaatcagtgtaaatcttgttttaaaatctcaatcacatcataccaacctcataatcttccaaatgacttctcatctcacgaggaatagaaaccaaacttcttgcatggttcccacaaggtcctatagtatttgtcgcctctatcccctctctctgacttcacctcatttttttgttactctcctagctgacactaccagttactctgatttccttgctatatttctccaagatagcaggcaaccttccagatcacaggcctctgcacttggctcttcaaccactaattccatggtcattctctcacatcgtgtctttttctttaaatgtcagtattcaaagtaactttttttttttttttgagatggagtctcgctgtcgcccaggctggagtgcagtggtgggatctcagctcactgcaagctacgcctcctagcttcatgccattctcctatctcagcctcccgagtagctgggactataggcgcccgccacaacacctgactaatgtttgtattttttgtagagacagggtttcacggtgttagccaggatggtctcgatctcctgacctcgtgatccgcctgcctcagcttcccaaagtgctgggattacagacgtgagccaccgtgtccggcccaaagtaagttttatttagaaatacaagtgaaaggccaggcgcggtggctcacgcctgtattcccagcactttgggaagccaaggcaggtggatcacctgaggttaggagttcaagaccagcctgaccaacatggtgaaacctcatctctactaaaaatacaaaaaattagccgggcatggtggcgggcgcctgtaatcccagctactcgggaggctgaggcagaagaatcgcttgaacccaggaggcagacgttacagtgagctgagatcgcaccactgcactccagcctgggcgacaagagcaaaactccctctcaaaaaaaaaaaaaagtgaaaaaagattatattcttgactgtaacaacaaaaaatgccctggaataagtttaacaagaaatttaagcacaaagcttaaagatattgatattctacaaattaatgcagaatcttaatagacttgaggggggaggggagacaaggcaaaggggatttaaacaaataatctaaaagatacaactgaaagaatgtaaggaaccattccccaaaatttctgataagcaaaaatacaggggagtgatctggcctattacatgttttatagttacagtaattaaaataatctgccctcggttaagaaacagaaaatttaaataaaaacaaaaattgaccaaagtatatatgacagtttattgtttaactaaaataatacttttaaatcagtttaaaaaaacaaaaggaggtattactttttcaacaaatgaatcaggaaaaccaagaggtcatacagaagaaaacggctgcatttctgcctcacaccaaaattaattctaaataaagatttattcattttcattttattttatttttttgatacagagtctcgctctgttgcccaggctagagtgcaatggtgcgatctcggctcactgcaacctccatctccgggttcaagtgattctcctgccttagcctcccaagtaggtgggattacaggcacccaccaccaagcctggctaatttctgtatttttagtagagacgggggtttcgccatgctggcaaggttggtctcaaactcctgacctcaggtaatccacccaccttggcctcccaaagtgctagaataacaagtgtgagccaccgtgcctggccccaaataaagatttaaatataaaaacaaatattatactcaaatctaaaaaaaaaaaaattgtgaagcaatatatagtggttaacagtatgagctgtggagccagactgcctgggtttgaaccttgactccgccacttactagctgtgtggccttaagacaagttactgtgtcttcatctttactaacaggagagtacctgatagagttgttttaaagataaataactcacaacagtatctggctctcgactcttaatcacttttgtaaaaccgtaagtatagctactgatagaacatttaccatcaaacttgatagaacatttaccatcaaagatcttgatttcaaaattctagcttcttaacactgtataatatgatcattgataagtcacatgacatccttaaattttctcacttgttaaaaaggactaataataccaatttcatgggagtgtaggaaagatcaaatgactctgtaactgttaaaacattacacaaatgttagctaaattagtataccgcatgatttctcaacagctggcacttctttgttgtggggcacagtcctgtgcactgtagatatctagcagcatctctgtcctcatggtgcatgtgcctccctactcccccaatttgtgaaaatgagtaattactacagatattgccaaatgtctcctgtgaggacaaaatcactgagaaccatgaggttcaaattacggtcatcccgtctagaaaaattcaaagcacaggctcccattaaatattagtggtgagtcacagtaaacataagactcagtaaaaaaggaaaacaaaaaaaataaaaattaatagtaagaacaaagctctcaaagactattgtcaagaacaagcctgaagagagcttcccctaccaaagatcagataacgttagcatcataaagaaaagactacaatggcttgaaatacctcaaatatgtttcaatcaatgactcacagccccttcatgaaaaacttcagtgactgtccttagaggatagtagaaaactaatttgttattttgaaaattggtaaataaaaaaaaacaacaaatcatgctttcttctgtacaaactgtacctcagggtaaacaaatagttgaaaaggacaattttccctttataaacatattctatctagctaataaaagaaaaacagaaatgatacaagtagaatatcaccattcttcagcttccaatttaacaatgggtccaggcaatgatcaccagtggttgataacaaacagtttagtcattacgtgtcttctgatacaagcataaggcggccaccttgtgttttctcacgaaactaaaactggacttattcacgtttctactagttttcaagaaaaacaagggacagaaaaacatcactgttttttaaatgcactaaaaataagatggattaataaatggaaggatgattgtatgctaaaatgttagtggtagaacctagggagtagctacataggtgttcactgtaaaattcattcaacttcgtatctgaataatttcataacaaaatttggaaaagaaaacagtgacaccacaggacttctgcttctagcagagtaatagtgatcagatttacctttcagtcataaaccagaaaactggacaacaggcagtataacactgagaaataaatggggtggtctctaagactgccctggttttccgtctggaagtacattctagactgcagggcagggagaggatctgaagcagagtataatagcttcactgagttgaggaagcaaattctcactagatcagaattcagagactaaggaaactgaaaattgcaaggcaaaattcttgagaggaggaagctttacagaaaaagagccccagaaatcttcataagatccccctgagtgtttgctaaatattaaaaggtgcatgtaaagggtgaaactatcaggccaggcaagagcaactaggcagctgtgagctgaaatggtttccacagctaacacaagcctgagaggcttttaaactgtgaccagccaaagttgcatagagaattcaagacagaagatcctgctttagttgtggagctagactactaaggtggccaactcctcacctgacctaacaaatgacaaggaatttacctgccagcaaaacaaagcctctttaaaggaagatggcacaatccacatgctacaagcagggaaaattattaattggattttcagcttaaaacataaataaaacattgttagatatgccaagaggcaagaaaatactactatagggataaaatttttaaaagaaagtaggctgtgggaaactaaggtatcagataaatgaagttttctcaacaaataaatcacctatatggatagtttgtatcaaaccaacactctcactaattggaaaagccagatttaaaacacacacacacacacacacactctctctctctctctctctctctctctctctcaaaacataagaaaaatgctgacataatgacaatattgaaagctaagattccagagaggaaaagaacctggccaacatggcgaaaacccatctctactaaaaacacaaaaattagctaggcatggtggcacgtgtctgtaatctcagctacttgctgaggcaggagaatcgcttgaacctgggagatggaggtttcagtgagccaaggatgtgccactgcactccagcctgggcaacagagcgagactccatctcggaaaaaaaaaaaaagaaagaaagaaaaaaaaaagagcagagcttttggtactcttgtagggctgaatggataacactagagacttgaaatgtcaaattatcaataaaaagaggacagggaactaagcatgacacacttccaagtaccaccctcccaaagaaatagctgaagttgtgaatggtaggaggctacaaagctaagtggaaagtctctgaaaagggcagagatgtttctggcagtctcgtgaggagactagaattagatctcaggatatgctaagaggaaaggaggctgggcacagtggctcacacctgtaatcccagcactttgggaggctgaggcgggcagaccacctaaggtcaggagttcgaaaccagcttggccaacatggtgaaaccccgtctctactaaaaatacaaaaattagctgggcatggtagcacgcgcctgtagtcccagctacttggaaggctgaggcaggaaggagaatcatatgaacccgggaggcagacgttgcagtgagccaagatcatgccattgcacttcagcctgggtgacagagcgaggcgaggctctgactccaaaaaaaaaaaaaaaaaaaagagagagagagagagagagagagagagaaaaggaaactgatcaacacatgttctcagctggaactaagagagagaaacagactgttatctttttgagacagagtctagctctgctgcccagactggagtgcagtagcttgatcttgactcactgcaacctctgcctcccagcttcaaaccattcacctgcctcagccacctgtgtagctgccaccacagctggcttttttatttttgagatgaagagattgcaccactgcactccagcctggcgacagagcgagactccatcttgggggaggggagggggacaaaaaacaaacaacaacaacaaaaaatcagcctgtgcaacacagtgagacctgcatctcaataaaataatgagataaaatacttgatacacgaagaaattcccacgttcccttaattaatactgcaatgctatcaattctctttgaaggaattcccaagaaatactcaatttaatacttatgaaggaattaataccaaagtaaaactctattcaccattttctgttaatcatagcatattcgtccaaaacactaaaagaattcttttggctcaaggacaggttataatcatttgcttttgctttgcatttgatattcgttatctaactcatccactgttaacatgtggaaagattttcaaaggtttggcaactctatcacaatcaagcatatcccacaactggctcttgaagatccatcagagtgaagaaacaaaacgtgtaagcttctattttatctcagtctttcaaaatttattttgtatgtgttttataatgtatatataaaacaccgtcataacagtttagaggtaactgttccaagcacagagtgatttctgagtattcttttagtagctttatgtcctaaggtacaattttctacatggcatgcttgctcctttccaaatgtctaactagtatgaaaaagttggttgggcctccaaggtctattgcactctgtcaaggaagaacgtatcaaattattaacttttaatactgactcatattctagttcattagtcctcaaccatggtgtcatgaaactggatttaaataggtggaatcaaaactaggaggcctagaatcatatattaacacctttatttaccctgatgtctacaggaaacctggtcatagccatgagagaatgccctgtacaaaaatgtcactcttcaagtgtgatacaatgggaagaagaggaggactactcggaattctatggaagccagctttaaaatttggcccagagcaatcccccctatgacaacaaggactacaaaattctaaaatgatgccagtacactgccaatttgttaggaaattgctactttttaaaaaattgaaagaaatgctattaagggcaataaaaatttcaagggtatgttagtaataaatgtagccattacctattctactggttattagtacaaaaaaacccagccttttcaaccattcatttccaaacactgatggtttccactgccagactatacacaagtttctaatggtccacagtaaattgagaatgagaacaatgcagtaaattattaataaaactacattcttttcttttttaaaaaaatactatttgtcttatggtttaattataaacataattttacttaaaaaataaaaagcaaccttatttgaaaattggctggtaccaattttattttaataactttattgatctgaaatcttagtacgtttaggttaagttataaacacctacttcacttaggcactgggccaggaaaagaacataatggcatataagaactttccactggagtgcttcttcattcacttagataattactaacatccaccatactagacccctaaagtgatgaaacacacaataaatagcaatataggctattcagtaattacaactagtaattccgtcattttataataaaattatgatttaggaagtactccatgttctccatgagccttactctgatattcacttaccacaccctagtggttattccttagattacatttaaaatattccacattcagagttgtagaggccttagactattatctcctccaggattactactgttagtctgtctttccacctccagtctcttgtgccaatccatcccaaacataatagttacagattggccgggcgcggtggctcacgcctgtaatcccagcactttgggaggccaaggcggatggatcagctgaagtcaggagttcgagaccagcctggccaacatggtgaaaccttgtctctactaaaaatacaaatattagccaggcgtcgtcgtgggtgcctgtgatcccagctactcaggaggctgaggcaggaaaattgcttgaacccgggaggcggaggctgcagtgagctgagattgtgccattgcactccagcctgggtgacagatcaagactccgactcaaaaaaaaaaaaaaaaacaaacaaacaaaaaaaaaaaaaaaaacatgttacagcagatttacctcccccaaaatagcttacaacacttctctgctcaaaaatttaaaacttatagactgaaacccaaatcatcagtttgggcattcaaggcttcctatttatttactgatagatctcatttctctttattcccaacgagtttaacttactgaacactttgttttagtcattgattttaagaagtacaagtgatataacaacagctttttttttttttttttttttttttagatggactctcactctctcaccaggctggagtgctgtggcgagatctcagctcactgcaacctctgacttcttggttcaagcgattctccagccccagcctctcgagtagctgggattacaggcacgtgccaccacgcccagctaatttttgtatttttagtagagatggggtttcatcatgttggccagggtggtcttgatctcctgacctcatgatctgccccaccttggcctcccaaagtgctgggattacaggcatgagccactgtgcctggccagcctttttaagggcaaaagagttactgcactaaacgtgcatctcaattttaagatatattccagccataattcaactaagctgatagccctttaaaaacacagtaattgggctgggtgtggtggctcacgcctgtaatcccagcactttgggaggccgaggcgggtggatcacttgaggtcaggagttcgagaccagtctggccaacacggtgaaacctcatctctactaaaaatacaaaaaatagctgggcgtggtggcgtatgcctgtaaccccagctactcgggagaatgaggcaggagaatcgcttgaacccgggaggaggaggttgcagtgagccgagatcgcaccattgcactccagcctgagcaacagagcaagactccatctcaaagaaaaaacaaaacaaaacaaaacctcaatgagttccctcaagtatgttttatttggttctggaatgcagtagagatcatttaagatgcaggtaaggaaaaaatattaatcacttgctttgtgtgttctgtactctgtactcacaataactgtgaactcactgtcatgtaacaatattagaacataatttacctgttaacttctttgctgtcattagaaagtaagctccatgaagataagggctttgttttccttaccaatgcaacctggctgccctgaataatacggtgggcattcaaaaatgctgttgaataaatctgtctggaaaaccgagcaattcaagatgacagaagacaagatgcttgctcatcagcaaataccactgaggtcatgtcatgagtgaggagccatgtgagacacagaaagcaacctagacagaaggaatggggtgtgtctctaactctggaagaactccagctttctgctagatctagtacatggtatatttcccaaagtcaactaatttctctgtcttatttttcatgcagcttacttttgtgtcaggatgattctgttttagaaagtggcattggaacaaaaggatatttagttttatgcctatctcttgcctaagctaccttttataattttatatgtacattcaaaactacattcgttcttaggcatggatcagaagaaggttggctacttcacatattaaaaaacaaaatccaggaggccaccacatacttcagaaaatttttatacgactcctgatgtcatgccatagtggctggtaaactgccaaaacagaggaagggtgctttattttcatgaggtggcggttttttttttttttttaaaatgtaaaagcattctgtgttaaattcatcaaggaattgacaaaaagctattttcctacacttgacagtaatatactgttttctgacattcctgttatcaactcctctgaaaatcttttagagatatacgactattagtaaaaaaaaaaaaaaaaaaacaaaaaaaaaactgagactgaaatgtcaatatgaaaaccctgccaaataccttattcttatctatttctgctattttgatatttcaggtagagtccgaggaatagacaggaagaaatggtatcgcctgacagtcaattctacaattcttttctttaaagagaacatggcaaacttacacagtacaactgcatactagaataaaacaaggaaagtactgaaaattcaccatgcaaatactaattgttccagcaattctctcatctcccttatttgtcattagcaaatatgttgctagtggctctcttaagaaaaattcccattctctgctctcttttacagcaacattctttgaaaatgttatctacaatggttccctcaattccttctgtggccttgtctcctgaaaccactccaaccatgctttaattcacctttctccctctaccaaaactgctcaccaatgtctgcaacaaccccaccccactaaattcaatggtctcaattctcagccttcatcttactgatcctgtctgtaacaactgacacagacaatccctcctcctcctccctctccaaaacactttctccccttgcctttcacataccacactctcttggtttttcttctactttattcgtcactcccttcccaatcctttcctcatctttcacaggaatgaggaggaatacctaagctctggaatacatcaaagggctaatccatatacctcttctttatctgagctctccagcactctctattccctcctctattgcatttctctctccaggattttttttaattaattaattttttattattattatactttaagttttagggtacatgtgcacaacgtgcaggttagttacatatgtatacgtgtgttttttttgtttgtttttttgtttttttaaaagacagagtctcaatcactctgtcatccaggctggagtgcagtggcacaaccatggttcactgcagtgtcaacctggtgggctcaaatgatcctcccgcctcagcctcctgagcaaatggactacacacgctcgcccacagcaggctttttttttttttaaagatatggggtctcactatgttgcccagactggtctcaaactcctgaacgcaagtgatcctccttcctcagcctcccaaagtgccaggattacaggtatgagccactgtgcctagcctctctccaagatttaatgctataggacacactgcagagttcatttattattttctttctcttaacaactagaatatttcatagggtaagcacttttgtctgttttgtttagtgttgtatacccagtgactagacagatttagctcgttgcaggaagccaataaatatttgttgaaagaatgaatgaacaacaacaaaagtggtaacaataacagccactttgtacgaggaacttatcaaccagacatcccaataagcatgttacatatatttcattgaaccctcaaacaaccctatgagatctctgaggctttggagaggagtggaagtcagggtggttaacatgcaccaaattaccaaactactaagtggtagtaccatgattcaaacccaaggttatcatcttcaaagataatgctcttaattcctgcacagtaccaattttactggaatattattatctcattagttttggaataaaggcaactgctatttgaagagtcagcaatctaaaattccctacagttgtgaattaatctccatttcctttgtgaagacaaacttttttttagtaatatcaatttaaaaactttagtgaagattcctttttttctcaggcagggtctcactctgtcacccaagcttaagtacagtggcacaaatacagctcaaagcagcctcaaccttatgggttcaagcaatcctgcctcggcctcctgaatagctgggactacaggtgtgcaccaccatgcttaatttttaaatactttgtagagatgaaggtctcactatattttccaggctggtattcaattcctaggctcaagcaatcctcctgccttggcctcccgaagtgttgggattacaggcatgagccactgcacatggccaagattcttttttagggcaaaggattctatactgccattttcagtgataacagtgaaggtgagagggcacactattctccttcaaagtgttaagggcagtacttaaactttcagtctctcccatttctattaaaaagctcaagacagtggttttcaaaactagctgcagagtcaccgaggagctttgtgttttctgaaaacaagattccaacatccaactccagagcaaacagggcccaggaacctagtattttataaagctccccagaagaccttggtggttagccaagtttagaaaacaccaaagttggcaagagactaactctatctgagcatctggctcactgcttgacaatgaccaactctcatctgtaccgaccttcttggaaagaggaacgatgctgttgggtcgaacaagcctccgcttcttacagctcagtacaggacgtgtccgggctgccacacaggtgccatcagatgatgaagagacgagattcagtcgttgcttcttatgtaattgttcctcagcatcagagctgtcacctggaatgtggtctgccaagacaggctgaagactatacaaggggaaggaagagtattctcagaacacacaaagaaacaaaataaataaacaacaagaaaacacaaagaaacaaagcctcttatactagttcaacctctatttgctaatgttcagacacaaagaagcattctagagcagaagcaggtctcctcttgatgtctgttaatctacctgtgtgtgcttatgtgtaaggttcttggtgcacattaactacatcatgtctgaaagataaaagtcaataaataaactcaagttctagtgattgagttctcctctacatcaaacacacgagtaaataaagtctagagaactacagttggttagaaaatgatgaattttgcaaatgttaatgggcttccttagaatcagttctatgaaacccgaattttaagggtgttgtacacatcattcacttgtacagaatctccctgaatcttttgttttctcccttgaatcttcataaatacagatttacaaacatagcccttggagatctaatctgtcctaagcagaggaggttaatataagcacttctgaggaattcctgcaagattaaaacaataataattcacagtaactgtagtgtcttttattttactccatgcccactccattttagtaggtaaaaggaaaatatacaattaattaaaatgcactgcttcattatacagtgaagattaaaaatgttactaagtgataaggcttccgcttctttaaaccagggtcagtcctggctaaagagaactaagagctccaaaacacctttacaagtctactaagtgtaggaagtagaagagctaaaacttacgtgttaataactccattgacaggtctgagtgctccacatgatttggtagacagtgactctgaaatatgaccaataataggggcaccatggttttccaatggctgagaaacagactcaatctgattaagaaaaaggaaaaaagaaattaacatgtacccaagcgcacccctgcctgaaaagcaccaccacttcatttgcacaaagcacctaaaacttctgatgatcaatttgaaaaacacaacttgaatgactgaagaaaaagaaaataagagaatcagtggtcaggtatgatggctcgcaactataattgcagcactttgggaggccaaggcaggaggatcgcttgagaccaggagttttgagaccagcctgggcaacacagcgagacctcatctctaattaaaaagagagagagagaggttgacagagagaaggagaatattatattagcttttgctttggggggaagagggatgaggaatccaaatgtacagactaaaagtaagtacctattgacaggaaaatgacctcaataattctatggaacagaagcttagcaaaacaattacacagtaacataagctttcaactaatgatcaagaaggatatactaacatcagtatcaagatgactaagaggaaatttaaatgtagttaatatctgcttaactctaacagagtatgctagaagcttgttttctaaaaactatgctttgtttaaaaatatacacacaggccggggatggtggctcatgactgtaaccccagtattttgagaggcaaaggtaggaggatctcttgagcccaggggttcaagaccagcctgggcaacatgacaaaaccccatctctacaacaaaaaaatacaaaattagccgggcatggtggtgcgtgcatgtagtcccagctactcaggaggctgaggtgggaggaggatcacctgagccaggaggcagaggctgcagtgagccatgatcatgccactgcactccagcctgggtgacagagtgagaccctgtctcaatgaataaataaataaataaacacacacacacatttttccctgacagaaaacaaagttaataaaatctcaatgaatctaattatctgatgctatcagatactaactattgtctttagagtattcaaatcaaatatgtttagaatataaaatgaaataacagatgagaaagaatagaaaaagtgtgatttgcagtattcaaaacaaattatatatttactaggctcaaaacggataggaacagtatgaatgccagtcatatagcacctctgaggtataggcaataaagcaacagatgcagctatccctcagttctagcaattgttgaactatcccagaaaggctatgggtctttgactccttactttatttttttgagatgaagtctcgctatcccgcccaagctggagtgcagtggcatgatagcagctcaccgtagcctccacctccctggttcaagcgattctcctgctttggcctcctgagtagctgggattacaggcacacactaccatgctcatgtaatttttgtatttttagtagagatggggtttcaccatgttggccaggctgttcttgaacttctgacctcaactgatctgccctcctcggcctcccaaaatgctgggattataggcgtgtgagccaccacacctaacctgtctccttacacttgaactgactctggggcacgctgaagttctctttcctataaaagctttcaaggtaaatattcctataaatgcttcctacaaatgctttcaaggtaaatattttgaggctgaaattctacttttcaatactgatttcttttgtctttatacccccaaggataaaacaccaaaggactgaacctgaaagtagtcctagacaagcatcaaaaagaacagactgaggctgggtgtggtggctcatgcctgtaatcccagcactttgggaggctgaagcaggcagatcacctgaggtcaggagttcgagaccaacctagccaacatggtaaaatcccatttctactaaaaatacaaaattagttgggcatggtggcgcctgtctgtaatcccagctcctccgggaggctgaggcacaagaatcacttgaacccaggaagtggaggttgcagtgagccaaatcacgccactgcactgcagcctgggaaagagagagagagagactgtctccaaaacaaaacaaaacaaaaaacaaacaaaaacaaaaaacagattgggaagataatctaaaagttttaatacaaattatcctaaaatacagatcaaactatatacacagacaagtcatataagtatgctacaatgagtgaacaccgagaaaaggctgtcttttttgttggatatcctgtacatctactaagatatcacaaacatcttgaacaattgtcaatgctatcaaaaattacagtaaatctggcatagacacattgccttaagctctatgcagatttcccttggaaagaaacacggtattaagcagcaagagctataaggatattcctatcttctgacaaaatattctaaccaatttttaaaaatctaccctaaaggagtaactcaacaaacacagccccaaaaatcttattcacaaaggtggtcactgcaatgatatctatcaataatctaaatgttgtaagcattataactatagttatcagttgtggtacaccaaatcaaaatattaaaaagaatcataaaggatatttcttctcttatggaagaagagatttcaagagaaaaaaataatagtttaatatagttgtagtgactaaaaatatacatacacagataacaacaagacaaagagtgttacagttgtaaaactattctgaaattttctttacattttaggtaatagttttatattaaaaagaaacccccataaaaccaaataccctcctgaatgctagtaaggatttactacacaggggaaacctcaaaaaggctaaacaaatatggtatgacaaagaacaagaaaaatcaaaagaatttaagattcaggttggtattaactaacagatgtataacttcaggcatgttataggtattctagatttcagaagttctggtttagatgaaaaagtttcctttcaatagaaaaatgctgtttaaaaatgctgtttgtttttatttcggcattaaattatggcagtgatttgatttatatatggtatatataatttatatggtatatttgatttatatatggtatatataatttatatggtagtgccttcacgtgttctagaaggtactacgtttaagtaacgggttgactgactctccatttgattaagtttttctggtagggattatgagatttaactgcaagaacacttgtcaagataaaatgttgccattctctaacaaagtctcatttcaaaacatttatctttcttatacaaagtctaaagaagaatatgtcaagtaaaatcaccagtaatgtcacgatccatatagctaactactactgctataacagcctgtcttgtttctcatgtctgcaggtgtatatatttaaatgctattcagctttaacatgaatgttattgattttcttatagaaacctgaatcttcctggagtaattcagcccccaaatcaaaattgaagtcaacaggcaacacattattaacatggaaatgttgtcaagaacatagaggtatacagaggtcaagagcataaacatcagaaagggactgtggctggcctgcattcccagccacaaaaaagaaagcactggatactcaggaaggatctacttcagatcttgggaaattctgtaatcaagctagtatccaacagcaggcatttggacatgtcctgcaacccatcatcaatgcaaagagcttaaaatattaatcccaatcacagtgttccatttggaaaaagaaaaacataacacacaaacacatgtaatttcacctagctccttaaatgcaggcactctcccttgagaaaaaatgaacatttcctatcctgcagtctaaaaggctgcaaatgcagaggataaacattaacaaacacttaagaaatattaaatccgcatactaatttcagcttattactactgcagtggtttacatcattagtgtttttagaaaactaaagcatgactgagatatctgctatccaataggcaactgcaaaaaggatgaaagaacttaagactctcctacctagaaaataaggattatcactgaagcttccatttgaattttatttgatgttgagatgaactcagggtttatgcatcccacagccagaaagaaagagtagaaaagctaaagtggtagacagagtgcctctgtaatcccctcctctccaaagcagggccctaggggattatcttttggagtaatcttacagttaaaggtagcaaggagggttgctgaattgctccccccacccctccccccgccccgattgaaagggccaggtgtacagcataaaattactaacatagcaatgagattcaaatttgttattcacataaagcaggcatctcattcattactccactctgggccagatcaagtaagcgtgacaaagaggccttgaatgaaaagctaaaactaaatagtttttacgggggtcgttttttctagggtctaagaaccaatgtctactagatttgtttcaccaaaaagtagagagggttaaggggtaaaaacagagagccacacacttaaaagcacacaataaaattaaactctacctgcaaatatgtatttttactttattcaattaatgccatgtcacacctgcttgcaatgtcattttttaaatgtatcacattcgtttggctagaaaagtcaacagttcagttttggttagttattccctttctgacaaacattaaaatggaaagaaaatgctaactgggtgacaggaatttaacttattcctgggttaaaatagtttttgactttgtatgattgatttcatgtctcaagcccaccccacccccatttcaatgatactgagcatagtttcgcttaaattcaccaaaatattgctggcctataaatagtatactagccatttccattagctagcaccatggccataaaattgtactaaacaagaagtggaatgttctgaaaattccattttcactaagttattgcctaggctttaatttctgcctatgtggggctatgtgcctcactttccggcttctgcaggttgaggataaaagaaaatctataaaattacattataacaattttgaactcatttttttaaagttttgattagcataatgctgttactaatccaatggttcctaagcctaagatttatgtttaccaacacttgaaaataactatctagaatttaaagaaatatagcaaatgcaaaaatgcatcttaaattcttattgttcaacttatttatccatagcccaatttattataaaagacctaacttgtcagtgttttctaacactgtgggtcaaatatttcttggccaatatctgtccctttaccttctatcccaaaacccttgtcaggccaatgaactactcactgtccctagagactgcaaaacttcaaagaaaggaagagtattcctacttacaccaatggaatgaagatgtatcttggactgtgtaaaaagaaacagcaatagcttacatttttagcatgcctttcttctgagaaagcattagctcttcacttaatagtacacttgtttttctcatcacttctgtaaagtaggatgagcaaggaaagggtaaaggagcaggatcattttacaaacagaaactaacacacaaataatgtgttacttgttaattgccatagaagcaatgtttttcgctaaacaaaaccctccttaacgtcaaatctagtattttaaaaaatatttatccaagaaggagattttaaaaaatatatacatgtgtctgctcatcggtgcaaaaaaatacaggaaagataagccaaaacgtactgaaattgctaacctacaggacgttgagtgagaaaaggatataaagaagaatgtatagcttttttagaaccacagtaatgtttcccatacaaaaataaaaattaacaatgcggggtggggaaaacagggaaggctagaattgaatactgtagtaacaaatgaacctaactgtattacaaaacaacataaccatactgaaagatttggtggaaggaaataactaacctacgtaacttcagaaaactgtattttgactgcataacagttaacatactgtacaaaaatattgtactctagttagcaaatgtgtttttcacaggggtactagatgacaactgtgagactatacgggtactaggattaaacgagtatcaataaggaagggggaaggctgctgtgttgaactggtatgaacttacggttttttatatatatatacaggttaagtagatacagaaatatagatgtgtgtgtatgcacctgtgagcatagatacatatgtttccttgctttgccttttgagacatcctagaagcagtgacacttacgaagtaacaatgagcacaactagtactcagattttagttcctaataaaaggaacctgagctgaagtaggcaaaatacaagaggaacctggaacatctagtattagaaagtatttcaaaatataagcggtacatgctaaaaggacacaggagccaatctgaaagagcgcccaatacccaaagttgagataactggagcaactgtataaacagtaataggttataatccattaaataaaataaatatccatgggaccatcctgatattcacaactgagtcaatgaatgagtaaataaatgaggggggaagacacctcttcctaacagaattccatttaatgcaggtaggaagtagaacaaccaccctttagtaaacaacacagcaataattgctgtaggaaaaagtcatcagtgaacaataaaattatgagtaaaaatataatgagcaacagaatatttacatagtgtctccctataagacagtcatttattccagccagggcaaaatggcaaaaccttgtcactacaaaaaacataaaaatgtgccaggcatggtggcacatgcctgtgatcccagctacttgggaggctgagagatgggaggatagctgagccagggaggtgaaggctggagtggtgattgcgacactgcactccagcctgggtgacaaagtgagaccctatctctaaataaataaataaataaataaataaataaataaataaatattgtcagttattacaaagggaaaaatgctaattttacagaggagaaagctgtcaggcaccaccttaaccaagggaacaaacctatcatcactattagaaagacaagtcaaaatcatgaaccccctgtggtgtagagaagggtacagtatcttctgtggcattcctgtaaaacaatgcgtaacctctaataatgagaaaacaccaatttgtggaacgctatacaaaataactgaccagaaatcttgtatccaagtaatgaaatacaaaaactgagaactctcacatattgaaggacatttagagatgcaaaaactaaaagcaatgatagattctggacaacagaaaggacattaataagaaaactaataatacagaaattcaaataaagtatgtctattactttgtataagttcaatgttaatttcaatgttaatttcgtggttctgataattaacgattattgtgacaagatgtgttaagattagagaaagctccgtacggagactctgtactactatttcaacacacacacactctctctttctttctgacacaatctcgctgttgaccaggctggaatgcagtggcacaatcttggctcattgcaacctctgcctcctgggttcaagtgattcttgtgcctcagcctcccgagtagctgggattacaggcgcacaccaccacacctggctaatttttgtatttttagtagagacggggtttcaccatgttggccaggctggtctcaaatttctgtcctcaggtgatctgcccacctctgcctcccaaagtgctgggattttaggtcaccgtgcccagcctaaaatcatattttaaaagaatgaagaaaaaatgtatctagcattaataaaacaaacttcattcatacataaatctgtacagtctacaggttcctatcagttacagtactcacttaagataaatatagaatccattctgaattggccaaaatatccaacactccatcacagaaaagtatttgcagttacctgataatgccaggctctttcaagcctatgctgcattacacattactccctacaccatgcttcagcaagtccataagactcagaaaaaagtccatccttccctaggaaactacctttactgactccctccagcactcccattttatgcttgttggaagaacaagaagcactcaagaaaagatagatacctggttctacttagtctttcagacacaaagtgcagtctggaacaatgacaattagcttttactaactttcattatctatcaaacattgttaaaagcaaattataaattttaaattaactttgtaagaaggctagaaatcaggtagtaggaggagagtgtgactcctccaatttggttcttgtttttaaaaattgttttggctactggccaggtgcagtggctcacgcctgtaatcccagcactttgggaggccgaggcaggcggatcacttgaggtcaggagttcaagactagcctggccaacatggtgaaacccccgtctccactaaaaatacaaaaactagctgggtgtggtggcacacgcctgtaatcccagctactcgggaggctgaggcagaagaatcacttgaacccaggaggtggaggttgcagtgagcccagatcacaccacagaactccagcccgagtgacagggagagacttcatctcaaaaaaaaaaaaaaaaaaaattgttttggctcttgaaaatacttaacatttccatacatacttgaaaatcaatgttcaattgttaccaaaaacaacacaacataaaccaaaaaatcttgctgggatttttcactgggtttgcattgaatcattgtgtctaacattgactcttctaacacataaatacagcatacatctccgttcacttatgtaatctttttcagaagttttatggtttcagcaataaagtcattaacgtcttttgttagatttattcctaagtattttatgtttcttgatactaccgcaaatggaactgtttctccgggttatttttcagttgtttgctctaataaataaaaatagaattgacttttatatattgaccccgtacctggagaccttggctaaatctctaattctcacaggtttagggaattccatggggtttctaagtatcatatcttcaaatacaagcagttttgccctaccttttccaatttccatgcctttaattgcttttttcttgcaatattgcattagccaagacagagtacaatgtttttgtttgtttgaggcagggtctcaccccgtcgcccaggctcaagtacagtagcatgatctcagctcagtgcaacctccaccacctgggctcaagcaattctcccacctcagcttccagagtagtgaggactacaggtgcacgcccccacaccaggctcatttttgtatttttttgtagagatggggtttcgtcaggttgctggagctggtcttgaactctgaggctcaagcgacccgcccaccttggcctcccagagtgctgggattacaggcatgagccactgtgcccagcttacaatatttttaggatatatttttttcctaattgtagaccaacaaaacaagcactttcaccaagtagtgtgatgttaggcgttaggtttttttcctaatttttaaacagcatcacagctcaggaataaggtcttcacctttgattttcacgatttttactacaatgttgtgattctcatggttattattcttgaagtttcatgatttttttattttatttttgagacggagtctcactctgttgcccaggctgcagtgcagtgccatgatctcggctcactgcaacctctgtctcctgagttcaagcgattctcctgcttcagcctcccgagtagctgggattacaggtgtctgccaccacgcttggataatttttgtatttttagtagagatagggtttcaccatgttggccagactggtctcaaacttctgacctcaggtgatccacccacctcggcctcccaaagtactgggattacaggcatgagccaccgtgctcggcctaaagtttcatacatttgtaaactgactgtttaaattcaaaaatccagtcattaagttcctcaatttttttccatctttttttttctttttcctcatgactaagaatcatattctcatgtttattcatatgtatggtaattttctattatatacagacaatgtatgcaatacattatagagactctgaatttagttagcttttcctaaagagtgttgatttttgttctagcaggcatactactactacctggttaccttcattttgtggagctagttttgtttttataaaagcatagtggagtctattttggttccctccttaatcctatggtgaatgccttcgtcctgggaaacattctttaactctttaagtgtgagcctttattggtttcaatcaaagccctcaggtttttgccaagtctagttggaattcgaactccaaattctgccttccctgcattaggcaatgatgatcttctctgctcagctctttcagccttccaattactgctttccactatgccctataaaatcttccctaaacatgtgcaggtcaggggtgagcacaaagatctgaaaggggctcaaatagattgtgggcctatgcccctccccatctcccatagctccctctttgccactattcccctccttcaatttctacctaacttggcagccctgaactccatcctctgataatatacaaacaagcccatgaagcagtgactattgaattctagaagctctggggcacatggactgagaatgctctcatctcttcctggcaatactttctgtctgaaattttgctgacattgttgagtaatttacctagtaatatgcacaggttccaagcttgcccttctttgctcattactttttcttaagcaggggaaagcaagcttctatttgaagagagagaatgagaaggtggggaagataagaggcatgtttcaatacactagagaacaactctcaaccgctttttacatgctctctttccaagggcacaccctctttgttcaaaaggagtcttaaatttcacagaagcatttatctgtacacacgacttatcggcagctaccaagctagaggcccgttaagttttctctccctcagctagccttacacctttaaaactgcctttgagtcagaagtcagaatgaagaggttaaaataaaaaaagaggcatttttctaggcattcctccttaggtcttccctttctctaacccactactctgtggtataaaaacagtacccacttccctaacccagaaaatattccttgatttgctccatgactcaaaaaaggttcacccatgaattcagtctccagttcttttgctcataggttgggtccttttagaacaacttagttcaataatatctgtactgtattcaagacccaagcagatatatactggttctgtcaataaacaatcatcctgtttggaaataaagcaaaaagactatgtatccttgcagtgtaccactgggacattacctaacaagcccacccaggaaacatctgactctccataaattatttaactttgttttacctactatctataattgattagggcccagaagtcttactggatgtttattttagaacgctgacaagttaaagttggtttgcatcttgttgaaaacaatgtccaaagttacagctttattgttctataggatattaataacttttgtatgctactgagtaatcatattcctgcattcttcctttttatctggtattaaaatactgttaacagtttggccaccatcatgattcccttgttattcagtaaatcactatatatttaggaattatgtctaggctggtgcagtggttcacacctgtaatcccagcagttttggaggccaaggccagcggattgcttgtgctgaggagtttgagaccagcctgggcaacttggtaaaaccccatctctacaaacaatacaaaaattagccagacatggtggcacatgcctgtagtcccagctacttgggaagctgaggtgggaggatcacttgaacctgagaggtagaggctgcagtgagccaaggtcgcaccactgcactccagcctgggtgacagaataagaccctgtctaaaaagatggaaagaaagagagaaaaagaagagagaggggagagagagacagagagagagagaaagaaaaagaaaagaattatatctaatgttttgaaactatattttgacaattctaaagacgctgatttttttgttaattccagctgagtttcagaaatgagaataaaaaaattaaacataacagaaaatacctctgacattattatttttaaactacaagtcttcaaatatatttttgggtaataaacaagcacagtccaggagtttgaggctgaagtgagctatgattgtgcgattacactccagcctgggtgacagagcaagagcctgtcttaaaaaaaaaaaaaaaaaaaaaaaaggaataaatacacctacctccatttggggaaaaaattaacaaaatggaaaacaggctggttacatgtgggtatgaaaacctacagttgccctctgtcccgggcaacctaatttttttttttaagcaaaactgagaaaagtcactttcctaaaatttaaaacaaaacaaaacaaaaaaacctggggaacaaacaagcaaagttaaatactgccttcttatacagaaaaactttgcctggcaattgacatacgcacagctttgcaaatatttggcattttaaaaatttaagtcaatagcttttaagaaacatatgctctgcgcccattctactaataataaacaatggaaatgtattgtccctgctccccccaccccaccccccaacccctgtcttctcttaatactttctgaacgcttttcagaaagcatggatatattcataaagggtagataattcacgaaaacagggaaggggtaatctctccttgacaaaatagtgacagtgtatacttagttgttttcattatttattttactcaatccaaaaagcattctattgcacaatgttgaaactagtatggccaacacaaagggaaagatggtcttgaccttcaagaatcttacaatttaatacacacacaggaatcttacaatttaacacacaagtaaatgaatgaagggtagggaaaggaccaagctcctaaagagtgtgtgtgtacaagtgaatctgtataaactgtctcacaatcactgtggattttttaagacaatgaggattagtaacacaatggaggactgttatgccctgtccttcagaagtgctgaggtaagagaaaacatgactacagggagattactcaaaaaagtttggaatccctaaattctatatacaaatatataagtatctacatagaacttactcccctatcacatatgcctcatgtttcatgtttcctgtacccataccaccaatgtatctatgtttcctttctcacttaacaatttttaccctgattagaccattcactaaaagtttcattaataacttaaaaaagatctgtaaacagcatgcaatgaacttatattatagacttaaatagtggcaaaacttggcattctgctctttaatttattcaaaactactttccagttaagaactatcaatcttctagtgtcttcacatttatctctagcaacagtggctggctttcaaaattaggtgagagatctttccaagatctaaacatctccaatatctgcctcagagaaaatttagtttccaccacatcatgcgttcctgctaacaatgattaaaataaataaaagaactataaggttggtttatttgcggatacaagaacagcttgcttaactcaccatttaaaaagccatcacttcacactagctttattatctgaagcataatcaaaataataaactacggttgtgggactttggaatttctaattaagttatggagacttaaatcaagaaatatgaatattcataaaacccagtaaccttttaggcaaagtaaaaaagtgaaaagaacaagtgctcttggaattcagaaagaaaattaactatggtattgagagaaaccaggaaagagaaggaatcacagtagagctaggatacagaaggaaacagaaaatgacagtttaatgctcattatagaataacagtgaatcacccacagagaccattttcagtgttcttgtgaatttaacctctagtctaaccttttaatgaaaaggctataatatattagagtggcccagaaaggtgaccttatgtctcaggtgtcagagccacacccaggtctcctgattcccaatgatactccctaaagccttacttgctctggctgtagtgttttgagaattggagctgcttttaatcctatggtcagctacacagctgcaggatgggccctagattccctattcaggaattcagatcttaaaacaccaaaagtgataaaagtagatacagttccccttcttcagccaatgcaaggatcctagttacagagaaaaaacggtgtgccaagacaacacccttaattctcacgcatttccccctttctatcttttatacttaccaatttatcagtcccatgatctgtcttcacctcagaactaagtggaagaaataagtctgttgtatgctctgggggaggtacctccccaagaactatcaacccctgcaggatagagaggagaaaaatagcataagtgagcagtataaacttcaaatttaatttaggagttaagtctcaaaaggactgttggtgtactagaggccccctcttcctcaccctatggttcagaaacaaactacagcagcagcagctttgttttcccaaagagctatttcaacaagcagcagacccaggctcccctctctgccacttgactgctctgacctacatggctcatcagccatttagcatctttattcatatctttcagatatgaaatctttaccagattatggcatttataccatattactagactccactagattaacagcagcaatgcagtttttgtagccaacaaatgcagtttatgacttactaagctgaaaatgctactattcttaatcatgtactccaccaactatacctgcacaaacaaaactgaatgaaacaaatgtggaacagtcccctacaatttatgagaaaccaagagcttcttaaaagctggcccaaaggaacctgcttttttcataagcataaatattacttcagattaagttcctgcttgacaatttcaaattcagacctttggaaattcattccaggaaacaatttacataaaaagaaattaaaaatgaacccacaagtcctccccattgtacatataatgagccaggatgggtaaaggcagaaggtatcttattattaaaaaaacaaaatactacatatgaatcccaccatgtataccagaagaggtgacaaaaataaggctatgacactatataaccgaaagactgggatgcaagtgatcagggttcccaatctctttctctggtctaaaaaatagagatctaactagattaagaagctcttaatggaaatttattatcagaatcacctggggaaccttatcaaactatactggcttaggtccaacatctactcagtacctctgggggtggggccaggtagtctacctttttatgggggaagggaggcaggacatggtgggtacatggaggtgggtgtctctctcctcccccaccccgccaaccccactatgttaccgaggctgatctcaaactcctgggctccagcaatcctcccacctcagcctctggagtagctgggatgacaggtgcctaccaccatgcccagaggtggatattctactattctttaaaagctcccctggtaagtcctaaacttgtaaagttgaaaaacactagacttgattagtttgggctcaaagaacatcctaaagtatagatttgggggactagggattgtgactattagtcttagctctctaggccatacgacagactcttatgagccactaaaccagatgatccatccctggggtccttgtaactaaaaaaccaatatgaaatacaagctgcagaaaaggggaaaacattaagaaagaaaaatggaattttatttcagtttttaaaaaagaagtatgtatctctttttctcttgaagcaaaagaagcactgcctccctattctggaatatgactacacttagcctgtatcaaaaatgaattggagggtcccggaatggcggctcacacctgtaatcccagcactttgggaagctgaggcgggtggatcacctgaggtcgtcaggagttcaagatcagcctggccaacatggtgaaaccccatctctactaaaaatacaaaaattgcccaggcgtcgtggcacatgcccatagtcccagctactcggaaggctgaagaaggagaatcgcttgaactcaggaggcagaggttgcaatgagccaagatcacaccattgcacaccagcctgggcgacagaccaaggctctatctccaacaacaacaacaacaacaacaaaaatgaattggaggctgggtgtggtagatcacacctgtaatcctagcacttggggaggttgaggttaggagtgcgagaccagcctggccgacacagtgaaacaacgtctccagtaaaaatacaaaaaatagctgggcgtggtggtgagcccctgtaatcccagctacttgggaggctgaggcaggagaatcgcttgaacctgggaggtgtaggttgcagtgagccaagactgtgccattgcactccagtctgggcaacgagagcgaaactccacctcaaaattttaaaaattaaaaaaaaaaaaaaaaaaaaaaaaaagaattggagtctcctcagaaacaagagaaaggccattaactagtaagcaagaaacattaaccctagcctttaaaatgaggtttctctggttaaagaacttctgcttcaaaatattttcttccctaaatcaaaagcataaaatataccttacaaactttatcacatccaaataaaaactatttgcaaaagacagttatcttgtacaccactgccttctcaaaacgttgtattcaacagatattccctacttaagggcccaaactgtcttcctgcttcctgtacaaagcatgccaaaaatcattttattattcaaattttcccataaccggttcctaagaacttttttaaagatcaatttccaactactttccccaaatatttgttagtgttataccaatctcatcatctcctagacaaatgtttcaatgaatgtgaagctgttgctgctgctggaggtaagggttattagtcagtagaaggttaaaaaaaactgaattaaaggttaacacatgagctgttcatctttatttatactcatttttatattttatcagtccaaattgccgttcgtccttccaaagagattttcaacaagtcccacctccttccaagaaaatgtcccgggttaatgagttcctacttgctttatccacactgccagacctcctaaagcacggtgattgtatcttactttctgtgtatttaaatctcatttccagagcattcataatcttatgccacattatttatttcacttattattgcctcagtttcttgtttgttgagacagggtcaagctctgtcacctgtgctggagtgcagtggtgtggtcacgaatcactgtaacctccccctcccgggctcaagtgatcctcccacctcaaccccataaatagctgggataacaggtgcatgccaccacatccagctaatttttgtatttttttggtagagatggggtttcaccaagttgctcaggctggtctcgaactcttggactcaagtaatgcacttgcctcaaactcccaaagtgctgggataacaggtgcaagccaccacacccagctaattgttctattttttggtagagatggactttcaccatgttgccaaggctcgtctcaaactcctagactcaagcaatccacctgcctcggcctctcaaagtgctgggattacatgtgcaagccgctgcacccagcctttaattgttaactaatgttagtttattgaagatgtggacaaaatacaaatatatttaaatgacccatgtcccttagcagagtcatacaccaagaaaataaatgcatagcaaatatttgttgagttgtataatttttttcctaacaggaaaatattaactttataataattatagccagaagataaataaatctaacaattagatataaaattactccttcaatttttctttttcagttatatgaaagtaaggacgcagtcagtattttccaaagggaagaatttttccttaaactacagaataatttctaaatacaaccctcagatagattatgaagacatctcctaagagagtataataaaacttggtagggaccatctattcatcgacataattttatagacccacagaggatgtaggtcaaagcttatgtctctacaggccaatacatggcagaactggggcaaaagtctgcatctaactaatatttcattcctcttttgttcagttaattcaatcatttatccgctcatcagcatttgttaggtactaaggatacaagaaaaaatgagagacctatccctctcccctaacccatccttcaaagtgcttattacgttctaatactgcggcaaagaaaaacaatgtaaataggtaaatgttatgtactacattagaaggtattaaatgctagagagaacaaaatataggatagtgaggggattaagaagtggaaatggtggggttggtcgtgacggctcatgcctgtaattccagcactttgggaagccaatggaggaggactgcttgaggccaggagttcaggaccagcctgggcgacgtggcaaaaccctgtctccacaaaaacaataataataaaaattagcctggtgtaatatcacacctgtagttccagatattcaggaggatcacttaagcccaggagagagagagagatacaagtgggagggggtactacaggcgcataccaccacgcctggctagttttttgtatttttagtagagaaggggtttcaccatgttgccaaggctggttgcaaactcttggggccaagagatctacccgccctggcctcccaaagtgccgggttgcaggcatgagccactgtgcccctgcttgaatgtttatttgaagacagaatcaaccagctatgccaatgtgcttacaagataggagggaaaagagtcagagacactgccaaggtttctagcttccacaaccagaagaatggaactcttcttcatttgttcagaggacatttgaatacacattagttttaattaaacctatttttgaaaatatgtgctcaagtgttacactgaagcaaccaacaatcatccatacactgtccattgcccccaagatatgtaagttcactatggcattcaaaaccaaacactggatcctctaatttaatactgtacctcacaccaaaaaggatgaaaacagctaaaaagaggctgagcaaataaaaagcatccaagtaggtaagagtcattcatgcaggtagcatctattgagtggctaccacgtgcaaggtagtgtgaaaacacagtaataaaataaaaacagattctaccataaggagcttatgttcatctagccttgaacagacaaagagacaaagtattatgacagtactataacagaagttgagagaaggtgatgtcagagcagaaaagagcctaactgaagagactgatgaaagtgaggctttacagaggaggtctacataattacttaacattccccaaaatatatttaatatattttgagctatacttattcattaactatacacttaatgactttgcccttttctgtatacaatgtttcatatgccacaataacacttatttcggataaagtttactcatgtttaataaccatgaaaagaaaggttagcattagctgagaaaacttcataatgttctactccacacctgtcatgctaccccaacatgggcttccctaacattccaggtttaaactgggtcagtgttgaatagctgtgccattagcctggtggcaataaacttagggctgctgtactatgaaatagcaaccggtagaagccgaagaaaaaggtcaagagtctccttttccttcgccatgtcccgagtcagagccaggatcatgcttaggctgcacaggcctagaaaactccaagagtgaagcaagcttctgctttacacaaggaccaaaggaactggaatgggtcacagttacatgcagccttaatacctcctaagtgactcctctgtggatgaaccctctctcaactgtatttgcaatacagctaacaggcaatttcacatacttccttacatcactctatcaggtcaatcttccctatgcatctcaagacaaaccagtgaccccactgcagaccagttccacaagaatcaccctgggctacctggaaaagataagttgtctaaagtgctttaaaaaaccctattaagatgagaacttcaacagctttatgaaaattttgaagagaaaggtgttataagcttctgcagttcccattcaactccttccctattcaaaagtttcaatgctcttccacctcccatcctcaataacatttccatcctcagctacagctgtgtaatctcaaagagtagtcagaagaggagattttaaaaaacaacgtaagagtcaagccagtgcttctgggaggccaaggcaaggaggatcacttgaggtcaagagtttgagaccagcctggacaacacagcgagaccccatcctttaaaataaaaaaaaccctttaacaattagctaagcatggtgggacttgcctatggtcccagctacttgtacttgcaaggctaaggtaggaggatagcttgagcccaggagtttcaggttacaaagaactatgatctggccattgcacctcagcctgggcaacagagcaagaccctgcctcttaaaaactgcttagtccctattctttcccctcatttaccaggtgtgaaatttcaacaaacatgtttcagtgaaatgatgaaaaggacacaacagcaaagtatgttagaaaaaaaatgctttggaatcagataaaaagtcctgagtttaaatttagctctgccttttacaagcctctgaagatttattctgatcattaaacgaacatacatgagtaaacctttaattagtatacactcaaggtacgtatattgttttcgtttctccttctaaagcatggaagagtttctttttaaaaaacaagctgacaaactatgaaaattaaaagagtacaacagcatgcagaagtagtacagaggagttcctagaagttatattctttctccagagagcaatattattcccaaaagggactctactcacttcacagcttggaaggtaatacctaccttctgacagaacagaaactggtgtctggatcctagaatcacctagcagtagtcacaaatactttttttttttttggtaatacgccacttaaataaaattaatgttaataagcaacaaagtaaatccttaaaaagaaaagccccaccatccctccaatctcccacccgaagacaaattataactcaacagcctatcaccaagattcagcctatcacctaggttcatctcaaaaaaaaaaaaaagacctgtgcaacccaggaagtgctgggaaatcttggtgcagcatggaaaatatgaacaccaacccacttaaccaaaacacataggaaaaactttcttccatttcagtaactaaaaaaaaaacccaagcacttaaagtgattactaacttgagcaatagctctgcactcacttggatgtgtaaccatgaacaaactacttgactgctctgatcttccattgtttatcttgaaaatcgtgaatgagagtaaaatgcttagcacagtgcctgacatatcacaagtgctcaaaaacttctattaattatagtgttacataaagactaaatgcatgtgaatatatcattgggggaaaattccatggcttgttagagcaagttgaatattgtctcttccaaatttatgttcacccagaacctgtgactatgaccttgtttagaaaaagggtctttgcagatgtaatcaagttatgaagagccatttagtgtgggctctaaattcaatatgactggtgtcctcctgacatggaaatctacacagatgcaaagagaaagatggtcatatgaagatggaggcagcaactgcagtgatgtagctacaggccaagaacaccaaggactagcacaatatcagaagctggaaaaagacaaggaaggattcttccctagagcctccatagagaccatggcccttttgacaccataatttcagacttctggcctccagaacggtgagagaacacatttctgattttttaagccatcccatttgtgatagtttgttatgacagtctaggaaactaatccatttgttgaaaaagaaatgtataaatacgacacgtaaagctgtgaattttcttgatgcattacttattggaactatcaacctagttttattcttcctatcggaactctgagaagtaaaagattatctatgatgttgtattttacagaccaagaatctgaagctcagaaatgttaagtgacttttcttctcaaggttcatgtaagcagctggtagcaaagccacgattagaaacaaaaatttaccaagtccaagtatggtgcttaatacaatacgctttgaatgatgaaactcttggataagcaacatacattcatgtgccaaatagcattatggtcaatgacagaccacatatacaatgatggtcttataagattttaatacagctgaagaatacctgttttagcacaaagcactactcctgtgtttgtggtgatgctggtgtaaagaaacctacagtgctgctattagaagtataccacatacaattatgtacactaagaatataatagctgataataaaagctatgttactgttacacttatttcttatgataataaaaagtgttatgtatttactatactatacttttaatcgttattttagagagtacttctactcattaaaagaagtgaactgtgaaacagcctccagcaggtccttctgttggcactgtcacaggcaatgaaagctccgtgtgtgttgttggccctgaaaacctaacagtgtaacaagatgtgaaggtggaagacagtaataccgacaaacctgaccccatgtgggcctacgttcatgtgtgtgtttgtgtcttagtttttagcaaaacagtttaaaaaataaaactttcattttaaaatggaaagttttaaagatagaaaaaagcttgtagaataaggtgtgaagaaaatatttttgtacaattacaatgtatttgtgttttaggctaagtgttattacaaaagagtcaaaaagttttaaaaacttaaaagtttataaagcaaaaagttatagtaagctaaggttaatttattattgaaaaaaatatttaaaataaatgtagtgtagcctcggtgtacagtatttataaagtttatagtagtgtacagtcatgtcccaggcttttcaatttcagttacccttcacccaccgactcacccagagcaacttccagtcctgcaagctccattcatggtaagtgccctatacaggtgtaccatttttatcttttctactacatttttactgtattttttctatgtttaggtatgtttaaatacataaatctttaccactaattgcctacagtattcagtatagtagcatgatgtactggtttataccctaggagcaataggctatataccatattgtctaagtgaatagcaggccataccacctcagcttgtatgtattaagtatgtatatatgtaagtatgtatgtatgtatgtatatgagacagagactcgctctgctttgcccaggctggagtgcagtgtcgcgatctcagctcactgcaccctgtctcccaggttcaagtgattctcctgtctcagcctcccgagtagctgggattacaggcacccgccaccacacctggctaatttttttgtatttttcatagagacaggggtttcaccatgttggccaggctagtctcgaactcctcacctcaggtgacccacccaccttggactcccatgcctcggcctcccaaagtgctgagattacaggcgtgagccactgcgcacggccctcagcttgaatttaagtgcactttatgatgttcacgcaccaatgaaatcacctaacaacacatttctcagtttcccttttgttaagcaatgtgtgatggtatatacaaaactccagattattttccagatatttagaaatacttttcagatattttgatattttgaaagtttctgaaaattgctctgtcattacttctgagtgatgagctgaagaataaagcatgaaccaaatgaggtgagtatcttcttatacacagctagtgagactataaactgacactgccaaaatacttctctgaagaatgcattaagaacataaaagagcattcatacctttgactgagataaagatatttatcatggcatatttaatttaaataacaaatgtaacttaaatagtcaacaaagaaagccaatagcatgcagccattaaaaatgttttccaaaaaccaactgggaaatattcagggcacatacgtaacatgactgtatttgaacaaattacttatgtgctaggaaaatgtaccataatgttggtagcgagataattttgagctgttgggttgttttttttttttttggggggggggggagggtgggtgtcttttatacttctatgtcatttcagtttcctgagaattgatacacagtatttcatcaattctaagaggtactctccccacatgtcaacaacttttaaatcaagatgcattttacaatttctgttatgccctggtttaactgaaataatttctttgtcgtacttaaaacaatggtacatcttacaatcaatagcatcttaagttctatgaaatgtagcagttttataacaaggaactaagatgatataacatatacacatatataaacccacatatatatttatgaatgtatataaaaagatgaagcagcacttatgactactattatactaatctcagttgttactaagagactctagttctcaaatatagaaaatcccacttaactactggctataaaaacctagaaacagacactgaagaggtgtctctgatagagaaagactgtgtttttctcctcagtacaggcatatccagtcacctcctagttattcttagtcatcattccagttcaagttctacaaatctcactttaaaatttcctttgtgaagacttgggaaagcaaaatatgcaccaaatctagaatgtttattagttttgttccagctaatttttaaataagtaaatcaggatttaatttgtatgctaccctaagggaacaaactagtaagaataaaaaagtgagccctctggactgtgtcctcaattaaagtatgctctattgaacttttagggggagggggaatatatatatatatatgtatctccaatctggaaagaagctataagtccgcagtgacatttttagaataaaagtttaaatgattagatagcccacagaactttcacttcaaaccctgatcattctgttcattttatcagttgatcaaccttcaacttttggcctactaatttaatggatactgttcacaggaaagccattttcttaaggctttgactagtactaaggtcaaaaaggcattttgacccttatttttagtagcaatagactttttctagacatgggtctacataaagatagagctcagccacaccaagctaatataaaaaatactttgcaagaatgtaagcttcatgaaggtaggatttttgagaacactgctgagacacagtaagcacttaaaataatggtacatcttaccatcagtagcatcttaagttctatgaaatgtggcagttttataacagggaactaacaaatataaatctaacaaatatgacagttaacatcaatggcttgcttgcattattcagtctgttttccttgtttcctgttagctcagatacccacacagttttgttctaaatacacgttcagttaaacattatattctaatagtgttttcctttttatgagacaggcctttcttagttgtccaggctggagtgtggtggcacaatcttggctcactgcaacctccacttcgtgggctcaagcgatactcccacttcagcctcctaagtagctgggactacaggcacatgctatcatgctcaactaatttttgtaatttttgtaaagacaaggtctcactatgttgcccaggctggtctcgaactcctgagctcaaatgatcctcctgccttggcctcccaaagtgctgggatcacaagagtgagccaccacgcgcagccacatcaggttcttaaattaaaccactatatcaggtcattaaaccatttactttgcaatagttaagaagagggttatgggggttacgaggtgggaggggatgtgagaaaagcgatattgatagttttcggcagcatttaaaaacatcagatacttatcccttaccttattagcacgtatctgtttgtaaatgtctgtttgctgacgaattcgatattccaagtcagaaacatgagcctgaagccagttccagcggctgacaatagctgcccggtctgcagcccatttccattctgacctgcgtctcctaaaaggaaataaactgagtgaaatccaagagtagcagtaatatctataccagattggggggtggggagtggaatttaacttttaaaggcccttgcagagactaactctagtgtcaagaaaaacccaagagagagacaagacacctcccgctcatcaggatgcacatggatataaacttccaaataggtatttcccaaattaagtggaactgcgttctagcatcctgatcctgtggcacacagtttctctgaaatccctttaatttctctgggacaataaaattattgtccatgccaaaataaaacatacattaagaataatctatacaggaaatccaactgacactaagaattattaaaactaataaagaattcagcaaaagtgttcagtaaagaatatttaaaaactaataaagtagaaaatatcattaagtaccattcataacaccaacaaaactaatgatatattaaatatctttacagagaaaataacgcctgaaagcatgaagatctatacaaatggtaggacacatttttttaggatggcgattctcatgaacatctataaattcaaagaaattccaatcaaattgcctacagtatttttaataaaagctgagaaacagatctaaaagttcacatggaataaaggaccaacagcaagaaatttgcaagaaggcatgatgcaaatacacattaccagacagccagatttgctgcaaaactatagagagcctcaaaacgtagaactagatacataaaagataacgggaaatttttaaaaaatcagatcagtgcagaaacgatcaaactactcaataaatagtactaaactggccagttctttaaaggaaaaagtaaaattagttcccttcttcatgatataattacaaaattttggcatttcaaattgctaaatatgaacagccaaacttaaaagaatatcttcgggacttagagcagggagcatttcttagataatacacaaagatttcacctacttttcaacatacaatagaaaatctaataaagttaaaaggccaactacattttggtggaagatatctaacacatataactgacgattaaacatcagaatatgtaacagaactctcagaaataggataaaagaaaaaaagacaatcttaacagaaataggaaattcacataaaaggcaaataataaatatataaaaatgtgtcatctcgttaaaatttggttaaaatataaatattaggtaaaacattaagatgctgtttgaaatctggatgggaaaacgcacagtctcataaagccaacaggtggtgagaaatggaaaagagcaattaatatattgctggtaacagttaaaattggaaccaccatttttgaaaaataatttgaaaatacttagcgaggtgtaaaatgtgcatacccaaccatcatgatactgtattttttttttttttttcctgagaggcagggtctcacactctatcattgaggctggattgtggtggtgcaatcacagctcactgtaacctagagttcctttgcttaagctatcctcccacctcagtctcccaagcagctaggatcaggagcatactacatacctggcttttttttctttttttttttttttttgagatggagtttctttcactctggttgcccaggctggagtgcaatggcgcaatcttggctcaccaccaaccttcgcctcccaggttcaagcgattctcctgcctcagcctcccgagcagctgggattacaggcatgcgccaccatgcccggctaattttgtatttttagtagacacggggtttctccatgttggtcaggctggtctcaaactcccaacctcaggggatccgcccacctcgacctcccaaagtgctgggattacaggcacgagccactgcacccagccctgactaacttttttttgagacggagtcttgctctgtcgcccgggctggagtccagtggcatgatctcggctcactgcaagctccgcctcccgggtttacgccattctcctgcctcagcctccggagtaactgggactacaggcgcccaccaccacgcctggctaatttttgtatttttagtagagacggggtttcactgtgttagccaggatggtctcgatctcctgacctcatgatccacccacctcagcctcccaaagtgctgggattacaggcgtgagccactgagcctagccccactggctaatttttaataaaaaatgttgtggagatggggtcttgctatggtgtccaggttgttctctaactcctgacctttagcctcccaaagacacgagccactatgcccagccatgaaattctgtttctgagaacataaactacacattcctctgcataaggaaacaggttcactggaggagagtctgtaatagataaaaactaattatattctaattctgctgaacttggtaaataaactataatttattcatttaatagttctatagtaataaaaataaacgacatctgtatgtatcaacatgattaaatctaagaacacaatgttgaatgaaacaactacaaaaaaactaaacaagattaagtacacacaagtagtgaaggaatttgatgaaatactatctagcaatttatttactgtatgtatcaacatgacctaatctcaacaatggggaatgcaaaagctgcacaaaaataaacaaataaacattaataaggattgttaccaatacagataactgatgaatatattttaaaatgcctaaaactgacatacaacaaatttacaatcaagctcctcattatctctggaaaggggatggagaagttggattttagctctacctataatgtttgacttctcatgtaaaaaaacaaagatggaaatgtgacaacattaacattgtttaaatattacactggggatacatggtgtctactatattctgtaatctaaatatttcataatctaccacaaaactattttcccagaaagcagcagcagtcacacagccctcagccccacttcccatcaggatacacacactcactgctaaaacttatgactataggtgaacttgaacacagtctcccataggggcaaaatacaaaatgtcaaaaataaaaaagaacaaatctgaccacgacagagtaagacatgaattaatacttaatcataccataataattaagaccaagggtagtaatggtattttaacttttgtatggaccaaacataaaccattcaaaccaaccactgtgataattatcaattatgtctcttcttttagaaagaaaacattttacagttccctaattttgatggaaccacttcaagataaaaagatacttttaaagtacagttatctgcttcaatgttggctgcaggtctagctctaccctaaatccaggaaatgatctcaagagatcaataagaaactagggatcattcttgaacaacaaaaatgccccctacccacaaagagacaaaactagttaaccctcgtattttattcccacctttccttacttttcaaggcttaccacctttctatcctgcaaaatcttttggatttatagattcctttcattcctaaaactaccaccacaccaggtccccatctatcaccactgggcaaccccaacagcctccttagctgctcttcccaacaccagtcaatcatactacttttcctcaatcaactcccctcacacctttttcatcctggcattctaatgtttaaggaaccatgcagctcctttgaaaatacaaaaggaaaagaaaattacttaaaacattttagttcgcaagaactttgataaatacactttttcttggatattaatgaaggtcttatgtcccctacacaggtatttacctaaataacaatacaaagcgagcctcctgataatatgttttggataatatggttaataaactaattaaagaaaggcaagacagcactaaggaatactaacaattcccaatttatgaacaagtttcattttacaagtgtatctgtgatgtgatggtttagaactcgaagtgatttccaggagaaagttgttacaacattattcttccataatgctgctcaaactctcatcatctccaatgaaaaatggaaaaccacaactcaagcgtccaagaagtatcttgtgttcaaaataccagcaatatgagcagaaagctaaactgttattaagcatgagaggtgtacagttaacaagtctggataagatatgaagatgttaccatactccagtggcagagcagagcaccactaaacagtaacacaagaataagagcttcacatcttttgttccttaacaaatacaagcggccgggcgcggtggctcacgcttgtaatcccagcactttgggaggccgaggcaggcggatcacgaggtcaggagatcgagaccatcctggctaacacggtgaaaccccgtctctactaaaaatacaaaaaaattagccgggcgtgatggcgggcgcctgtagtcccagctactcgggaggctgaggcaggagaatggcgtgaacccggaaggcggagcttgcagtgagccgagattgcgccactgcactctcgcctgggccacagagcgagactccgtctcaaaaaaaaaaaaaacaaaacaaaaaaaaaacaaatacaagctatataaactcagcttatcagaggtaaagatagacttcctcctcaatattcgaagtgtaaatttatcactctgacaatttacagctcaaaacaagggacacacattgaacattagggacatgtttaatgttataccatacagacttcaggaaagaacacaggactaaggttgcagaataatactttaaatacaatgaggacttggtttctaatatagtcattatcaataatgaagaaaatcacgtggattctaacactgatgagtcaactcattcctgatgcttgtttctgtgctattagtgaaataactgttttaactatgtgcctgagtaggacactagaatgccttagaacgtttgattttaccgtgtgctttatcctagtccatacaaaaacatgtactatatatactgtagttatcacctgagtgggaattcttttcaactcgtattttgctcattgcttttataaactttttattggtaaaaatggctttgtcaccatgtgctatacaaaaattcattaaaatgttacatgatgaattactttttggttacctaaatgcagtatcaatatttgcttttgtgacaccacatgaatagtacaccttaatgttaaccagctatgtgctagtattggtttacataagaaatatttgttgtatataaatatttcattagctatgaacttgtactttaatcgttctttttacacagttagactattaccacagagaattgagaatgctctgttgactctaagaacatagatctttcctgtgtttgtttcacactgcttttgagctaggtagtgagtacctgtgaatggttttttgttgttttcttcatgtgactcaacaattttaagacttctcattggtgaaatctatggtgaaaccccatctctactaaaaataaaaaaaattagccagacgtagtcgcgcacgcctgtaatcccagctacataggaggctgaggcaggagaattgcttgaatccaggaggtgacggaggctgccgtgggcccagaccacacgccactgcccttcagcctgtacaacagagtgagactccctctccccaaaaaaaaaaaaaaaaagcgccctctataaacacacttaaaccatacagtaaaagtaattaatttttttccttgcaaattcagggttcagcttacatgttggctaaaaattaatttttgtttttagttctttaaagttattaatagtcaatgggtttaaaagggattatcaatagatcaactcttttgtatttattagataagtagcaccaaaagctagacattgaaccacatggaacaccacatgttgactaccaggcctagtgcctctaattaagtcacctaattctattctaagatgggaaatttgtatgtcaatccagtagaacagggctggtggattatgcttctcttccctgatgtattaacataaatttttttaaatctcattaaggcaacaaacatgccagaaaaacccgaatggtggtaatttcaactttgattctgatttcagtcccatctcgattctttccttttaatgaaacaaaggttctattagccaactaaagtaaaatgactgttcacagtgagctacacagtgctacattcacactggtagataaattgacaaaggattatgtgctacttccaagtgtgcaggaaatcctgagacatctaagttctgaaatctccaggttatttagataacttttaaaaaccaaaagattcaaataaaactgagatcatcccagagcgtacaattgccagattaacagttttcagggtaagagttagggtcactgtggggcaggaatgagaaatcttgaaattgctgagtcacatgaaaaaaacaaaaacaaaaaaccactcacaagtactcactacctagctcaaaagcagtgtgaaacagagggaagatcaggagacaagttctcacttttacttactttatgtgatcctaaacatataaattgacctctgcaaataagaacaacatctgcttcacaaagttgtgatagccatacaatgatgtaatcctaactgcaacctaaaatgtatgtattagataagaataacaatttagtcagctgggcacggtggctcaggcctgtaatcccagcactttgggaggccgaggcaggcagatcacaagataaggagtctgagatcagcctgactaacatagtgaaaccccgtctctactaaaaatacaaaaaaaaattagccgggcttagtagcacgcgcctgtaatcccagctactcaggaggctgaggcaggagaatcgcttgaacccgggaggcagaggttacagtgagtcgagatcgtgccactgctctccagcctgggggacagagcaagactctgtctacaaaaaaaaaaaaaaaaaaaaaaaagaaataacaatttagtcattataaccatggatttaaattccgtatcaaaaaggtacaaaaaaggaagaaaaacagaataagattaaagaaaaacctctcagataaattcaggaaacaagtgttttcagttagcaacaagccatattctgagagtttcttgagctttgaactttagagtcatctaaaagttccactctaaacagaaaaatcaaagtagtctattagaatagacattgcattatcagtgacattaccaccaaatttaaaaagatggaggggataaagcacaaggagaaaaagaagagaaccaaactgtccagagttaaatatcccacattttagttgtaaagtaaaacccaggaaaaaactcggatacatacttcgtcttaacccattctcatctgtcacatgacctaggttgtgtcagctttctacagatatctgtagtaatgtggaacaaatgtaccagagccaatacttttttttttgagatggaatctcgctctgtcacccaggctggagtgcagaggcacgatctcagctcactgcaacctctgcctctcgggttcaagtgattttcctgcctcagcctcctgagtagctgggattacaggtgcctgtcaccatgcctggctaatttttgtgtttttagtagagatggggttttgccgtgttggccaggctggtctcgaactcctgacctcaaatgatccgtctgcctcagcctcccaaagtgctgcagttacaggtgtgagccacagcacccagccccagagccaattctacctaaactgccaattcatcctgacagacccttgaaattgaacacagcacttttgtcttactacttcaactagattacctctaatatttaaatgaaatttgtgtagttttggtagtttatttcagccaagcatttagcccaccatgaactcactctatccttcttccttccatttaacaaatatttaagcaactattagttaccaagaattagactaggttagggatgcaaaaacaagaactgtggctaaagtttacaatttaatggggcagatagatgttaataatcaaataatcatataaaatatacgataagagatcctaactatgtcagatttagactgggggatctagaaagacttgtgatataaatatttaaacagacctccaaagcataaaataggacttggatgcacaaactggtagggcttggggatgtggagcagaagacattaggtggaactgtggtgtgtcacaaagaaacgacatgtatacaatggttatgtggttagaactccaacagtgaacaacgaaaagaattcattcaacttgacaatggatacaggtaggcagggccaggtcacacagaacctggcaatccatgttaatcttataaaacaatataagcaatcctcatctttcctcatgctcttttatttatctcagaccctgtttgaatgaaaatttacaaatacaagctaaaagataataaactcccacaaaaccatcaaccaatttcaactatcaacttttggcgaatcctacctcatctataacatctatctcccatccctatgaattatttttaagccaattcccaacatcacatcatcacctctaaatatttcggtatgtttccaaaatgtaaggtcttttaagaatatataccagtatattttataatctaaaaaacaataattccttaatgttaaatatccagttactggttaaatttcctggattgtctcagttttctccaaatcagagtcaaataagatccacacaattcatttacttaatacatcacaagctcgtaacacgctcctcctcattttctttcctcacaatctgtggaagagacagcactatctgtcctttagaatttcctccattgtggattttactgactgtgcctttaacacaaagcccatacttctaaacttgataatttgacacctctaggctggccgtgctggctcatgcctgtaatctcagcactttgggaggctgaggtgggtagagcatttgagatcaggagttcaagaccagcctgaccaacatggtgaaacactgtctctactaaaaatacaaaaaaattggccaggcgtggtggcctgggcctgtagttccagctgcacgggaggctgaggcaggagaattgcttgaacccaggaggcagaggttgcagtgagccaagatcacgccactgcactctagcctgggcgacagagtgagactctgtctcaaaaataaacaaacaaacaaacaacctttagtagtttgatacatttcattttctgtaggtcagctgataaattttttttgtacattaaatttttacatgtttaagattgagatatgttttaaaatacactcaatcttttaaaaatcatttaaggtactttaaactcctttcaatacccgtcagtcagatttttcatcaaacatggtaaacatatacatattatatactctgcctagcacaataaaagaaatgtaattgtttgtcataccctatgcaaatttccaaccagaaaatacccagaagcatcttctaacactaaaacccacgtctctccaggaaagtttttccttgtgcatcgtacctcacaattcactctttgtcctcttcaagcttagttggatcctcttattttgttatttgtatgtgctattatttccaagtcatgtcatatatataactggtctccaactagattatccatgcctccttatgggaactaccatgtgttttaactgtaagacaatttttaatgatgtctgtgcacatgtagtttacaagtaaatttgcaaaaaatataaacaatatgagagagttttagctgatgccttatcctgtttaattctcaaatgtttatattttaaaaacacttaactgaagtattctaatggaggaaaaaatggcatgacaaagaagtatggaaatggcttacagttcttgactggctgtaggactgaacatggaatttgagcatgaagattttgagcaaaatactaggctacttactgtgtcttttttcttttttttttagacaaagttttgttcttatcgcctaggctggagtgcaatggtgcgatctcggctcactgcaacctccgcttcccaggttcaagcgaatctcctgcctcagcctcccaagtagctgggattacaggtgcccgtcaccacgcctcgctaattttttgtatttttagtagaaacaaggtttcacttggacaggctggtctcaaactcctgacctcaggtgatccacccacctcggcttcccaaagtgctggaattacaggcgtgagcaaccgcacatggcctactgtgtcttctttagagaataagactgttatgtttcaagaataaagcaaatgacaaatagtgaaaggctctcagttattcaaagtactgccattccagagcagctcctccagagtgaattaattttctgtctacttttcttcctttcaaaagttaaactgaggttagaatgttcaaattctgtatgtgatactaatttctctttcaaagagattgcttgaggccgagcatggtggctcaggcctgtaatcccagcactttgggaggctgaggcgggcagatgacttgaggtcaggagttcaagaccagcctgaccaacatggtgaaaccccgtctctactaaaaatacgaaaattagtagggaatgtggtgggtgcctgtaattccagctacttgggaggctgaggcagaagaattacttgaaccctagagacagacgctgcagtgagtgagatcacgccattgcactccagaccaggtgacaagagtgaaaccctgtctcaaaaaaacaaaaacaaaaaaccccaaaatgatcactcgagctcaggacttcgagaccagcctgggcaacaggtgaaaccccatgtctctacaaaaaaatacaaaaattagccgggaatggtggtgcaagcctaaggtcccagctactcagtaggctgaggagggaggatcgcttgagcctgggaggtcaaggctgcagtgagtcgagactgcgccactgtactccagcctgggcagcacagcaagaccttcacacacacacacacacacacacacacacacacacacacacacacacacacacacaccccagaagggtgaaggagcagaaaagtacagtgtattgaggcagggtccccctttcatccctactaccccagtcccacatattccacagggagaacttgcctccggctatctctagaagaatgagagaattttaatactaaatccaacagaaaaacatcttctttctcactttgaaaatacggtttattggaaaagagtatggtgtctggagtcagtgaacactgagttccaaatcctggccccaccacttagctagctattatcattgagcccccagtcagctactgagaaatcaaacaagttccaacgcacaatctccaggaataatgctccaactttagtaagtctaagaattgcctgagagagttaagtctcacgtacctttatgaagaaaaagcctcttagttattatgtaagatatctatgagaccatactttttttgttttgttttgtttttgagatggagtctcgctctttcgcccaggctggagtacagtggtgcgatctcggctcactgcaacctctgcctcacgggttcaagcaattctcctgcctcagcctcccgagtagctgggattacaggcgtccaccaccacacctggctaatttttgtatttttagtagagacggggtttcaccatgttggccaggctggtctcaaactcctgacctcaggtgatctacccacctcggtctcccaaagtgctgggaatacaggtgtgagccaatgcgcccagctgagaccatattttcagaaatagtccttaaagacactgaggtttagcaacagaacccatcttcaagaaaatgagttgaaccaaaaattaatttgttaataaacttaccagttcttaaaaataaatgtggtaaaaaggaacaaaacaaacaaaaaagtgaataaatagaagaaaccctggtacaggcaaggtggtgtagactctattctttctcccagctcatccctgttctaagcacaattataaatcctgcaaataacacaagaggcaatcaaaggaaaactctgaaagatagaaaagggaaggcaaactagttaaaggccccaggactaaaggaacaacacagtgacaaaagcatctaataaacactatccaaccgaaagaaggtaacccaagtttggcatttcctggcttccaagagagcaacaaagagcatctcagacaggctcattccctgcctccatataagggaagtatttccttcaataccagggaagcactgcagcaacagcaagggggatggatcaggaggtctgctaataataggaagccagaggaaacgttattgccccatttctctatttctttttacggcaaatactcattattctaatttgtctcttctcactgtttctttaacacagggtttcaacccactattgcaccaaagctgctggtcaaggtcaccaatgacctccactgtactaaatccaatttccacatttcagtccttaccacccttgatccatcaccagtatccaacaaaggtgattactccctccttcaaatactttctccacttctctttcaagacatactaacctggcttttctattgtctttttgaattccttgtaagactgcatatgcgaaatcactaaatcttctttcctatacttcctttctaggtgatcttacccaaactcatggctttaagtatccaactatgtttctgactcccaaattcctacctcgagctgaaatcgctcccctcaactccagattcctgtttctacctgcctactcaacacttctatttgaatgtctaaaaagtgtctcaaactttacatgatcaaaatgaagttgatactttcccctccccaactcctatatgccatcccaaacctgcttcaactagatggatctgttcaggtcaaaaacctccatgtaatccttaatttcaaccccccaccacctctatctctctcataaacacactcaattggcaaatcttattggcactgtcttcaaatatatccagtattcagccacttcttgccacttcattgttagtactttggttgaatctttctagatgagtccaagagcctctaaatgggcttctagctctcacccttgaccactttcaggatattatcatgaacatagcagccagcctaatattgtataaaaggataagttcgatcatgtcactcctctacccaaaacctagcctagttgtttaccatctctaaaaacccaagtcctgacaacgaccctgtaaggcctcaaacagagagcctctatcacccaatccctgctacctctctggcctcatctcctgttctcctcctggctcattccattccagtcactgctgtttgctgaacatgttaggcaagctgtcacccacaggaccttttatttgctattcctaaagcagatatcctcactttcttcaggtcatttccttacatgacactttattaaggctttcccttaactgtcctataaaattgcaacccctctccaaataccccctacacacctttctttcccgcttcctggctttattaatagaaccttcatgaaaattatttttaattatctatctttcttactgtctgtttcccccactagaatcatatccggaaaacagagatttttgtcttgttcaccataatatctctgggtgcttggaacaatgcctagcaaatggcaggtactcaaatatttgttcaaagggaaggaaggaagcaggaagagagagggaatgagggtaacaggctggaactatgatcctaacttttccttacaaaagattaaaaccaaagtaattccagactgaagctaaccccttttctcatctggtgccaacagacctcataaaactaactctggcctcctcataaaactaactctggcctctaatgctgaaagcgagtcaagcaattatagtccacactcttagtccaagtatacacaaaccagagaaaataaagctatattacaaagtgaaaactactaacaagatatttgagagctcttctttttttggagataggatcttgcactgtcacccgggctgaagggcagtgatgcaatcatagctcactatagcctcaatcacctgagctcaagcaaccactctcacctcagtctctgcagtagctgggacctcagatgtgcaccaccacgcccagctaattttattttttcatagaaatggagcctcacgatgttgcccaggctggtctcaaactcctaggctcaggtgattctcctgcctcagccttccaaaatgttgggattacaggtgtgagccactgcacccagtctaatcccaaccatacacaacttgaatggaaacttgctgagggtactatagatgttccagagtaaaaacgtttccgcttttacacatggtaaaatacaaaattctcacatctcaatttctatgcttttgcaaaccacttactaacagaatcgtgaattatatgatacgtgtaagatagttaagttttattggcagatttcgattctgccacatcaaattgaaaaatattctgtcatgttcatcattatatattatataaatttgcctccctcaaaaaccacacccccaccaaaaaaaaacccttaagaaataatttttaatgacatagacctcaaaggtcgagctagttttcagttaaagaatgactgagggcacaaaggtggacatttttaccatcctaaaaattggaagatatcactcccagggtggctgtgtgatttcaatgacataacatttttaaagtctagcattccattataagtgctcagtaaatgggaagttgctgctgctcttacaagcttctgactaccatacctggttgaactaactcagttaccacaaggtactctatgcccttacatctaatgacaaatatttgttttgaaaaacgtatactccttaaacacacttgagaaacaggaaccagagacccaagtacattttgttctgaatcaaattccagcatgcacagcaaagtgcatgtagaggggtgagagggtgactagggagactgcttcaatgggagattattctgcagtagtgccttaactgtagaacagtgatgatgataaactcatcctaaatttaggactactgacaggaacaagtgaccacagtaactgttcatcttaagtcgtaaaaagctttctggcaatactcatcttcaaaaaaacctagcatgtaggaaaaatcttttatgtgtttgaataagggtaatatagttaaagctaaaggcttagatttttaactggtctaatgagagaaagcacagtagtcatataataagaaggtttatgttttacttcattttactagtgtttcctcatgagaattaagtaacagaaattataggaatcacaaatgaagtgcttactccatgcaaaacactggtctggcacattacagatattaattcacgaaatcctcattaaaaccctgtcaagtgggtattatgatcatcactgccccatttttataataaggaaactaagacaataaggctaagtaacttgtctaaggtcacaccactaacaagcagagccaagacttgacataggtgctctgggccagagtttttgttaacagttggaatatacaaatttacaagtattactgccaaatcaattttctcaaaaataagtcaaagtggaggaaggggggagatgaccctctgaattcactaaggttctgtgaaaagatgctgaaacaaataaaaagagtatttgattgtcaaatatatgctatttagaaatactaatggaaaagaatactgtgggcaagaaaagaatcacaagtatttgtgctgagttctgaaaggagagaaataaggttggggtgggaggtggggaaagcaggtcaagcatggaatagagcatgaataaaaatgcacagtcagaaaagtaaaaagctatgtcctagatacaaagcagtagtaataggtagaaatagtattacaaaaacagcagtgtcactaggtatcaggcactcaatgcataactaaagagaacataaaaataattaaaactatagtgaaacaaataacaagaacatgtcatattcctggttgtgataactacctatcataattgtagtttttttcccttaaattattaagttggagcagttattttacgtctgatgcatttcttaagcggttttaaagaagggcatagaatatgtgatgataaatttgacacaataatttgagttcatgtgaatgagtgttcaaacattgccaagaaaacactgaaagataatttttaaagatggagtttcgctctgtcgtccaggctggagtgcgatggcgtgatctcggcttactgcaacctccgcctcccgggcaagccattctcctgcctcagcctcgcaggtagctaggactacaggcatgtgctgccaagcccagctaattttttgtatttttagtagagatagggtttcaccatgttggccaggctggtctcaaactcctgacctcagatgatccccctgcctccacctcccaaagtgctgggattacaggcatgatccaccgtgcccaaccgaaagagaatattaaggaagactctgcccaaccaattattaaaattgccattatacaacaagtataatcaatagatacggatggtatttgaactagactagacaaagagatcagcagaccacaaaatacaacatatacatccaagtatacatggcaacgtaatatgcaaagatgacatctcaattctcagaggaaagaacattgtatttaattgttgatattgatataaccaactacacatttgggaagaaaggagagggaattcctatcttacactacacacaaaaataaatctaaagtgtgttaaagactttagcataatcactgcattgggaggcattcttaaagaacagaagaaaagcagaaaccagaaaagtttattttttggaaaattaattaaaaattctcatgctctctgatccacttttcaagattcgatcccacagaaacgagagcaccaatacaataatgtttactatcaaggtaactgaaagcaactgtatttcccaaaggagaatggctgagtatattattgtacacctctatagggagtgttatataatcattaagaatgaagacaggcacggtggctcacacctataatcccagggctttgggagcccaaggtgggtggattgcctgaggtcaggagttcaagaccagcctgaccaacatggtgaaaccccatctctactaaaaaataaaaaaattagccaggcatggtggggtgcacctgtagtcctagctactcaggaggctgaggtaagaaaatcgcttgaacccaggaggtgaaggttgcagtgagccaagatcaagtcattgcactccagcctgggtgaaaagagtgaaactctgtctcaaaaaaaaaaaaaaaaaaaaaaaaaagaatccagaccgggagtggtggctcacgcttgtaatctcagccctttgggaggctgaggcgagcggatcacctgaggtcaggaattcgagaccggcgtggccaacatggtgaaaccccatctctactaaaaatacaaaaattagccggacatggtggtgtgtgcctgtagtatcagctactcaggaggctgaggtgggagaatcgcttgaacctgggaggcagaggttgtagtgagccaagatcacactactgcattccatcctgggtgagagtgagacattgtctccaaaaaacaaaacaaaacaaaacaaaaaactgggcagataaattttttttttttttgagatggagtgtcactcttgttgcccaggctggagtgcaatggcacaatcttggctcactacaacctccgcctcccaagttcaagtgattctcctgccttagcctctcgagtaggtgggattacaggcatgcgccatcacgccgggctaattttgtatttttggtagagacagggtttctccatgttggtcagggtggtcttgaactcccgacctcaggtgacccgcccaccttggcctcccaaagtgttgggattacaggcgtgagccaccaggcccggccgggacagataattttagacatcaatttaagtgggaagaagactacaaagaatacaaagaaactagcaatgcctgaagacattttttgttgtcacaactgggggtggggggatggtacttggtagaggccagagatgccgctaaccatactacaacacaggacagtttcctacaagaaaatgtcagtagagctgacactaagaaaccttgctgtatatgaaccactgataagaataaaatcttagctttccaaggtcaatcttgccttttagccccatcatggccccacgtgtttgcaggttctttggctaagccaccaaatagctgttatggtctgttaacaatcaaatgaatggcaagggagaagtttaagccatgacccagcatttaaaaaataatggaaaagaatacaacagaaaactaagagtatgcagcatgcagagtatgtggggaaagtaatttttgttaaagttaggcatatgcaagcctttgtgtctctcaaatttacctgtaggtataagtggggcaaactgtttatcgcacggtagatcatgctcaaagaaagtcattcaagatactcctcagttctctcatccaaaaaactcatgagttggactaaaaaaaaaaacaaaaaaacctacgaggcactttctttataaaatgttaatgaatttatgatcatctgcatgaagtctaccctgtatgtacagatgtaacctacatgggagggggtacagtccttataggtagacacctgaaaggctcaattcatttcagatgtttcaagaaaattccttagtcaataacattcacatagactttgtaagatcttgattaagccatgaggccaaatctaaatctaaatcacccactcagaaagtgccaaaaaccttaaaaccaaaagaaacattagagattatctatctctaagcatctcaatttttaaatgagtaaaatgagcccaaaatggggcccaaaggattaaatgatttgcccagagtcataagccaagtcagactgtcaaaccgttaaagcaaactgataagaaaaagatgctcagggccaggcatgttggctcacgcctgtaatcccagcacaatgggaggccgagtagggcagatcacaaggtcacgagttctagaccagcgtggccaatacggtgaaaccccgtctctactaaaaatacaaaaattagctgggcatggtggcaggcgcctgttgtcccagctactcgggaggctgaggcaggagaatcgcttgaacccaggaggcggaggttgcagtgagccaagatcgcgccattgcactccagcctgggcaacagcgagactccctctcaaacaaaaacaaaaaaactaaaacatctaactgaatcaggctgcttaagtatcaaaataatcttaaatatctgaagaggaagaaggataaagattccctaacatgcagaactaaaactagaaaaactttattctaatgttcttagactactatcaaattctccctaggacttctacattgctgataacagcttacaatatttttcccagtttagttaagaccacatgtcagtattttattacaatctttcaagcaagaaagaaggtctctgatatactaatttaaagacatatacactcttgatagagctatattaggaaatggcaatggctaattcgtaaactagatttttaaaaaatgacaatatcttgtttaaagttattagactatgacagtcatctgagtggggaggtaactagttccccagcagaagccttaatcccattaaggtttatcagacaagtgtataacagaaatgttcatttcttctcagaaggaggttatgaattatatcacacggattctgtttagatgaggtttagaacaatttttctttttaacagtttctccttttgatttagacactctctaaagatctgtccagatttaggtccatttcactgaaattttgtactaaagtccacgaatttttttcattttttctttggcaaacaggtatttttgtaaacccaagttttatttatttatttattttgagatggagtttcgctcttgtcatgcaggcaggagtgcaatgcacaatcttggctcactgcaacctccacctcctgagttcaagcgattctcctgcctcagcctcccgtgtagctgggattacacgcgcctgccaccacacccagctaatttttttatttttagtagagatgggattttgccatgttggccaggctggtctcacactgctgacctcaggtgatccacccatctcagcctcccatagtactgggactacagacgtgagccaccgtgtccagcctgtaaagcaagaatttttaaagagcaaaaagaaagtgcagattttctgtctccttactacagatgagaaaatagtataaagctatcgagagtgtcaacagttctatattacccccgtccccacccccactgtactgctcctgaaagctaaacagaaatcccaaggaaagtatacattcaaggaacgaagataactttagatatgtattacatgatgcatatacgggttttcagtgaactatatgtgatttcaaactaaattaaaaacaaggctttactatgacattatgaatgaaaaacagtttatttataggatactttgactctactcaaaaagtatgcttaaacaatccaacaactttaggaaagccaaccgataaatctttgcaatcaggcagaaatactaaggcatttaaaaaacatacccagaccgcttttaacatttaccccagagatctctaggctcatcacagagggtaaccacaaaatgcttaagctgcatacagacatcaggcaaatgccacataactgctggacagtaagttatcaccacagtagttaccaatgtgacaaagcagaggataaggagcattcagagttggaaactacggtggaaacgtttccatttatggcacattttctgattggttttataactcatgttactaactatagaatcatagacgagaagaatccccggaaccaagcctcttataaataagtcaactgacctgaaaaacttacgacagagtgaaaactagacccaacttcaaactgagataggattttatacttcacaaaaattaaagttagttatttagattttattagaaatagctcagcacgtaaagtcctcaaaggaaacagacatacagtcaaaaaaaaccattactgcggggcgcagtggctcacgcctgtaatcccagcactttgggaggccaaggcaggcggatcacgaggtcagaggatcaagaccatcctggctaacacggtgaaaccccgtctctactaaaaacacaaaaaattagccgggcgtggtggtgcgtgcctgtactcccatctactaggcatgctgaggcaggagaatggtgtgaactcgggacacggagcttgcagtgagccgagatggcaccaatgcactccagcctgggcaacagagcgcgactccgtctcaaaaaacaaaaaccaacaacaacaaaacattattaaactataataatgttttctatcaagacacaaaatattaaaagtagatcaggaaggaataataagtcaattcattatcaaccttgtgactcttctgtccagcctcttccagaggttccctttacttttaagtgcaatgcaatctttaaccttaactctaaaaactcatttagagtcctccaatttcttatcagttttccaatacagctcaagaacttttccatcagtgaataaaagttgcattacttttccctttcacagcttgttggcagggaattattttaaatgtacaacaaaaatctataaatctgtagcttccaaaagagtgtttgaaaatatattttaaatggcaaaataatctcagtaatcaacagtaatactgaagtaatgtttgaaaattacatttttagaaagtataaagttacatttattacaagtgaagaaaaaaatttttatgagggaatgtttttaaaaagggttacaaattctttgacacttctcccaatgagaggcagatttctgtcaattccccctcaaatctgagggagcttgtgaccactttggtcaacagaatatggtggatgtggtactagatgactttccaggacaggttataaatgggtatgcagcttcaactgagcacagagacttcatgttaagagatattataaccctgagaattccatgctgaacagccatgtgcacacagtacttgacgaagcaacccagccaagcaaagctttctagccattccttaaaagctgccagacttatgggtgaagaaactatctcacaaatttgtgtatggactctccttccagtaacgtaaattccaagagagtaggaattcgtctttgttttattcactgatgtatccacaccattttaatagtttccttttatgtatgcagtaagcattcaataaaggtctgttaaatagatattagtgatggtggcagtggcaggtggagaaggggatatcctattcatgaatagttcacagcagtaaccatgtgcatgcctcgcaaagcagccaaagattttcagagagtctatctaattccaatgaaaagcccaggcttttaaaacggtattttacaaagactgatggatctgactaaagaaatttaaaacttctatcattcaaaaaccataaaaattaaaacataaataaataaaaagctagggaaaacaatttgcattttaattatgcttttaaaatgcaaaaaaaccctttcaaataactcaaaaagacacaaagatttacagatttctttatataaaaaagtgacaaataaatacaaaagaaatacactactaaatcaaccaaataaaataatccaagaatgtcttttttgtttattaaattggaaattctttaaaaactactatctgttaggcttcagaacactgctgacaaaacagcagtttcattctggagaacataacatttctcaaaagccttaaaactgtcattatcccatgaccactccccactacccccaccccagaaaaagtccacatctagaaatttaacctaaggtaataatctgtgatatgaagcaagctttacacacaatgtttttaaactcttagataaaagagcactaactgagggtcatgttcccgacgttagttttatttgcttgtagttgggttttctttggccttcacaagtgtgtcaaaaaaaattcagtaagttgccagcattttaaaatctattgcacacaaacacaagatctgccagcactgggtctgcaagcctcttaatgactattagctaaacagtagccaatcccttcagatgtggcacatgatacacagttcaaaatcatccctaatctgaaagcttggttcatttacattagatgctttatcttctaaagttatctcagttggaagccctacactagagatcaaactttaagcatgcagggcttgctaaacgctgattggtgggccccacccccagagtttccgactcaggacatctgaaatggggtcccagaatttacatttctagcagatttctaggtgatggtccaaagactacactttgatggtctagagaccacattttgatgaactttccttgctgaagccagagagaggcctagcatcctttgaattacacaattacaggatacttaaacaatattggagattccattaatgggggagggaggcaaggaagagtagaaaagccgacggataaacaaccaatagtcagtgcactgcttccctctatcagaggtggaaaaccattgccctacactaaatttaagaataatcctagattaagttgctagtccaaattttctattctacattctttctcatgggccttatccatttctcaaggtttaatgacctcttctacacttcatggataaaataacaggggtaaacaaaaattgtggtaaaagatcccacgtagctccaatattttatgactaacaaatgtgtatcaccagccttaatattttctactgaatttgctttctccagctggatcctatacatagcagcttttgctgaatgcttcctttgttccgggcattgtgctacaacattacatgacttttcatcatttcatcataataacaactctatgaaacggtgcctactatccccatactacagatggagaaaaagaggtcatttgtcaaggggttaggtcatttgtcagagaagcaagcacaggtaaaatctacatctgtatacgggtaatctggctccagagtcctcaattttctttttctttttttttttttgagatggggagtctcgctcagttgcccaggcgcaatcttggttcactgcaacctccgcttcccaggttcaactgatctcgtacctcagcctcccgggtagctggaattacaggtgcacgccaccacgtccagctaatttttgtatttttagtaaagacgaggtttcaccatgttggccaggctgctctcaaactcctgacctcaagagagctgcccacctcggcctcccaaagcgctggggatacaggcgtgagccaccacacccggcccagagtcctgaattttaaccactacacttcatctaaaattcaacttgtacaaattccaatctttcatctaaaactagctcttcctctaaacttgcctactgtcaatgttttcaccttcctgctcaggctgccaggctccaaatcactaagttcctaccataattaagtccttctacatttcacatctgtctttttctttttatttcaattgacctaaatgtccttattcacccttcacctggcctctaaaatgcctagtatttctgcttctagtcttacacccaacggtgctcctcactcattgcctatgggtcaaaggccagcttatttaacatcaaattcaatttaagaccttacctacctcttggatccatttctgtggttccacaaacagattaaaaattatacttaaaacacaccaacacacatgcagagctttatttctgaagaagaagagagaggggtggaaaggaaaaaacttaagaaacaatgttcaatctgaaagtatcacttctaagtggaaggctacaagggataattaatagctaccaaaactgaacactgaaacatcacatccctctttcatggagccatgtaagttaaaaaagaatcttaaactgttgaggtatatcaacatagacaaaatctgaatgccaaagtgagtttcactctaggatcaggttatctggcagctcctgaaacaggacagtttcaggaaccctgtacaaacctcagtgaaatgaaataacttcaagctgtttgttacaggggactcttgtgtcttttagtctaagtaaaagcagcaattttctacaatatatttatataagctgtgcatttccatgaaagaaaggaggtctactgtggatatatgcttggtatgaaattatgtcagaaacaagtgggagcgaggggcaagtcaacatgctgtcactaaataaaagacagacccccagaaatgacctcaacaatcaaagaaaacatgatagtgtaagttaacatgattaattttttaaattaatagactatattttaaagtaatttgaggtttaatgaactgagtagacagcagagtacccatataccctcccttccatttcctttgcacatttattatacttaatgagccaatacttgcatattcttattaaccaaagtccatttacatcaaggttcgctttgttttgaattttgacaaatgtaaaacatgtacttaccacgaaattttacaatatgcaataccaaaaaatacagctagattcaaagagagaatgtttcagcatctcattatctttatcacagtaacataaactgaactccgatcttctcccctgctcccacctagttttcccagtcttcccatctcagtaaagagcaataccttccatccacttgctcagaccaaaaattccttcctcttttataacccatacatccagcccatcagcaaatcctacctgctctaacttcaaaatatatccagaattgaaccttaattctcacactttaccaccaccactggaacccaagacaccattctctcactaggttattatagtagccccctaactcttttttttttttttgcttctgtccacaaactaatcagatcatgtcactcctctactcaaagcaggaactggcattctaccttagagcaagagctacaatcctcacaacaggcctactaggttccacacaacctgtctccacctacctcagttcccttttctgtctatgacttcacctcctgtgtcctcttcaccacttgctgttgaagctacactggtttgcttgccggattacttcaggcagtctctgtccttaaagttttggcactggctgttctttttgtccaaaatatcttccacaaatgctcacacagctgacttcacatcctgacacaaatatcactttcatagttaggcctttttccctgatgaccctatttatcactgcattgttttcccctgtactccttatccctcttacctgctttatttttttctgcatagcatttgctgcaaccaaatatatattctactttgttattttattgacccccccaccccactagaaaataaatgcagcaactgaggtttctggccttaaaaagcacttagtaattatttgttgaatgaataaactatggtgtacagattctcctcaacttacaatgggggttttgtcccaataaacccatcataatttgaaaatatcataagatgaaaatgcatttaacgcacctaacctactgaacatcaaagcttagctgggcctaccttaacgtgctcagaacacatacattatcctacagctgggcaaaatcatctaacacaaagcctattttataacaaagcatgaataactcatttactgaagactgtactgaaagtgaaaacaacggctgtgggtactcaaagtacagtttccagttttcacacgataataaagttgaaaaaccataatttgaactatagtaagttggggaccatctgtcaaggttcctaaaggtgacatacaggtgctagcaactacagtctaaaaaaataaagccccaattctcaacaaatcagtaactgattctggaaacacagaagttcctttgactctcttaaaggcttcaagcccctctatcagaaaaaaatgtctacagtttgaggagactagcctgctgccttcgggatgtccccatctgttttctagccactaacacagccacaaagcataccacacttaggaacagatctatgggtaggacacaagcatatttaggctgctatcataaagataaagatgcattcagccataaatacttaaacaagtattcatactggaaatatgaaacacttttaatcatattcctaacaaaagtaccacgagattaactggctgagaaataatgggggtgatctcctatcgactacaaaagtgggttagaaactgaagtaatctaacctcatcaagcaagtaaagcttcactttactgcactttgcagatgctgttttaaaaaaaaacaaattcaatgtttatggcaaccctgcatcaaacaagtctattagcgtcattcttccaacagcgtgcactcacttcatgtccatgtgacacatttgggtaattctcacaatatttcaaatgttttcattatctgttatgatgatctgtgatcagtgatctctgacactgccattgtaatttctggaggtaccacgaaccgcgcccataaaagatggaaaacttaactgataaaaatgtgtgttctcactactccactgaatggccattcccctgtctctctccctctcctcttgtttccctattccctgaaacacaacaatattgaaattaggccaattagtaactcctcaatggcctttaagtgttcaagtggaagagtctacagctctcgctttaaatcaaaagctagaaatagacacttgcggatgttttctggtaaaatagctgaaagaaaagaattttttttagagacggggcgcagtggctcatgcctgtaatcccaacactttgggaggcggcggcaggcggatcacctgaggtcaagagtttgagaccagcctggccaacatggcgaaaccccctctctactaaaaatacaaaaattatgtgggtgtggcattgcgcacttgtagtcccagctactcaggaggctgaggcaggagaatcacttgagcccgggaggcagaggttgcagtgagccaagatcgtgccaccacactccagcctgggcggcagagcgagactccatctcaaaaaagaaaaagaatatatattttttaaaagctagaagtgattaagcttctgagaaaggtatgttgaaagccaacataggctgaaagtaaggcctcttgtaccagttagcaaacttgtaaatgcaaaagttcttggagaaaatttaaaaagtgctactccagtgaacacacaaatcgtaagcaagagaagcagctttattgctgatatggacaaagttttagtggtctgtatagatcaaaccagccacaacattccattaaactgaaagcctaatccagaacaagaccctaatcctcttcaattccatgaagactgagagaggtgaggaagctgcagaagcaaagtctgaagatgacggaggctgctttacgaagtttaaggaaataagccatctccaataacctaaaagtgcaaggtgaagcaacaagtgctgatggagaagctgtggcaagttatccagaagatctagctaagatcatcgatgaagatggctccattaaacaacatgtcagcaatgtagaaaaaacagcattctattggaagacacaatccaaaacttttgtggctagagagtagaaaggagaaatcctgtcttcaaagagaggagaatgcttgacttcaaagcttcaaaggacagcctctcttgttaggagctaatgcagctggtgattttaaggtgaaggccaatgctccttgaccattctgaaaatctaaggcccttaagaattacactacatcagccaggtgcagtggctcatgcctgtaatcccagcactctgggaggccaaggagggagaactgcttgagcccagtagttggagaccagcctgggcaacacggcaagaccccgtctctataaaataaaataaaaacaaattatgctacatttactctgcctatgctctataaatgaaacaacaaagccaggatgtcagaacatctgttgacagcatgttttactgaatattttaagtccaccattgagacctcatgctcagaaagattcctttcaaaatactgctgctcactgacaatgcaccattgccggagaggtctgaaagagatgtacaaggatataaatcctgttatcatgcctgttaacacaacatccattgtgcagcccacagatcaagcaataatttccacttctaagccttataatttaaaaaatacattctgtaaggctatagctgccatagatagtgattcttctgatgaatctgggcaaagtaaattgaaaattattctggaaaggattcaccattctattgagtcactcatgattcatgggaggagttcaaaatatcaaccccaacaggagtttggaagaagttgactccgactctcatggataatcgagaggttcaagacattgctcgaaaaagtaactgcagatgtgaaaaacacagcaagataaccagaattagaaatagagcctgaagatgtgactgaactgcaatctcgtgataaaactgaaacagatgcaaagttaagttgactctgactctcatggataactgagaggttcaagacacaggtcgaaaaagtaactgcagatgaggaagaaacagcaagataactagaattagaaatcgagaattagaaggaaagaaagggaaggaaagaaagggaagggaagggaagggaggggaggtagggagggagggaggagggagggaggagggagggaggagggagggagggagagagggagggagggagagagggagggagggagggagggaaagaaattgccacagcttccctaaccttcagcagccactaccctggctagtcagcagccatcaacatggagataggaccttccaccagcaaaaaagattatgactcacttcatgaaggctcaggtgatcgctggtatttcttttagcaataaatattttaaaattaaggtagtccactatttattatgacataagcctaccgcatacttaacagactacagtatagtgtaaatgtaacttttatatgcaataggaaacagaaaaagcccatgtctctcactttagtgtgatattcactttattgcagtactgtggtcatctggaaatgaacctgtgatatctctgaggtatggctgtattttcatacaaataaaggcactccccctaaatctagagtctagatcccaaatacatctgtccatatagggggtaccactcccaagaccaaaggggtgtatggctcctatctccagccgtaccaaatcatatatacagtgtaatatctggttactctttattcaggacagctacattcaaaggaaacataaaatgggcagaataaggactccttgctcattaacaaaacaaagccaactcttatgtcagagtacccttttgatcaattagtgtgattatgttcactagtaacagattctaccatcattgttgtccatttcatttccattctcaagctttaaaaccccaaaaggacagaaagagatactacaggctagtattagtaatactaaaaatagttacctcttattgaaacctgaagggcctggtacttgacatatatcattttctaatctttatatgaactcaataaagcaaatattgttatttcaacactattacatattagagactgagcaatctggacaaagtcacacagcttatcagtaccagtaggaattcaaactcaggtctgactcaacagtctgcattcttaaatatacctcaataaagctgttgaaaaagtaaaagtcggccgggcacagtgtaatcccagcacacctcaataaagctgctgaaaaagtaaaagtcggccgggcacagtgtaatcccagcactttgggaggccgagtcaggcggatcacctgaggtcaggagttcgagaccagcctggccaacgtggtgaaatctggtctctactaaaaatacaaaaattagctgggcgtggtgatgggcgcctgtaatcccagctactcgggaagctgagacaggagaatcactcgaacccaggaggcggaggttgcagtgagtcgagatcgcgccattgcactccagcctgggtgacaagagtaactacgtctcaaaaaaaaagtaaaagtctccatctttccactagaccacactgcttttctcaatctttatgacaaacatgtaaggcatattgggttctggataatatgtcaaggagatatactattttggaatattttggcaaataaaggggggctttaaaacatgaaatttttttttcttaataagaactgtaatctatttccccaacttcattattaagtgagttttaggcctaggtcttccagaacagtttcctccaaaacatacagtgtaatatctggttactctttatgtgtgcataagaaatgtcactgtgacaaatgttataaagaaaaaatttgattaccctaaaaacaaatacataaacagcccgcaagtttagctcctaaagtaggaaagaataatgtgaaaatgtttctggctgtaccactcaacaaaaatttgcccgccaataaggaatcctttcttcaaaaattggtcatgatcattagccaaactgtaaccagtaacatccagctggattatggagctaataaagaacaacagaggggatccacaggaaattcaacaggtaacttacaactggctctctcatcagactggcagactgggtctaatccgaggtcagatgacatgggggattatggaagccaataacaatcatatttaaataaatgtcctttacagaacaccaccactttcctcataaaaagttcaaaggactattttcacccctcacaattacagtaaggataagaagcccaagcacagcttgaagcagcaaaattttctgaaaaggaattgaattctgtgttctcttcaggatcttcctttcccaataatgggggtattaaatttcacttataaatcaaactgaaagggaaaaaaagaacaataaaaaatgagctggaaaacctacattcatcatcttcaaaacaacatcaagttagaaacagttttaaagcaatgttacaactcctttagaatctggcaggttttctggtttttaccagatcccgctccggcaacaacaaaaaaagaaacagttttaaacagttttatgggcgtggtggctcacacctgcaatcccaacactttgggaggccaaggcggacagattgcttttcagcacaagagtctgagaccagcctgggcaacatggtaaaattttgcctctataaaaaaataccaaaaaataccaggcatggtggtggcacactcctgtagtcccagctacttgggaggctgaggtgggaggactgcttgagcccaggacagcaagggtgcagtgagccgagattgcaccaatgcactccagcctgggcaacagagccagaccctgtctcaaaaaaaaaaaaagttaaatgctgatgactgaatagaacacaattctctgtaaattcttcaatgtgataaagcatttcctacaccagttaccagtggcagcacctaataagacttgagagcaacttaatacttcaccctcatgtatgtatgaatttaaaatagaacatcacaataactacgaagatacccaaacaccccttccctaatttttttttttggtacaaacaaagtctcgctatattgcccaggtggatctcaaactcctgggctcaagtgatgctcctgcctgggctttccaaagtgctggggttacaagcgtgaaccactgtgcctggtcgcttccctaattcttaacatgtcccacaaaagattctgcttgatcttggcccccactatatcatcactatctctagtaaatagactcaaagcctctgctttctctgtggctctagccacactggcagagaccaaaggagagttcaatgataggccctctcacagaaccttgtgccttaccatacttgtcagttacaattttattcactcgattcaagcattttttggatgcctcatatgtttcaaggtacctttgttacagcagtgaacaaggcaaagcccctaacaggaggaaattcacattccagaggtaagaagagaattaaaaagccaaaaaaaagtgtgtgtatgcatatatatgtgcataagaaatgtcactgtgacaagtgttataaagaaaaaaaacacagtaagaggacagagagtgaagttgtccttgtacagttgacagtcaataacacctcttttaacagtagtagagacctgaacagggtgaagaacagagccaagctgacaggagatctggattaaagctttccaggcagaaggaatcgaaaataggcgggaatatacttagcttgttgagcaaggcaaacagcatggctggagcacagagagccaaaagagaggtgataaagacaacaccaatgaggtaaataaaagcagacagaacttggatcctctagagcctgcagctcacgatatggagtttgaattttagtctacgtgtgacaggaagcctttgaagaactttgaggagggacacggatgtgttatcgacacactataaatgaccagtaacttcagaagcaaggaggccaactgggaggctgcgaaggttgtccaggcaaaggatgataatagcttagactagggtgatggtagcagtcaaatgaggaatgttatttattttcagaatgtaatctgaaggtggagccaagatttgccaatggaatagaatgtagagatgaaaagaaaaaaaaatctattcatctctgcatcccctcagagaatgtacctgaccaccatgaaagcaagggccatgtttgtcctattcaggtccttgaacaaaggaacagtgcagtatgttctagttgaattaataaatgacctgcttctttccctacagaatcacaatattggcatttattttggctggcaaatactggtacgatgtcaagcatagaaattaagcaccttaggagaagaaaagggagttaaataaaaaagagatccatgtttcactgaacttgcaaattcaactcaaagcaccacctgtctgaaaatggaacgtatatatataaaaaaactgctcattaaggaaaataaatcacagtatctcagcaacagtgctttgtcgtgagttacaagattggctacaccatctgacaggattacttaaattgacaaagacctgcctcaccaaacacagctagaggtccttgggtccttgtggtactggtatcaggaatctgataaatcagtcagagtgtggagtgtttttaaaacacagacaaaatatatttagcaagcaaagtctgttaaagggaagattggagatcactttaaaaataattcaaagcctactctaagtatttgcaaaattgtaagattatatttctgtgcttttgaataagattcagattggacagtctcaactctcccttgtgggagagggtaggggtgggggtggacctgttttctactaagaaatttataggactctccaaaaacagaacttagggcagtactccttaatagtgaccatacattagaatcatctagggagggctgggcacagtggctcacacctgtaattctagcactttgggaggccgacacaggcagatcatttgagcccaggacatcaagaccagcccgggcaacatggtgaaatcccatctctactaaaaatacaaaaattagccaggtatggtggcatgtgcctgtagtcccagatgctcaggaggctgagacgggagaatcacttgtgcccagaaaggtagagggtgcagtgagctgagatggtgccactgaactcatgcctgggcaaaagaatgagatcctgtctccaaaaaaaaaaaaaaaaaaaaggaatcaactagggaggcttttaaaacatgaatgctggagacccacaccagataaattaaatcaaaatttaatcgggggtgggtcctgggattttccctttaagtgtttcccacgtgatctgaatgtgcagcccaagttgagaatcaccaatttacagcaataaagtttaaagtagaggatttaaataaaagtcttttaaagaaacaacactttcagaagtcaacaaacttgagccttcatgttaacacgtgggggtcacagtgggcattttggagcacagataaaaggacctgctttggaattgtaaaaggctgtttcatacatacaaacagttcaggaaaggatagaacgaaaacaaaaacaagaaaccttgattaaccccaccacattccttcccaagggcttgaattttttaaccgaacactacaatagcaacaaacctagagagtcagttcaagacggcttctccctgtaatgctgccttagaactctacagaacagcagtcactgctgcacagctaaatacatctccagccaaggaaatctagacatagaagatagaaaataacatcccagtttgtccctcctctttcccctccctcatcacatatcaacagctaactttgaacacatctgtggttcactgtaccacttacaggggtacagaggaatgaaattaccagtcctcactgtaaaataaacacatttctttaagaaattctataaagcacaagaggaaagcaaaaccttagtaaactgacaaatgttcccattctcccagcacatgaagaagactgccacagtctttttcaattacactttgaaaccctctgtcctggttttcaagcacaagctgatcttcacctcattatagatactcaaactgccacccgtcttatttttaaatatcagagaagtgacaaaattctatctatgatcaaggatgtattataaaagagaagaaattttgcctggtttttacatttatttaagtcccttctacaatgaataaaaatggttgttcaaatcaatgggtgaatgggaatacaaataaaatatgggtagcattttaaggcatggtattaaggctaacatgatgtccatctaacatccagtttctgaaaatctgaaatcagaacacaggaccttttcatttcaaatttacattaaagttcagctcactgattaagcatttccctcaataaaattacatttgtcataccttaattgtgcaaaagctgcaaactggtaaaaaacttgaatgccatggcatgattattcaaaaataactggtacaccctatgcctgaaacctgagtgcctactgtgaacctgccaaaatgattacaatgacaacccatcatcttcatcacatgaattactgcaatgtgaacagtattctgctgagcactatacagtaatcaaaagacaagctccacatcctcaagaagcttataaatttgactgaggagatagggctgataggcaagatagcaataaaacacataataagggcctaaatcatgcagtacaaactaagttttgaataccagttcccagcttgcagtctcagacatagatagcaacaccaccaccaccacccttgccaagccaagtaagtaaaaagtaaaatgagtaggctaggcacggcggctcatgcctgtaatcccagcactttgggaggccgaggcaggtggatcacaaactcaagagattgagaccatcctggacaacatggtgaaactctgtctctactaaaaatacaaaaattaactgggcatgacggcgcgtgcctgtaatcccaactactcgggaggctgaggtaggagaatcacttgaacctggaaggcagaggttgcagtgagtcaagatcgtgccattgcactcctgcctgggccaaaacagcaaaactccatctcaaaaaaaaaaaagtaaaatgagtatacaggagtcctaaaaacttgagaaaccaaaggaagcaattcatttggtcaagagaaaggtcagggcagtttcaaccttcccatttatttagctgtgtgactttcaacaatttacccaaccctttaaaggaagatagtacctactaattaccatgagaaccaaatgagatagtgtatataatgcgctttgcacaatgcctggcacatagtctcaaatactgcctattatcattactgttagaaacagtaaaatcctagtgttggcaggggcctttcaataatccaattttccagtcgaatagttctcagggtgtagttaccatcagcatcatttgggaaattgttagaagcccatactctagggctccactccagacccactgaatcataaattatcaaatctgcgcccagtaatctgtgttttaacagcactccaggtaattgtgatgaccattaatgttagagaattgctgccctaattaaaccctctaattttacgtataaagaacatggaggccaggttcagtggctcttgcctgcaatcccgacattttgggaggccgaggtgggagaaccacttgagtccaggagtttgagaccacgtaatatagttagaccctgtctctgaaaagaatacaagaattagctaggcatggtggcatgtgcctatagtcctagctgctcgggaggctgaggcagaaggatcacttgagcctgggaggtcgaggctgcagtgagccatcatcataccactggacttccagcttgggcgacacagcaagaccgtgtctcgaaaaaaacaaaagtaagcagatggaaacctgaagagataaaataacctgctcaaaaccacaatcatggagactgtttgtttagggtccattatatgccaagtaccagggtgaccactttttacatttttaacatcaggtcctcacaacagcccagctgggccccaattaacagaagaaaaactgaggttcaggtgtgagatggatggagtaatttgtcaaaggcggctcaatttttaatgggcaaaattaacattcaaatccaagttgtatgtgatcccaaacccttactgaaaccaggaccactgagtgttctgagggaacgataccaagcacacgcccagacttccccacccaagggcatcgttcttttcattctatcataccaccttagctgcaatgattttaccatgaaacataaccagaaattagcactttaaagcaactctcagaagacaggtggtaaacgattcttcactccaactagaaaggaaaaaatgacaacatactatgaaaaaagctatgaggcaggaaaaagcacacgtcaaggcatggagatacggatatagactaggtaattttgcaaccacataagtgaaagaaaatttgctatccaatcttcctattctctactcccaagagcctagtgcttttgtatagttttcagctcagtaaagtgcctccagatttataaaagctcaatgacaataacaaggtatctttattacaaaatagttgttaaaagtttgattcgaaaaattttaaggaaacctttcaggtaactgaaagtggagggtaggggcgcgactcatgaaggagttttttaaccaaagaaatgatatgatacatttttaaatgaccacttcagttgcaatataaaataacagattttggaggaaaatgtcaatacaaggatatcaattatcaattattaggttactatattggttcaaggagagatgatggtggctgtggagatgagtgaaatcaacagatccaagatatattttagagagtattgtagaagactaggaatgggagtgaccagacaggaatgaagacttctagacttactgcacactgtcatgaggaaggatggggatggaagggtacagtggaataagctgggttttagcagaaggaatcaagagccccattacaaacacattaaatggcctggcgtggtggctcacgcctgtactcccagcactttgggaggctgaggcaggcggatcacctgaggtcaggagtttgagaccagcctgaccaacattgagaaaccttgtctctactaaaaatacaaaactagctgagcgtggtggcaggtgcctgtaatcccagctactggggaggctgaggtgggagaatcgcttggaccctggaggtggaagttgcagtgagctgaggtcgcgccactgcactacagcctgggcaacaagaacaaaactccatctcaaaaaataaaaaataaataaaaataaacacattaaacgtttataatgtatttacaagactaacaatcagataaagtctgaacttcagaaaggagatagagctgacctgaaaatataaattacgaactattgttatatgaatgttacttaaaagacgaggaggccaggtgtggtggctcatgcctgtaatcccagcactttgggaggccgaggcaggtggatcacttgaggtcaggagttcaagaccagcctggccaacatggcgaaaccccacctctaccaaaaaaaaaatacaaaaattaatcgagcacggtggcatgcacctgtcagcccagctactcaggaggctgaggcaggagaatcacttcaatctggaaggcggaagctgcagtgagctaaggtggtgccactgcactccagcctgggcaacagagtgagactcggtctccaaaaaaaaaagggcagaagatggggcggaagaatagagataggaaagaggaggatgttgagaactaaaccctgaggtacttttagtattcaaagtgtaggggggtctggaaatcttgtagagaccagtaggggttggagtatgacatcttccaataatgaattctcgttgctgtccccttatgggtctgggtctacctgatagtctcttctggaagtcggtatcacttgtgcttaatttctactcttttgtgccctctatacagcctctactacaaatcttttttgaagaagcacagggagaaataacttggggaaaaaaaaaagcctatcttttagaaatagattctgaaatatttacagatgaaataatatgttgtacagaattggcttcaaaatagtccaagtaaggggtggtctagataaaaaaaaaaagaacagctctgagtagatgcctgttacagttgggcaatgcacacatgggaaggttcactgcactggtctctctgaatatttcacaataaaacataaaacatagtatggaaggttggcaaacacaagtccatgagaaatctctccatcttacccagattaacgagagatacaaccaaggatccacaggtttgatgcagacattctaaaagattcaattataccaagactttaaaggtgacagatttttttcccctcaactatacatttttttttttttttttttgagacagagtctcaactctgttgcccagactggagtacggagccataatcatggctcatttcagccttgactttactggctcaagcgagcctcccaagtagctgggactacaggcatgccccaccatgcctggcttttttttttttttttttttttttttggtagcgacaggggcctgctatgttgcccaggctggtctcaacctcctgggctcaagcctcagcctcccaaaagtgctggattataggtgtgagccactgcacctggcctatattgctatcttaaaatgtctcagtgacccaacaatttgccaaagagcatgtagagcaaactaggctctattcagcatttccatttcttaatgtatctatttgatttcaataaaatttcatcattttgaagatctctcccattagcttgggaaactacagaaacatgcacataactactgagaaggtatcaagtgttcctacactagtttaaaaaaatcattcaacacccacataaattctgatatgcactaggctgaacagctgttaaccactgagaagctgggcactgcatcctctccctgggtcaaaactctatatgctaatcaaacagggtcatgtatttgggaaaataataatccatggtaaaagtcacaaaaagaccttaattttaaaatgagaattcctaatctatacattctttaaaaaatctagggtatataggttgatgtaccttccttgatcaaaactcttacttctctgaagcctgtcagagtattttcaccacaaggcttggattaggtttcattttacatatgcatgcacatgttcacatacccataatcatccttcttagtagtatatagagacggaccatatcgttaccctcttctgctcaaataaatgtcttcccctacaaatgctaaggagtaaaatgatccagaaaaagtagaaatttggcataatcagcactgacttcctcaacggtaacatacatgacataaacacattaggtagactggatgcccaaaggccaatccaacctcatgtcttcctggcatttctcaggcctttctcgtcacccaccccacctaggttccacgtttccaaaaaagttccatgaagattcaggaaaaaacaaaaagggaggaaaactcattttattaaatttacatcatatccttcttcccagggttcaaaattaaataaaaccaaaagaagaaaaccagaaagacaaaagcacttttgtccaaggtggcaaaacacaagagcaatttaactgccattatgaaccaacttatactaaaatagtatttcctggaatgtgtataaattaaaaaacaaaacaaaatgttcatggttacttttactttcagggttgggaactgaatcccacaaacagcagctaaacctcaaaaaaattgtaattccctaattatttccagattaaaacacttctcttgaacacatgtttctgctgttctttggggtgagtgtagggcacagctggagtacagtataacacagaaacagcaagtgcactaagagcatcaaatccttccccccaaaattgtttatctcttccagactcctattcacacttattcccctgacttaattttaattctgcctcttggccctcttaccttgtccctttctaccctactcacttattctctattcatcctcattctctgaaatgatagtcaaaataatacttcatgctaaagcattttcttaaatatttccagatattccaacttgttatgatctcccacttctttaaaccagaagctattactacttttagagtgcatacctatttctgccccatatttatcacatacaacttacgtatgatttagttagcatcctcaaacttagaaaatgattctcgcagcccagcaaaaatccttactatagcagccaatcaatatctattgaaaaatacatgtaccccctcgatacaattgtcataaaagttttcagtgtgcacttaatttgataatgtcacttccatctttctgttttgaaaactgtttcgccgggcgcggtagctcatgcctgtaatcccagcactttgggaggccaaggcaggctgatcacaaggtcaggagatcgagatcatggtgaaaccccgtctctactaaaaaaaaatacaaaaaattggccaggcgtggtggcgggcgcctgtagtcccagctactcaggaggctgaggcaggagaatggcgtgaacccaggaggtggagcttgcagtgagccaaaatcacgccactgcactcaggtctgggcgacacagcgagactctgtctcaaaaaaaaaaaaaaaagaaaattgtttcataagaatgactcatccttcaaaggaaaaattcagatgaaaaggtgtctgcactatgtagtgtgttaaaatttgttctcaagcctctccagctaccctcaggagtgaacagtggcaaactgcagcttaggctagtgaagtgatctgccctacaccatcaagttagccaagaatagaagccacatttcctgactcctgccttgactcctgatctctttccacacatgcaaatacaagttcagcatcccaaacccaagatccaaaaagttcccaaaataggaaactttctgagtgtcaacatgacactcaaaggtaatgtttattgaagcattttgggtttccagatttgggatgttcaactggtaagtacagctgaccctctgtattcatggattcaatcaatcaaacagcaaaaatatttaaaaaacaatgtctgtactgaatatgtacagactttttcttctcattattccctaagcaatacagtgtaacaactatttacatagcatttacactgtattaggtgttataagtaatctagagatgacaaagcatacaggaggatgtgcataggttatacacaaatactatcccatcttatatcagggatttgagcactgtcagatttggtatccacggaagttcgtggaacaagtcatccaagaatactgaaggataactgtataatgcaaagattccaaaatccaaaacacctctggtcccaaacatttcacatcagagagactccacctgtaatggctttcagttctgtaaatcaacagcacatctagttgtgtgaatacatacgtggctaaggttcaaagtactttaaaagtattaagtccaagacaaagatgagatagtattcctcacctgatccaagggtcacacctgacagtaagaactggagtcaaaggatcatcactgtaacccatcaacataggtacagttcacaatattaggagaagtcatgaagtaacatacatacaggacacacataaatttcacctctaaccaggaatcctgtgatagaattcattaaacctattctcactcaactacccccagtggcttatgaatcaatcctaaaggcatcagacacaagactattaccattacaaatttctaatctgctaagaagtcttgagttttaaggaagaaactagtgccaattcattaaaaaggaaggcagaaaaatggaaaaccagaagtctttcattgctgctctatccccataatctaaaacaatacctaggacatcacaggaaaccaatgtctatttactaatgtctatttacctcttagcctttattaaagtgaactcatagtattgacattattttctcatcctcacagggcatttgaccacattttggaaccaagtttaaaatctttcataggccaaaaaaaaaaaaaaagtatataatgactaacatgctttaaataccatgacaaatataattaaatacttgctctcactgaattcaaaatttttagttccctcaaggtgaagttactcattttccattatttctctctaacatcaatttctccaccagatttcctccacctgtgccactactcacccatctaaatgtgcacatgtgtactcaagcattcaatgaattgcttattatgtactactcagcacgaagaagcagaggaaacccagcctttggagtgatatgaacctgactctacttcttgttttaaccaattactaagccttgtgacctcgggaagtcaatcattatgtctagtactcctgttgcctaactgtaaaaatgtgaaggattattacgtacataaaagcataataccaaaaataggcactaactgattgttagtttccgtccctctcctacaacagcaccctgactttggaaactaaccctccacgaactgaaagcattctcagaatatactgtccttaaaaaaagaggaaggaatgaagggaaagaaaagaaaagaaaaaggagagagggaagggaaaaggcaaaaatttttaaaaatacttttggtcctggtttacaggccaccacaataattcaagtaaattagcataatccagagagacaaaaactttttctattttttactacaccaaaaaagctcataataaaatttcaaagtattaaaaaataaatgaaagtaatcccttcccttcctccatcccaacccatcccatccctcagaaataatcactgttagcactctggtgtgcacatatacacatacacatacatacatatatatttttgttgccaaaattttactgcagatatctggaaaataaagagtagcataaagaagaaaaatatgtaatctatacaaccggaaaaaattttaagctgcaaataagtttccacaactaaatttacattgtaaaacacatgatggggaaaaaaaggtctttacaataaatatggtacaaggacaactgaatatccactatccacaggcaaaataaaattggattcctacctcacaccatacagaaaactaacttaaagtcgatcaaagccctacttaaatgtaagcattgaaactcctggaaaaaagcataggagtaaattcttcatgaacttgggttaggcaatgatttcttatgctgtgacacaaaaagcaaaagaaacaaaaaaaaaacataaattggactatatcaaaatttaaaacttctgtaaataataatcaagaaaatgagaatacaatccacagaatggaagaaaatatctgaaaatcatctatttgacaagacactggtctccagaatatatacaaaaaacacaattcaacaatttttaaaaaccaaataactttagaaatgagcaaaggatctccaaagaagatatacaaatgaccaattaagcacctgaaacgattatcagcatcattagccattagagaaattaaaatcaaaaccacaatgagataccacttcacattgactagcatggctataattaaaaagacaattagaagcattggcaagaatgtggagagaatggaacccacaaatatcgctcatggtaatacaaaatggtaatataaaatggaaaacaggcagttcctcaaaaagttatacacagggctactttatgtgttaaatgctgaggatgcataaaggatcagaaattcagataaagcattcccagaacagtgattgatcctgtttgtttaaaaaaaaaaaaagacaatgtactcaacaattaactaaagtacttgtatttctctttacaaaactaagttatgtaagaactaaacattttaaattgaaaattgtttatctggttctttgaactgaaaatccttttatattcccacctgtgagtgtacacaacaaggtgaagcaaatgcattaaacccagtaggtctcaggacaggaagcatttacactcagaggctatcccacagagcaaaatccacactgaagactaaatcatttcacagaaccctagatttagataaacttggagacaggagagcagctgaagagcccttctctttcctcaaggttgtctacacatctaaatcaacttcactgggggagcataggggctgcttaagggtctaagacaaataaattcttctatgcaatactttacatttatttacaaacggtctatcttacactaagctcaaaatattccactgagctactgcagaaaatctgggtgcgaaataagaaaagacaatcagagagtgtatactcataaaaggaattaaaaagaacaaaatgcccaagaatacagtatcctcacaaaaaataccctaaatgaatctagtaaaaatttggcaacccatattctggaaagatattctttacaagttaacctgtatgtcttatgcaacttccaaagtcccaaagaaagtaatacaaaattaagtggttttgagatactagtcagctttttcggaaagagggttagagaggacttacttccttgtattatgaaacaaaaaacgctctgatgaattaaaagggtagtttctttctttatttctctttttttcagacaagtctcactctgcgtgcccaggctggagtgcagtggcatgaccttggctcactgcaacctccacctaccaggttcaagcgattctccagcctcagcctcccgagcagctgggattacaggtgtgtgccatcacacctggctaatttttttgtattttagtagagccaaggtttcactatattggtaaaagggtagtttccaaaaataaaaacatgtacaaggaaatttaaaattctcctattagtgtctggaaggatgaagaatttctactattttaggttgagaaagaaagctaaaggcaaaagatcaacagacaaaaatttaaacaatttataatttctaacttatccaagtttgactccaatatttttaccaaaggataaatatctctgcttcaaagaatcataaaaacattacaacagcctggcacagtggctcatgcctgtaatcacagcactttgggaggccaaggcaggaggactgcttgagtccaggagtttgagaccagcctgggcaacagagcaaaaccccatctctacaaagaaaaaaaaattttttaataaggggggcataagggtgcactcctgtggtcccagctacttgtgaggaccacttgagtcctggaggttgaagctgcagcaagctacgactatgccactgcactctagcctgggcaacagagcaagactgcagactgtatcaaaacaaaacaaaacaaaacattacaacatatgagaatgttcaacttcactaatactttcccaatgcaaatttaagtaaagatagtattttttatttatcagtttagcaaatatttttaaaggatcctccatgctaattggagtgtggttaaacaaaaaacctgcttgttacactgctggtatgactacaactgggaaccttttggaaagcaacctaacaagatatatctgtagtcttctgaattgttcacactctcttttattcttagattcatacaatataaataaatacaaaaagcaaagcctatgtgcacaaacagcaagcatcagaaagtccatgaaaagaatagtacaagtatatagtaaaggaattaacttatactttgcttttcaaactatgttcaatccaatagatttctaaatatggcaagtttctaaaaatccaactccttaagtacactgtaaagacatttatgcacacagctaaaatatactcaaactaagaagtcctcaaaggccgtaagatacactaaaaatataatacctcccagtgaaataaagggaaaagcagaagtcaggtgagaatatttacatatatgtacccattcagcagttctgtagaagtcattatcttctttgggaggccgaggcaggtggatcacctgaagtcaggagttcaagaccagcctggccaacatggtgaaaccccgtctctactaaatacaccaaaattagccaggtgtggtggcaggcgcctataatcccagctactcagaaagctgaggcaggaaaatcgcttgaacccgcgagacagaggttgcagtgagctgagatcacgccattgtgctccagcctgggcaacaagagcaaaacttcgtctcaaaaaataaataaataaataaataaaaaggccgggcacagtggctcacgcctgtaatcccagcactttgggaggccgagacgggtagatcacgaggtcaggagattgaggccatcctggttaacacggtgaaaccctgtctctagtaaaaatacaaaaaattagccgggcgttgtggcgggcgcctgtagtcccagctactcaggaggctgaggcaggagaatggcgtgaacccaggaggcagagcttgcagtgagccgagatcacgccactgccctccagcctgggcgacagagcgagactccatctcaaaaaaaaaaaaaaaaaaaaaaaaagaagttgttatcttcccagtagaagagatgagaaaatttgaggtccagattggttgagtgatatccgaggaccacagagctagtaaaattatggagctagaacttgaagtctgattccaaatcacatgtttcctatgctaccccaaacaaagggagtattttctacagtggcattacaacagaccaagtaacagcagaggtaaaacaagtttcacatgtctgtggctctttgttttttacaagtttttattactttgtcatgggggggaaaacgaaaaattataattaggtcaaggaaagatataactatactactactatcattctgaaggaagggaaggtataccttctaagtcctgcatagtttaaaaattcccattacttgcgagaccaggtgagactgcacagttctagacttcctatcgtgtgccaaaactctagggataatcaaaaaatgtttgttgaatgaacgctaatttaaaatagaaaaagaaattccagatttcctcctcagtacaagaggcctgcaacaacaaacttctgaaataccagcagtctactaattgcatattcaaatttaaaccacagaaagttgaatcaactctgccaatttctgggactctctaaatgaactcttaatacaaaaatacatactcaggctcagcattttttctaatcatttacaaaagtaaaaggacgtcaggacaagttctggtgaaattttataaacagccatgaattgcagctgtagactgccagatacataacctgtatatgacagggggtaccacgtggaaattagagacatcccccttcaccaaaaagattatatccaggggatactacataataaaaaaaaaatctgaaaaatgtaatgggattaagatcctttagaataggctagtagtgatgattttgctttttcagtcccctcctcacaaacaaatgatgatgacactgcccttagctttctatgtgcaaagacagtattaaccttcccaggccaaacttacgactacaccttttccacacgaaatgcaaggcatttctaactccccagattacctcacattcgttggatgccacacaatagattataaagtatcaagatatatattaatttttaaaagttcaccaggagttggatattctaaactgggtttctgattcttaacagtgagaatgaagtcaagctccttatttggtggttagaggagaggatttggccagaaataattcttttaggattgacagacaagtactacttaagttctatcatctcatccaaaaacttgcttcttatattctgcttttaacccgatctacacaatgaaaagccacggagactagttttgcatgaaagcaaaggacttttctaatatgacttcagagcatgccatgctttaaagtccatgttcaaccacttactatcattttccaactcactctctatgggcccatcccatatttcaactacaggtatacctcctggccctttctatttcataagcttctttggaagacaaatctactgatttatgcaataaactttctacctctacttaaccaatttgataatttaatagctggagataattctaaattccccaaaccttaatcaagaattttggaaaaaaagagctatctagaacagttatcttcctgaaaacactgttgtgctaaactgaaacacagccttttctcaagagctaagcagctacttgggtctacattttaatgcactaaataattttataagatcatgtttgaaaccaaaaaacccaaaaaggattgtcaagctaggtcagcttacaaaaccccttctgttatgaactaggaaatcaaacaacaaaacataagctctaggaaatgagcatggaggtgctccatccatactagcttttccttgtttttttcttgagaggagtgactctctgtcacccaggctggagtgtagtgatgcaatcctggttcactccaacctccacctcctgagttcaagggattctcctgcctcagcctcccgagtagctgggattacaggcgtcgaccatgacactcagctattttttgtatttttagtagagacagggtttcaccatgttggctaggctggtctcaaattcctgacctcaagtgatcctcccaccttggccccctcaaagtgctgggattacaggtgtgagccaccgtgccagcccatactagcttttctgaagcctctttactcattcttttgttctctactctagcagctaaagacatctcctaaagaaacaactagtgtgcctccatacaacccctcagtaagcactcagtattgagactaaactgtgaaaagcactaaaataaatgcatcattcatctatgaccttctgagaataccaccacctcatatttgaatagacgtctagttttcatgagaactttcacgcactcatttgatcctctttaaaaaccacaggaaacagggcaagccatcttatcagctctatttacagagagggaaatcaatttgaaaaggttacatagcttaatcaaggtcacaaagtgactgactggccaagctggtactcagtcttatgatagtccagggctctttcctctacactgatcctaaattgaaaaaaaaaattttttttggactgctcctgcaaggtagggctaccccataggcagagagtagctgaaaaattctgtatgtgtctatcacaagaagttgaggccgggcgcggtggctcacgcctgtaatcccagcactttgggaggccgaagccggcggatcacgaggtcaggagatcgagaccatcccagctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagaagttgacaggcctaaaaggtttcacatttagatgtttctttttttggaaaaggtgaagatctggctgggcacagtggtgcacatccttaggtagttccagctacacaggaggctgaggcagaagaactgcttgagcccagcctgagcaacacagtgagactccatcactaaaaataagtaaataaataaatcacataaaaaataaaaaattttaaaagggggtaaagagccaatgaattgactaagaaatgtgttgtttcaaatcagaatgaccttgaaaagccatagtacttgcatgcaaaaatatgatccgatttaaaaagtcaatatgcttaaaatacaacagaaaaatcaaccaatatatgtatttcgtattactggtttaaaatttctgaatatgctgtaaagagaaggaggtgaaaaacgtcaaccagactggggtggtggctcatgcctgtaaacccagcactttggaaggccaaggtgggtggatcacttgagttcaggagttcacgaccagtgtgggcaaggtggcaagatcctgtctctacaaaaaatacaaaaattagccagatgtggtagcatgcgcctgtagtgccagctactcgggaggctgagatagaagaattgcttgagactaggaggcagagggtgtagtgggcagagatcataccactaacccctccagcctgggtgacagagtgagactctttaaaaaaaaaaaaaaaaaaaaaaaagagagcgagagagaaagaggcagagagagagagaaagatctcaactgataagatactacataatcacattatctcttgcttgaccaacttaacaaatatttcaaaatgtttataaaaatcaaaatgggtcagcattggaagaagttgtaagtaaaattcaggtgttctccacatgaggcaactgctgttaatagaagactatatgacggtattttctcgaagtttggtacaaagatcaaaaatagaatcacaggcaaaacccttgaaaggcttaggaatctgaatttttaagtactaggttgttgatgaatataaaatttaaagatgtgtatttagggtagaaataaccttgaccttggtagctgtggaacttgtgtggttactcgttctgggccctggttttcccaatggtaaaacagaggaggtagggacacaaacgtcctacttcatagaaaagttataagactttaaaggcgatggtttataaaaagtaattagcacacagttttgacacacactaaataataattagctactatggtggaaattttatttctatttaacacttctgacattagcaaatagtgtaccaaacagacatgctttttacatagttacatgattcttctcaacaaccgctcccccgaaagaaagcagtttttaagagggtcactctcatgatttgaagagaactgggagaggaggaacataaatcagttctgtcacattttaaggattagaatttaaacattaaaaacaattttaatatgttcacatatataactatcacctggttggaccatgacaaaaacccacccctaaccataaacaagggtaacctatcatttatcaaaaacaggaaacgttcctatctctcaagatcagcgctctgaactaattatttaacataaggtcatttttacgagttcacatgctgaatggcttacaattaaaagcctcttctaacccaaatcaccatcctccttcacttacctttttttttttttgagatgggagtctccctctgtcgcccaggctgaagtatagtggcacaatctcagatcactgcaacctctacctcctgggttcaattgattctcctgcctcagcctcctgaacagctgggtacaagcacccaccatgccttgctaatttttttttgtatttttagtagcgacagggtttaaccatgttggccaggctggtctggaacgcctgatctcaagtaatctgcccacctcggtttcccaaagtgctgggattacaagcatgaaccaccgtacctggcctgttgcttacacttaaaaaaaaaaaaaaaaattcctcccctctccctagactcctaacctaatcaagttaccaaattcaaaaaattattttatctcacccattcttgcctctttttttcttttttttttttttttgagacggagtctcgctctatcgcccaggctggagtgcagtggcatgatcttggctcactgcaagctccacctcccgggttcacgccattctcctgcctcagcctcccaagtagctgggactacaggcgcccaccactgcgcccagctgattttttgtatttttagtagagacggtgtttcacgtgttagccaggatggtctcgatctcctgaccttgtgatccgcccgtctcggcctcccaaagtgctgggattacaggcgtaagccactgcgcccagcctgcctctttttttctactagggctatcacaattctggccttcatttcatttgacaggaaggcatgggtttataccctaaccagaacaacaatgaacaggatttctgcctccactcctctaatccaggggttggcaaactttttctgtaaagggccagatggcaaatatttaggctttgcaggccacacagtctccgtctcaactacacaactcttgccattatagtactaaagcagccacagacaatattcaagtgaatgagtatgactgtgttccaataaaactttacttacaaaaacttgccttagactgcatttggcatacagggcatagtctgttgattgtgctaatccaaccaactaatatcaactttcctaaattccatcacagatcatgtgatttctgatttaaaagtcactttccttggctgggcacggtggctcacgcctgtaatgccagcactttgggaggccatggcgggtggatcacgaggtcaggagatcgagaccatcctggctagtagtagagatgatgaaaccccgtctctactaaaaatacaaaaaaaaaaaaaattagccgggtgtggtggcgggcgcctgtaatcccagctactcgggaggctgaggcaggagaatggtgtgaacccaggaggtggagcttgcagtgagctgagatcgcaccactgcaccccagcctgggcaacagtgcgagactccatctcaaaaataaataaataaataaaaaataaaagtcactttccttaccaaaaaaaaaaaaaaaatagaacttaacattccttggcctgatactcaaaggcttcctccatgagtataatcttcattaaccttggtcatttcctttttctcatactagattccaaattgtattccatgattgtggctgcttatactgctctaattccaaacctttgctcaatttgtatacagaatgtcctttcttctttccctctaaacacctacatctcccttgcttcccacactaccacctagaactaaaatccatctatcctctaagaagtctccttccctttacccagaaattcttcttcagcagaacttctatggcacttaatctgtatcttttctgacaatgattgctttgtatcttttaccacagtgaattatatcttagatcccctaagcctgtgggcagaatttatttacaagtcatctctgtatttcccacagcactttacaatcaagagataaaaaaacaggtattattgtttcaaagaaaatattcctacaactaaattcctttacataacatagcactgttaataagaccaagacacacttattctgtattaaaatgttacctaaaaactaatgacactggctcaacaaattaagccttcaaaaattagtctccatcttattacccagagggcagcatggcaaagtgggaaaaggaaaaaaggacaagattgacatcctgattctgccattgttgttaaatttctgcttccttatcttgtgaaacagatgttaccactgcctacctgggaaaactaggaataacgactacagtaaattattatgcattatggcttttataaacagaaatttaagaacagctaagttaactgcaagatccctattctgtcaaaaaaaaaaaaaaaaaacacgagtatcttgtgttcagcattatgaatataaagaataaagacatgagcagtctcataacatagacaagttcagtctactgtagatcctttcacagagaagtaatacaacatactgagtgctaaccttccagctatttctaaaaagatggaagtccaaggttatttctaaattattttaagcataaagctaaatatttaagaatgagttataactgagtttctaccaaattaaaacaacgatgcttacaacagcttacagggctcctgatctcaccttctaccactcattctatacctggatcagcatgcatgctcctgccaccccgggcttactgatgaaaatccaacaaaccgggctcagtcccatcttagggcctttgcaagtgttctctacaccttgaatgctcttcctcaagatcttcacaggtcttgctcacacacttcatacagatctcattcaaactgtcacctcctcagagaggctttccctgaccaccctattaatatagacatctctctcccataaccatcactttcaatctccttaggctctttcctttttatatctctttatagcacttgttaactagccttcggtcattatttacttatctgtcttccctagtaggataaaactccctgaaaactgtaatatcttattggctgctgtactccttgtaactaaaatcatgcctggaacacactgagtacttgatacatattaatttttaaattgatgaataacatttgtgagtgacgaggaatattcatcattgcaacttacataatttcttaaaccagctgcttacaattaaatctagcatgttgaggctactcctagaacaggggttcttaatttggggctttagggaatcattaatacccatgtttctggaaggaaaatctacagcttttctttaaatggtccctaatctgaaaaacatcctagaccagtgatttatgactctggctacatcatggaatctcctggtgaattttaaacatacagatgcttggatcccatcccagagggtgtattttttctcatctgtggtacaaccacaggacttctaaaaaattacccaggtgattctagtgtatagcaaaagttgagaaccatgcaatttgaacacaacaaatgttaactgggtgagagtcctcaaaggtacttacagtgggaagaaaacaaaaattgaaaactatgaattttgagggaattggcattgctggcaaacagatcaatacacaagttcctgaataattctgtatcataaaaacattttaaacaaaaactagtagctctacctccacttaaatactaacctgacattgagattctagagcttactcccagaacacaaataacacctttcacttaaaacaacgtatttcagacaaacattcacttcttaataacttacttataaaaacctaaaactatcaagaaaacaacagaatactttttgaagacgaatcagctatattacaactatgaagctctttgtagttttattcctaaaaatgcctttgaagcaacacatttccaccaattaatgtcctcatttagcctcaactgttacacaggatgacaggccctgaatttaggtgaaactaatactgacaatagacacaaaggggggggggggatttcagagatttatttagatcatgtcaaaagggtttgaaaagagcaggtgtcagactgacacaggtggtaaattgttttctttttgaagtcaaacaagcaaacattgagtaataagcgaattcactgataccaaccgagggtttcataagttactggtttttataccttcatccaagtagcccttttaaaaaagggattagcaagatagagagcaaaacaacaaaatgttaagtatttgtaaaataaataaatccagatgcttaaatccacagtgataaataattttaaattattcctggatacttagaatcacgatgaaactcattccatctatccctttctttctttattcttggctgtatggagatacctgctgacacagaagcaccaggtcatgagcacatctgacataaaacattacaaacttaaagcagtattttttaaaatctaaagggcttagggaagacagccatgctcctagctatgaagcctctgtggcttgacttcctggtcatatcacaaggatttttttttaaagtattattcagttcccttgttgagtaagttaatttactaggaaagtgcaaacaaagacatacatgcaggtacgcagctcatcaacgcattttagttgtggggaaagatcaggcttaggagacacgaataattataaaactattagagctggaagagccctctttaaatttcccttctagaaagatgggcacaaggaaatccttagctttctatgtcgttttactcggtaaaatagtacactcttattagtaactttatcttttatcaaaagcctgtggaaataaatgttctgggattaactagtaaatatataaataaagccacagaaacatattcccaaaatgtgggctggaaatgaaaacagaacagcatgggatacaaaaccccactggctgtttacaaaatgtttcgtgtacatgacttttatgtaataggaacagaacactagtataggaaatgaagactacatggaagggctggctacttggaggtgacggagttaaagatttcatgaaccatcaaaagaccaggtcatttatacactagattatcaaaccagaaaaagtctgagtcccctcattccattacatttgaagaaatgagaagcaccaaaaaaataaagtatcaatacaaagaagagagagaaactaagacaatctgaccctgaaggaatcgcaatgtggagggaaaacccagccctaggagttaattgtctaagtcaggtaagaaaagagtgaaaaagttgaacagcacaacagactatttcatgaacaccagatgcctcgatatgtaagggctttaaataaagagaaaacactctcctcatgagctgctgcttcagtgcctagttcttcactcaactatacccccctctaaatcagatgcagcattttgaaatcgacctcactcccttaaccacacttaatttttggagtagaggttaatgaacacaccaggataaaacgatgtctagtttggcaggagtgggagtacaaaagtaaggggaaaaagacaagaaagaacaaagcactggttcgcacacctctctccaccccagttaagctgtggaaagctgactggcatatccacatgcttaaattatacgttactggcaatgagggaagtggggaaatgctaacattctgatttgtcccttgacaaatgagggaggatattcccccctcagggttgcactttaagaatttctacttgcaatgctcactgcagcctcgacctcccaggctcaagtgatcctcccatctcagcttcccgagtagctgggactacaggtgtgaaccacaacatctagctcatttcttgtggtttattgtacagatgggcgtcaccacgttgcccaggctggtctcgaactccttgagctcaagtgatccccctgcctcagcatcccaaagcactgggattacaggcctaagccaccgtgcccgggctctcaccacaattataaaaagagagagaatgaagggaagggtagaatttcctctttaaaagtggtctgactcaccaaaccatcttcactgcaaagccttaaacagtaccagaatacaggaaaaggatattgtatgcttttcttagagctgggacaaagaaatgagagggtgtggtggggggaaggagtaaacaatcagagcataagtaacccatattatacatggtttatatgatgccatctccaggtttaatctttcccttttattattttatgattattttaatggagatggggtcttgctatgttgaccacactggcctcaaagtcctggcctcctaaagtactgggattacaaggtataagccaccacgagcagcctaatctctcaattttagtttccttaccataaaacagacacaatgcttactatacaattaaaatatgctataaaatagtaagtgaaataactatactaaaaggcattcctggcattcagaaaagttgatggtagcatcctttccccctcaaagataggtacaggaggccctaatccaatagttctcagccagggatttttttttttttttttttttttttgagatggagtcttgctctattgcccaggctgtagtgttgccatctcggctcacagcaacctccacctcccgggttcaagcgattctcctgcctcaacttcccaagtagctgggactacaggcgtgtgcgaccatgcccagctaatttttctatttttagtagagacaggatttcgccatgttggccaggctggtctcgaactcccggcctcaaatgattcgcccacctcggcctcccaaagtgctgagattacaggtgtgaaccgctgctcccagccttggggattattttgaccttaccccaacccccaaaagggcacatataataaagtctggaaaaattttgttgtctcaactagggtgagggaaggtcctactggcatttagggggtagaggccagagacgccatcaggcattcttacagtgcacagaatagcttcccatgacaaataattattagtcccaaaaggttaatggtgcctctgttaagaaaacctgcctaaaaaacattcatttttggaaaaaccacataaacacagaagaggagcataacactctagttcctacagtctattaaaaaaaaaaactatttaaaagatattacaggctaagtgcagtggctcacacctataataccaacactttgggaggctgacacaggaggattacttaagcccaggagtcttcggctgtagtaagctatgatcacgccactgcaccccaacctgggtgatagagtgaaaccctatctctcaaaagaaaacatactctaagaacaatcctttcttgtgatagctattactcaaatgacaaaagctgggggaaataccttgtaaatatcagaaaaaaacttctcctcctaagtagtttaaaaatatgcagataggcgggcacagtggctcacacttgtaatcccaacacttttgggaggccaaggtgggcggatcacctgaggtcaaaagttcaagaccagcctgaccaacatggtgaaaccccatctctactagaaatacaaaattagccgggcatggtagttcatgcctgtaatcccagccacttggaaggctgaggcaagagaatcccttgaacccaggaggcagaggttgcagtgagccgagatggcaccactgtactccagcctgggcgacagaccgagattctgtctcaaaaaaacattaacaaagaatactccagatcatccagaaagtcagtatctgatagtgtttatatggagaactcctgcactggaatgtaaactcctaaccctagatccatctcttctcaggtcttcctatcacctcagcctacagcagtcaatccttccctctaaccactccctcctcctaagatttcagcatttaatgcctgtaccatgtatctaatacttagtacacaatgcctaattcttgttttttaatttttatttaaaatactaaaacgaaacagagacggggtctcgctatgatgcctattctggtctagaactcccgggctcaagggatcctcccaaggaactcggcccacaatgtctaattctaatgcttcctcttttacttgaaagtggaggggaaggctgggagcagtggctcacacctgaaatcccagctactcaggaggctgaggcaggagaatcgcttgaaccagggaggtggaggttgcactgagctgagatcacaccactgtacgccagcctgggtgacagagtgagactctatctccaaaaaaaaaaaaaaaaatcagtcacataaattactcattgaagacaggaaccaagttttcaattcttcttaagtgttttcatcattcctgatctaaccaccagagaagtgtttccttgccctttggtggcaaggttaatcttggtgataaatgatcctgaaaggctagtctccaaataattagaaccttgaaaatgtttatatttttctctgctcggaaaattctggaaccccttttctaggactgccacaaggacacttctgactatcctcaatgatgacacattttagtttccattcagattaccaattatggtaactcccctgatcactgtttaagtactacttattaaaggaacaaacattaagctattgctcttggaaggccagcctgctaggaaacacccaagagcaattctgtaccttatccttccctaaattagtcagccaatcttaccattcaaggatgaaattaaaggcatttatctcatctagtaataccatcagtaaaccatggaagcttaaataatctaacattgctttggacattatggaaatgacaacctcagcacctaataaaatgtaaaaccaaatatatacatatcatgtcaatgtcttgaatgtacaattaccttgaaaatttcaaagtcacctcacatttctcaactcttggacctgagacctgcttactatcaagttatcattgagaacaaattaagaattctcaattgagaggtcacctgttgcactaagcaaaccgcctgcaaatactaaattagcttttctacttacactatcaagtcaaattacttctggtaatgcttgagtgtatttgcatgagatcaatttcatatacagttgggcagaagcaaaatgagtcttaagcaagcttcattctgttttcatcttacaaagaaaagactggcctgtcctcccagccttttgaataaggatcttgaaaaattcactacgcacagggtgtgcccaaagaatacttgctggaaaaatatgctgggagagtgccaatttaaaaagaaaaacattttcgcccagttggaaatctagagaaagaatagttgtagcaattcagctaaaaactctcaagacctgaagaaaattttagaaaaaccccagatctttttgttattggagtaaaattctatgaaaggcaactaaatgaatcaatgaagtattcaactatgctaattttatgcacctaaaaagcagtaactgaaattctgcctttgacatttgacggtgcaaaaagcactaagtaccttatttgttctacataaatgaactttataatctgcaatagtttttaaatcaactgtttctgggaaataatgaaagcattttattttcctttttaaaaaagcaagaataacaaaacttctttattgttttgctttttgggaggaggggttgggggaattgggataaatttttgttttccattagagacttttttttttttttttgagacagtctcgctcagtcgcccagctggagtgcggtggcacgatcgatctcggctcactgcaacatctgcctcccaggttcaagtgattcttgcacctcagccttccaagtagctgggattacgggcatgtgtcaccatgcccagccaatttttgtattttttgttttgtttgtttttgagactgagtctcgctctatcgcccaggctggagtgcagtggagcaatctcagctcactgtaacctccaccacctgggttcaagtgattctcctgcctcagcgtcccgagtagctgggattacaggtgcccgccaccacacccggttcatttttgtatttttagtagagacgaggtttcaccatgttggcaaggctggtctcaaactcctgacctcaagcgatctgcctgccttggcctcacaaagtgctgggattacaggcataagccaccacacccggccaagagacttatttctgaagcataacactccagcaatagcttgattaagctaaaaagatacccatctgttacaggcctttgtcttcagtctctcactacaacacccacccctttccaggtccactcagaaccttacgctcagatttttttttcactgcaataagtgaacacaacaaaaaattacagttactacagggacacactggtcccaggttgcctcatgagaaaagcaggtgagtaggcctgctggagctttgcactaactctatggaccctgtggaaactgcatgcaatgcaggctacatggagggtcaccgggctgctcactatacctcagcaaagcaaaaggcctgcctatgcctatgacaacagcctttcccatcacagcctggtcccaccacaaaacaacaagcaatattcttccaaaaagtacagtcctaattttaaaagtgaggaactcgagcctaggtagacaaaatgtaacaattcttaacagttgtccagaattctttctactctcttactccccttttagtactaataccacaaatgctaagaaaaataacctctagttcatccttcaagttttctggtacttgccaaatcaataaaaataacatgtgaaatgttaatcacaaaccacctactcagacactgaaatgacacaaatacagactaagtagatgaaaaccaatcaggatagtcctcaactattctttcaatatcctttcaagttctatggtaactagatttaccagcaagagttttcttgaggaaaatactaaacacaaagcacatgcttacaattcacctgtaagcacaagttaagaataatggagaaagaacataaaataccttcataactcaaaagagctccttttccagcaactggggaaatagttgtttggggcttttccacataagatataaatcatccctttcgaatgtcaaaaatgtttaatttagccatttgatggggaaaaacctttaatagttcacttctctagagtgtttattacagtaaaggaaaactatttaaacttcccaccatccctcctggtcaatgctggtgtccacccacgtactgtgtggtcagagagctgtctaaaggagttacagcaaacagcaaagctatgtgccttcaggttgctccatttctcaaaatagaatcttttttctgccctctctctatcagttccaggagttatcttctattcagaagatagaacatgtatgaccacaagcaaattatttaacatatctatagtcttgggtctcaactgtaaaacagggtatcatcatcatatggaagatttaaagacaacaaacctaaaccacctaacatacagaaaggtgtgatcaataaatactaattcctttcttttcttccttttttaaaaaaaataacttcaaccacttcctagatgttagtctgccctagcaaaatgtccctcctctacccatccaactttttttaagacaaggtctcactctgctgctcacgctggagtgcggtggtgcaatctcgactcactgcaacctctacctcccaggctcaaagcaatcctcctacctcagcctcccgtgtaagctgggactataggcgcatgccaccacgcctggctacttttttttgtagagaaggggtttcgccatgttacccaggctgctctagaactcctgggctcaagagatctgcccgccttggcctccccaagtgctggaattacaggagagaggcatcacgcccatataacccatccaacttctactccacaaaagaaaatgagtaattttcttttactcatattgtaggcttaaggatgtatctggttaagatacatatggccattatacctttcctcaaaaaatacgtattaccaaattaatgtataatagtcttctgaatataaacataaatgccattattttacatgatggttggtagacctcttttcatcaaccaaatctaatgaacaatttgattctgtttacactaaaaaagctagtgcttatgcccaggagataggtaaagagcctagattattatcttgatctcttattagctgtttgacattaagttacttaaactttccattctgcagtttgagtctgtaaaattaaaattatctatctcattgtactgttggaggattacataaattaatttgtaaaaagctctttataactaaagagctaaaaacaattcaacaaatgtgggctattatttctctaccagaatgtctcaactctgttgtctgcttaggcaaagttggttaaaaacgttgttcccagcagggcacagtggctcacacctgtaatcccagcactttgggaggccgaggtgggctgatcacgaggtcagcagatcgagaccatcctggctaacatgatgaaaccccacctctactaaaaaaaaaaaaaaaaaaaaaaaaaaatacaaaaaattagccgggtgtggtggcagacgcctgcagtcccagctacttgggaggctgaggcaggagaatggcgtgaacctggaagttggagcttgcagtgagcccaggtcatgccactgcactccagcctgggcgacagagcgagactctgtctcaaaaaaaaaaaaaccttgtttcctagctcacccaaatcagttcggtcaaaatcctcctgggttctcaggtttaagactaattcagtcccaaaggccctaaactctgccaccctgtttcttcccaggatacatctcttgtaagtacctgagaaacaaaccggaaatagcaattaaagggagagcaaggaaatggcactacatatacaagggtattcaattccctggcacatgccctctattcttttaggcctaagtaaaacaacttataagaacatgattttaaatgaactatgacacctctctctagttgccattccccaatctccccatttcccccgcccccaaaacaattttctctacaattcctcttacctgagttctgaatataatctacatgattactacaatgctactaaataggctgctagagcaaaccacaacattcacaatttaatagcaaattttcagtatattctgcttgcagagcagaccctacaactttcatcaggcttaaaataatttcaaagcaattttgtctaccatggtacaagaaacctttcttcacacttatagaaatataaaatcaaacaggacacagttgccacaaagccttaactaatgagaatcaaaactggtaagatttattcttatgtttactatatactaaacccccttggtttcaaatctatataaactcaatgttttctttacattggatatgtaagcataattttcccagatgcacaatagaaaattggagaaagataattcactggtaaacatgaaagggcatgaccttaggcatgaatttctacccagcttgcaaaataatctagtccactttggtccatgtttagggaggtggggaaatgaattaaagtaccatccatttataacagaatgtggacccatgctttcccttttctagttaaaactatttgttttatcacactgacagagcctaatcgggggctctacaaaggacactccaggtatacccaacaaaggaaaatatttaaataaaaattaatgaatgcctacctcatctgctccttctccatcttgacatatccatccaatgtagttacccctgccaaacaaaaatctgggaatcacccatggcacctcttcccttttgctcaccacatgcaatcagccacaagccctcatcacccctacttccaataaccaattctcttaaatctttcctgccaaaggctgagtccaccattcagctaactggttagcctaaattcacctctattccccttctccacacaagcggggtctgaaaaatacaaatcatgtaagccatgtcaatggcttcacaataaaaattttaactttatataatcaacaaggccatctgtatgatctggcaactagctacctctctggtctcatttctcactacttgtaaaatacactatactttgctctgttctttgagagtcaagcaccttccatttccaggaccttagcatgtcttgtttcctcaatgagcagcaaagccccttctcacccaccaattccttcttatccttcaggtctcagcttacatgtcacttccttcagaagactcaccatcacatccccatcacatgctgcctagatatatccaatatgcaccctcagatcactctgaactttgttcctgtagcacccacaacaatcataaatatatcatctatgtaattacccgcttaaatattaatctctctctaatctatattccccatgagggcaagacaaggattgtatctttcttaaccactggatccctagcatcccagcatgtagcaggcattcaatgtagagttaatgaatgaattaatcaaatccaaactcctccaatgaaggttttcaggtctctacagagcaactcctcccccatttatagaagattatttggaagcttatttcctcactgttttttattttttcagacacagggtctcactttgtcgcccatgctggagtttagtggcacaatcatagcttacccaagccttgaactcctaggctcaacccatcttcctgtctcaacttcctgagagctgggattacaggctcaagctactgcacccagccatttcctcatttttaacacttgctggaacttgtaaggaatacagaaaccttcatttttaagactctagtaaagaacctggactctcatgagctcttaagattattttgcaaactgagtactgaaatgcttctggtaaccatctattgctgtagtcagccaggcttaaaacttcaatcacctatgatgatccctcccgtcattgcccccacacatcacagttattaagtcccattcaatttacctctacatcatttctggaattatctctttttcttctcacattacatttaccatctgtacctataatactatgtcttcaacatatcccattcccatggtgccaccaaagccctatacctttcaacttgtcttctctgtgtgccctgtgctttctgcctatactgacctctcagtaggtcacaatcaaaagaaaactgtctatcaaaatctttgccaaccttcaaggttcatttctaacatcactaagtgccaggcactgttctaaacattcatctttgtcttactaagttcttcactcccttcactctttaaacttcttgaggatacaaacttagcttattcatctgttatctcttgtgtcttacacatttacttactccataagtacttattatatgactttaacactaccataaaagagtacgttcacttcagagaacaaaaacaacaatcacaaggtggcagaaaacactatagcaactatatctacggtaaatgggtaacacccaaattcctgatgcctaagttcctttcttcagaatcccacaacaagcactaagaatgattttcactacctacgtttcttctcaggaaaaaaatgagaagagaatagaagaaaaaaacacaagttcctacttctgccacttgacgtcatgtgcagattaggagaaaagccaaggggcattaaatcaaaggtgttcaacaaatgaaagtttactcagctctgaagtaaattctgtaagaatacaatgaaattattcccacatttctatcccatacatcaagaaataagataatcactttaatggactatgaaaagtaaatcaaccaaagaaatgaatgaaggcattagaagaaccaaagctttaagtcacaagtcaagaaacctgttttgtttcaacttataccagtgctttgctgggttctttgcctcagcttcccccaatgcaaaaaaatggtgatgagaatagtttcattcatgttatttaaagataaacagtcacatttcaaagtagtttgagacctaaaggtcacgtagggtcagctccctcactttaattagaaaaatggttacattagtcctatagctagtttttagcagaagaagggtttagctgagaagacttgggtatcctggctgatgttcctcccaacccaccactttatgaaatgataaagagtagaaaaatgatagccgggtgtttggtgcatgcctgtagtcccagttactcctgaggctgaggcaggaagatcacttgaacctgggaagcagagactgcaatgagctgacatcacgccactgcactccagcctgagtgacagaacaagactctctctcaaatatatacatacatacaaacatacataaaaagtaaaaaatgacaaagcaatttgattgccactttggcaacatcatctgtgtattcttaataaattcaagtaagagttacttttttttatttttatttttacttatttatttgaaatggagtctcgctctgtcgcccaggctggagtgcagtggtgcgatctcggctcactgcaagctccacctcctgggttctggccattctcctgcctcagcctcccgagtagctgggactacaggggaccgccaccacgcccggctaattttttgaatttttagtagagacggcgtttcaccgtgttagccaggatggtctcaatctcctgaactcgtgatccacccacctcagcctcccaaagtgctgggattacaggtatttttattttttttttgagacacagtttcactctgccacccaggatggagtgcagagctgagatttcagctcactgcaactcctgcctcctgggttcaagtgattctcgtgcttcaacctcccaagtagctgggattaaaggcgtgcaccaccacgcctggctaatttttgaatttttggtagagacggggtttcaccatgttggccaggctggtctccaactcctgacctcaagtgatccacccaccttggcctcccaaagtgctgggattacagacatgagccaccaagccagaccaaaagcaacaatatagaacattccaaagtatctaaaaagcaaaacctataaacacactagtaattcattttaccatgaggtcttcataaactccaagaggataaaattccccaggaggggctaggcacagtggctctcgcctgtaatcccagcacttcggtaggccaaggtgggtggattacctgaggtcgggagttctgagaccagcctgggccacatggtgaaaccccgtctctactaaaaatacaaaaattagccaggcatggtggtgggcgcctgtaatcccagcttactcaggaggctgaggcagaagaattgcttgagcctgggaggtggagattgcagtgagccgagatcatgccactgtaactctagcctgggcgacagagtgagactctgtctcaaaaaaaaaaaaaaagggctgggcacagtgacttacacctgtaatcccagcactgtgggaggccaaggcgggtagatcacctgaggtcaggagttcgagaccagcctgagcaacatggcaaaaccctgcctctactaaaagtacaaaaattagccgggcgtggtgacaggcacctgtaattccagctactcagaaggctgaggcagcagaatcacttgaacccgggagccagaggttgcagtgagccaagatcgcgccactgcactccagcctgggcaacaagagcaacattcggtctccaaaaaaaaaaaaaattcctgagggtgagaaaactcactgcaatcaagaccatccaaaattcaaataagcgctttagtgtcactgaactgcatccatagtctatttttacccaaccctgatctgaaacagacttcaggagactattagacaaaacacaggttagcataaattcaaccagaaataaaaacatgaaaatagggaaacaaaatgaagctattaaaaaggtacaagcttagctctaaatttccagatgtcaataggaaaaaagaaacctagtgaacaattacagcacccaggtaataaaaacagactaaaagcttagacaaacatacaattattcttggctgcacatctttctccctgaggtctttataaagaaggcattgcagaatacagagaatatcctcaacaatatttcagtaatcacaatgaaatgttttatgaggttatttttatactgaacttcaagataagcctagagtaacggttgggagaaaaaaaagaaaaaaaaaatttcggggacagagagaaaaaaagaaaggaaaaaaaaaaaaacttaggagagagagacctacataatgtggtccaggtacccagaacactgctgatttaagagcacaattaagagaatttctggaaaaaaaatattattttaacaagtagttactatatagaagtttataagcacaggacccagaaaatgaaaagcaaatttagcaaaatgtggaatgggtccaggaattaaacaaaattgcagggaaaaaaaaacaactctaagagggaaaaacaaagaatataaaagaaagaagagcaagcacaactcagcaagtacattacatacatatgataattaaatgcttttatttctacatctacaattaagaattaaacattaagatatttacggaagcatgcagcttccttcttaatcccataatcaaggagataaaatttaaattcctgtaccttccacagtgatgaaatatcattgtttagtgacatcatatcaaacacaacgtactgcagaattttcaaagcagttatatttccactgtaccaagaaaggaagatatgtgaaatatttcatgaaaattttccaagaagagtttaaaacaaaaagggtaagagtttttaaaccagacataaaatcagtcaaccataaaaattaatttaaaaaactctctctaaagtctcatttagcaatatagtttactgtcaagcataatacaatgataaacatacaatttgctaaacattcaacaacatagaaaaattaatcattctatagctagcatgtaccaacgacacagaatggatcactgtttctcctctgggaggtgggaaagaaaaaaacaattgaattcttagtgaagaaagggattataatttccacagaactatccacttgtaatttaagcaacatcatttaaaaacagctcattccaacagtctcctctactaaatattttcatcagggctgcctagacgaaacctagcccaccactctatcttgggcaaaagagtaaaatacagaccagctactggaagggtggggggagccaaaattcaccagctgggtcaagttcctgaagaattaactaactacattctaggattcatttctcagcatcaaagaacaactttttcttcttctttttaaattaaagcaatgcctccattctcattgtctggtcaactgctgaaaacctttaaaacactcagaagatcaacaaacacttggctaaataaataccagccttaagagtcaacccggtgatcttgctcaacaagaactttaaagtatttatgctttactggtggttttagtttaaatacaatttttttttttttttgagacggagtttcgctcgttgcctaggctggagggcaatggtgcgatctcagctcaccgcaacctccgcctctcacgttcaagcgattctcctgcctcagcctccagagcagctggatgtagaggcgtgtgccaccacgcccaactaattttgtatttttagtagagacggggtttctccatgttggtcaaactggtctcgaactctcaacctcaagtgatccgcccgcctcagcctcccaaagtgctgggtgggattacaggagtgagccaccgtgcccggccctaaatacaattacaatgtgcaaaaagagcatgtacttcagagtactttcagtacccaaatatgatctaacgcatgaaaattcaactttttaaagtatcagttgatttaattgcaagaggattcaactgatcccaaaatgtttcctaaaagccatcctttggctgttcttatacacttcacacccttccaaaccataaaccattatgtgagaagaatgctcagaactaagtagtgaatgaatggccttaaggtttttccaagtcattaaactatcctacagaataagaaaaattctcaggtacttttatttcattggtttgtaacgcttacctacaacagtaccaaaactcagaaatgttttcaatgcaacgtatcctgaaaacaatacgcttatagtgtctaggtgcttttctgttactcaaaataagtgcatgcaatttaaaatcctttaactacagtgtttattatacctctaagcacaaaatatttaacgttaaccaagatatttttaaagcggtgatttaaacagcaaagttagtggggataatgccatgaatattagcaagctgaattaagctactaatccatttaaagaaagatgggttacggaagaagcaagcctctgaagcatttgctttaaatctaaatacagaagtggacttgagcacagtgaactaacaaatgataatagaactaggtctacaaggaagaaattcagcaaaaattatccatttcttccttcaaaatagaaaaaaaaagtttcatttcagatacaatatccatgcagataatataaacaaaattgggaaaccagaaaatttacttttaaaaatcatagctgtctcaacaaccaaacactccagtgaaaatcttcatcaccttttaatacagtcaaggaaacaccaattcttcccacatattcatctttttcagccttctctagtaagccagcctctagcaaagagaaaatgaaagatctgctagtcaattatcctgcccctcttttccaactcctcatgctctctctcaaatctgatattcctaaggagataaatgcacttatttaacatgtatctttaagtatgttataatatagtactgctttatttaattaagtacatagatgctgaattgggagtgacaggaatgaaacgtctctgtctccaccatgccaatttggagtgccacccataaaaagcttatgtaaaattttctcaaaccaacagatttagaaaaaccagtaagatgaggtgggcggatcacgaggtcaggagtttgaggccagcctggtcgacacggtgaaactcagtctctacttaagaaaagaaaaaagaaaaaaattagcctgacttggtggcgggtacctgtaatcccagctacttagggaggctgaggcccgagaatcacctgaacccaggagccagaggcttcagtgagctgagatcgcactactgcactcctgcactccagcctgggcgacagagcggaactgtctcaaaacaaaacaaaacaaaaaacaacaaaaaaaacaacccagtaagaatttattccaaatacatcaatacatttaactcagcttaacaaatctgcttaaaatgggcttttttttttttttaataggaagagagtcaggttgtgaaactagactgtgcttggaggcgatgtattaaatattctgaagcattttctaattgtcagtccttaaaatgtaagaaaatctcaagtgttaaaattgaagactgggtgtgctctctgctgaaagttcaatcaaaagcaactgtaatttcctacaaaggtaactaggtcaactcagcatttgtccctgcttactggaaacaacaaaatctcaacaatcaggccattaacttatcatgtcctatatatagtttcaaaagaaatctaaattcactcttaaagaggtactagtacaattttacacataagatgtctcctagttatttttcttagacttcaaaaggaaattaccaccatttagactacaacaatacaaccctacagcaaaagtatcttccccttcttcactagcatgtatatgcactcatctacccaacatcagggaaaaaacaaacagaacctagacacctatgtacaaagaatcacattctctccataatggcgattcattcattcttccttgtgccaacatttctcaagaatgctatcatgcatgaggtctactcacaggggtacatgacgctgctcgggatcagctctggtcagttcttcctcttcaatatcagactcccctcctgaactactgtcagtgacatctgaatcaaatgcctgttcactgcacctcaagttggctatgccactagctgtaaatctctccaattcttctgaaattgaattgcttttcagaaagttgctaagtccctctgaagtggtggtctcactggcagcttttctcaaggcagcttcagcctttcgagtcagcatcaactggctccgtggtctcaaggattccaagtttggcagtttgctcaaagtcttctccaaaaatccacccagctgatgttgtatatgcctctcaacctgcttggcttgcacaacctgtaagcgcttttgtaatctgcgggcacggctctcaatgtcagcctgtcgccgcagtaaagctgttatccttgtgtcagaatctaaagcactgaaaagaatggaagacaggggagactttttaccctccaatttgacaccccccaagttagagctggagtctgtaccaggtgataatctactgcttccttgaagtgccggctgttccatggaattgacagaggatttgtttgcagtgctattattgctatacaaagttgtgtgttctacatcaaggcttctatgtggaagagtgcaattggtcataccccccttcaagtccccagattcagatcctcccatttcacccccatgaagagcagatgaagtgagagcccgttttcccccattgagggaagtggaattgtcatgatcagaatgtgttgaacttttagtcaatttcttagccaacccatttacaggtgcttgtggcagagctgtctgaccactcgtattcatggttctaagattttctaaggaaaactccaaaactggctgtctccccaacagctcagctcggagttcataggactgagataagagaggatgagatttaaggactgtctgcttgctgaagaccccttgcaacttcaaagactcctttgagggaacagatgttacatcagagcagagataagatgccaccagtggttgcagctttcccaagtcttccttggtaggattatttcggaaatctaggctgggatcctctgcagcaatggcttttcttttggttccgttggcagcaataaggatgttggcgttgccgttattttcggcactgccaggggacaaggtagaggatgggggagccagtttgaaccggatatggtgtgcttcagctgctgcgtcagtgagagcgggcgccatcgcagccattcagcacagagagacaggaagtccagcctctcccgatgccgaggccgaggccagctccacggccccttactgcctccccagagaacagactagaagagaaaggagaaaagaatattagaaatacaagcacttttaaaaacatgtatatttttaacaaaagcactacttgaggctgttgtctaaactgcctccagaaagaaaacactctggagctaactgtaccacagttattctagagacccaaatatctttcatctgggagaaagggggaggcaaaatccctgcacaagggaaggaagaattgcacccttcttgtcatttgttaccacagattgaaaggtgccaaaacacaagttcgattcagagaaaatcacagattgttaaaattaaatcatctccattaaaaaaaaatctctttaagcttgttgaaataaatggatttaaagcaagacacatcaaactaagcaataattaaacagaaaaaaattagtaaggaattcccgtgttcactaaaaaaagtatgccaaatatcacaggtctgtgcatttttctggccagggaatccagttttcatcagcttctcacttctctagaagtatagattatactacaaagctaactgtaccacatctgtaataccaacttgtttcatcagttttcttttctttcagatcaaagtggtcatcaatatcttctctactggcttcttcctctcagcctaggaatttactcaagtatcttctgccctcagtacagcctctctctcatacttaattgcccaaatatctctctttccctttaccccaaaacttctctaagaatagtataaataactgtctctgcactcttcactcttccataatctggatttcaccccctactgctctggcaaaggtgaccagtaatcttattatcaaatccaatggtcaaacctcagtccccattctatctgacttctctgaagcactggacaataccgaccttcttctaattctttcctgatgtccttgtactatcatcctcttctcttcctcctggacccttaaatgctggtgctgcacaaggtcccttctgccctcttctctctcaacaaccactagtatggtgaggtttcttaaccataagaaaaacttctgagctgcactaatcaagattcctataacctctatgttcctcaagccccctgaagctcagaattcactttctccttccagcacactattccgcatcctgtttcattaccttaagtaatgacactgcttttatttagtaaccaagctaaaaatctcagtcatttgcctctgtttgatcccccttgatctatgtggtctgggagccaaaggaaacatacgtaaagaactaagccagttgttctttaaagtgtggtctctggacttctggggatctcacaggctattttggaggttcgtgaaatcaaaggtattttcatagcaatactagaatattatctgccttttacactgtgttgacatttgcaatcagagtacaaaaacaaaggtgaacaaaactgctggtacattattagcacaaatcaaggaagaggcaccaaactatactaatagtcattatactctccactcagtttttctttttttaagggagttccacttaagatgtccttgatgaacagcaaaaattatgaattatcttgagcctttagtgcattttttaaaaatattctttgtgatgaaagggaaagtatgcataaagcactctgctgctttatgaattctcaggaaaaagcacagtacaactgagttgcaaaatgaactagagctttgttcatggaacacgatttttacttggcagaactactgacaaacattatttgaaacctgcttcactagcagacatttccttgcaaatgaacaaagtgaacctgtcacttcaaggaagaccactgacgatatttgctgccaataataaaatctgaattttttaggcaaagattagtgtttttgaaaacttgtatcaacaatcatgaacttaaacattttcccaatattttatttggtgggtgtggatgtgtgtgtgtgtgtttaacagagtcttgctctgtcgccacgctggagtgcagtggtatgatctcagctcactgtaacctctgcctcctgggttcaagtgattctcctgcctcagcctcccgtgtagctgggactacaggcacgtgccaccacgcctggctaatttttgtatttttagtagagacagggtttcaccatgttggccaggatggtcacaatctcctgacctcatgatccgcccacctcggccttccaaagtgctgggattacaggcctaagctgccacattcggactttctgaatattttaaaagccatttctgatttaacagacttgtgacgatattaatgaacgtgaatttttgattgcatataatgtaatgtgtaacatttggaagatctgcataacccagtgaacgataaaatgtccagtgaatgtcaggaaatcatgcatgggtaaaaagtttaagtgcaagacaaatcatttatttgttgctgttattttgaaacagggtctagctctgtcacccaagctagagtgcagcggcacaatcatggctcactgaagcctcaacctcctgggctcaagtgatcctcctgcatcagcctcctagtagctgggactataggtgtgtgccaccatgcccggctaattttttgaatttttgtagagatggaatttcattttgttgcccaggctgctatcaaactcccagcttcagccttccaaactcctgggattataggcataagccgccatgcccagcctgaattacttattaaatattttttaaatttctcaaagtttataagaaaaacaatttatttgctgttctcaacaaattttaagagttaaaaaagggtcctgagaccaaaatgcttgtgaaatcactggactaagcacccccctccctgccccaaatgagggcaatctccaatttaatcaaaaatgcttatctttggagcaataccaacacaggatggtaggccctacaggaccacagtaagcttctttatagtatgacaatttgaatcattaacataaaaatactcaaataaatgactgagaaaacattattcataaaagcaccaatatacatatgggtcgaatctgtcttattgctgtgtgtgtgtgtgtgtgtgtgtgtgtgtgtgtgtgtgtgtgtgtgtgtgtgtttctgagatgtagtctcgctctgtcgcccaggctggagtgcagtggcgtgatctcggctcactgcaacctccgcctcctgtgttggagtgattctcctgcttcagcctcccgagtagctgggacttcaggcatgtgtcaccatgcccagataatttttgtatttttaatggagatggagtttcaccacgttggccaagctggtctcaaactcctgacctcaggtgatccgcttgcctcagcatcccaaagtgctaggattacaggtgtgatccactgtgcctggcctcatataattattaacaccaaaagtttcttgttccagggttgtattttaaccaacactctttatgaactagattttcagggcttatgtagttttctcctgtgggctttctggcatatggcattctgtgtggcacaaattattctatgttgtcttttcccatttctaactttaaatataatactaattactaatatattattaaacattgtgttacagaccagttgacagtactaattcctgttattaaacattgtgttatagaccagttgacagctggaccaatatagttgttaaaaatattttgagtcacttttataatatgcaaagggtttttcccatggacaaacgaaaatcactaccagataattcccatcaattcaatctcctccccttttgaatgtcaatatgtagttgatatgagcaatgcaaggaggcatattatcagtgccagatgattaatacaacatgtgaagagtaattgtaccctactgcctgacagcactacagtaagacttagcaagggcaggaaacagcttccctctgaggacccaagcaagggcacaaatatgctttatgacttacataaaacttaggaaaacccaggctcactccagcacaaatgaaaaagagggtcataattaacatcacatcacagaaggtgcttaagtagtaaacttctcaaagttattctgagattattcaattctttaaagcttacaactttaagaaaaaatgccggcttaaatcccatctactccagctgggcacagtggctcacgcctgtaatcccagcattttgggaggccgaggcaggcgtatcacctgaggtcaggagttcaagaccagcctggtcaacatggtgaaaccctgtctctactaaaaatacaaaaatcagctgagtgtggcggcgagcgcctgtaatcccagctacctgggaggctgagacatgagaatcacctgaacccaggcagcagaggttgcaattagccaagattgcaccactgcactccagccggggcaacaagagcaagactccatcttaaaaaaaaaaaaaaaaatcccatctactccaagacttctctgaaatgatgtctatgaacttgacattaacatatacacttcaaagacaatagtttatttgatttgcactttatccttggtctcaatatccccataggatacacagcatagtgtagttactaaaacaatcatctaagtaagggggtgggggaggagagagagtgcagagaacaggaaaaagtgaccactttttccgaaaaaattcccattcctaattcctaaatcttgagatttctataccaaagaaataccatttattgacttgacatacctttattgactcgaaatactatgctaagattcaacattactcccaaagatattcataagtaagaggagcactgactcaagtgagcaaatctcagttcccatcctggctccacctcctgtaggttacttaactattctgttctttaagtctcctcatctacaagtaacagagccttcccgacaaggatgctatgatgatgaaataagatactttcaattacttggccacgtacctggagcaaccacccagtattatttgcacttttattacactggaaacaaaaaggaaacatagaaggaatgaatttccatggctttttaatgcacctagtttgcaattagctacaattgccataaaccaccacctaagtttagtactttaatcttttccctgttatgtctagacttacttttaatatttcatgatgttgtttataataaaaagaaaactgaatgccaaaaactcggttaaattattaaatatccatacaatggaatactgtgcaaccctaagtgtggcagagctatatttactaacatagaaaagtgcttgcttcattattaaatgaaaaaaagttacaaaacaaaacacagtatcatctcaattttgctttaaaaagtcattggttaagattcttttgtcttttgtttcttggcttatgtaaagtctccaccataaacatgtattacttctataataaaatggagagaaacaaaaagaaaacaatggaaattcttaaagagccaataactaagtaaaacaaaatcacagtaacattctttttttttttttaagagatggagtctcgctctgtcacccaggctggagagcagtggcgtgatctaagctcactgcaagctccacctcccgggttcacgccattctcctgcctcagcctccccagtagctggaactacaggcgtccgccaccacgcccagctagttttttgtatttttagtagagacagggtttcaccatgttagccaggatggtctccatctcctgacctcgtgatctgcccaccttggcctcccaaagtgctgggattacaggcatgagccaccacgcccggcccatagtaacattcttaaatttaatatacagagcaaaacaatgattcctatcccacttgacccctacaaaattcaaaaagcttcaatctttgacaatgtaaagcagggaaagactgtcaaatttaagcagttcttagagaagctcagggctaaaggaaaaaaaaacgaaaaacaaaaaaaggaagcagttctacacaaacagcacaacagcctatctgataaatcatctttctccaaagaatacaaagccttaaaagctataattaactgattaatcctcataacaacctgggcagtagaattagggctgagattataatttctaatttaccggtggggataaagtcagactgtacattcagaataaaaattcaagccccaaatatcccaatttttagttcattcagttagtaaactataatctgacaaatacagatggagctgctacacctgctgtcactcacacaaattgagattctgcagtaagcttgtacagataaaagaaaaggctacctattcaaggtcatttagctataaaaggttgggctagataatcaatagtttctctctcagtttcaaagaagtattttagggtctggaagatgttaaatgcactcagcaagcaaatacatttcggaaaaacttcccagatggagactcacaacgtattgcatcatactgaatatgcaaatgtttacctttaccaaacttttttaacaagcacctttttccattacatctattaatatcaagcagaaacatcattgtgagaaatacaagttgggataaagttcaaatatgtgacctctagggtcccttcctatgttaattctattattctaaattgcaccatcggtccaaggacaaacttctacctaacacaagtggcacttgggaagcaaaaatatacttctaggatagagtttctcaacctaaccactaactgacatctcacgatgagtaatctatcacagggggctatcctggcagtagcatgtttagcaacatctctgttttccacccactagatgctagtagtgcccttctgaaaattatgacaatcaaaaatgtctccagacatgtcaaatatgggagctggggggttcaacatcacacctcccaacagagaaccatatcctaaagattatacacacacatatatatactctttcaaaagcaaaacgtatccagctgcttcaaatactgtaagtcagaactaactccacacccacaaatgaaaacctcatttattcccagtcaatttccaagacaagactccagatacacaagaataacctggaagcatccaccttgcaaaaatatttagctgcagagaacaaaggggaaggaataggtcatccaggtggccaacaagtattacaaccacacttgcactgaaagcaaaagcaaaaatcagatggggaagaaaagtttgcccataatgtggcttctactaacctcttccttcaccattacctcatttctctacacaaaggacggaaagaaacagcaggaaggatgattagggaagtgtccatgaagttgccgcaattttagctgagacttgaaaattagctaaaatgtcattatgcaaaaggctaggacaagagaatggtaatgtggcattctagtgagaggaaatggcataagaaaaggcaacgctgtgtgggaaaaggcgacattctgaaggttaaaagaaatgaacaatttgggccgggcgcagtgactcatgcctataatcccaggactttgggaggctgaggcgggtagatcacctgagatcaggagaccagcctggccaacatggcgaaaccccatctctactaaaattaccaaaaattagccgggtgtggaggcgcgcacctgtactcccagctacttggaagactgagacaggataattgcttgaacccaggaggcagaggttgcagtgagctgagatcgggccactgcactccagcttgggtaacaagagcgagactccatcttaaaaaaaaaaaaaaattaacaatttgcttaaaacacaaagcatattttaatagaggaaatagtagaatgaaggtggaaaggcagtttgaagccagatccttaacggacagcctttaatagccttaattcagacttaaagacagtagaggggccaggcacagtggctcacgcctgcaatccccgcactttgggaggctgaggcgggtggatcacctgaggtcaggagtttgaaaccagcctggccaacgtggtgaaaacccgcctctaataaaaatacaaaaaaatcagctgggtgtggtggcgggcacctgtaatcccagctgctcgggaagctgtggtaggagaatcgctgaaacctgagcggcagaggttgcagtgagccgagatcgcaccattgcactccagcctgggtgacaaaagtgagactccatctcaaaaaaagaaataaataataaaaataaaaataaaaaatttagccgggcatgatggcaggtgcctgtagtcccagctactagggaggctgaggcatgagaatcacttgaacccaggaggcagaggctgcaatgagctaagattgagccactgcatttcagccagggcgacaaagagaggctctgtctcaaaaacaaaaacaaacaaacaaagacagcagaggccaggtgcagcggctcagacatgtaatcccagcactctgggaggccaaggcaaaaggattgcttgaggccaggagtttgagaccagcctggtcaacatagcgagatcgagtctctgaaaaataaaaagtatatacatatatatatacacacacatatatatgtatatgtatatataaaataatgacagcagagtatcattaaacactttttaaatgggagtgaaacatcagactgtgctttagagagatcagttgggtaggatggattgaaagtaagtaaaaaggcatctatagatggcaaagaccaataaaaaagctaccacaataatccagataggatgcaatgagaacttcaaccagaaaataatagtcaaagtctctaccaaagcttaaatccagaaatgtgaaggggccagtctaacaaaaaggccaaatatatgacaaacaaaaacatgatggcttataaagaatggaaagaaagctctcttttccttcataatttcatctcctttgtgacgaaatccttcttttctcacgaagcttttcaggtttggtatgtcctctctatacttctaacactatcagtctagcccaggtcctcatcagctcctgtctagattatcacaacagcttcctgactagtgcctcagtgccccaaactatcctttacctttttatcatctcactttcctactctgaacaagttcctcacactttttttttttttgagacaaagtctcgctcttgtcccccaggctggagtgcgatggcgcgatctccgctcactgcaacctccgcctcccaggttcaaacgattctcctaccacaacctcccgagcagctgggattaccggtgcctgccaccacagccagctaatttttttgtaattttagtagagatggggtttcaccacgttggccaggctggtttcgaactcctgacctcaggtgatcgacccgcctcggcctcccaaagtgctggaattacaggcatgagccaccacacccagcccctcacacctttttaatgagttcaaattcttcaagatgaaacttaacgtcagggcaagcacatcaattgatacggacccagaactccccacagattcccaactccgtatctttgcctatgttgctacctctacctggaaggtccttcttctactttttttttttgtccccaaacttactaatttttcaatacatagcatctccacaaaaacttcttagactcttccaattcatatcactttcttcctgcttgaattgtataatgcacttaaagtcactgtcattcagttcaaattatctgaattttccctaattgttaactaattctatttccaagacaagcaaaattccttaacagcacccttctttagcgtgctaactttatcgagagcttggtacatagtaagtgctgtaagccctaaatgactggactagagaagtcaaaaaggcctcgtgggggttgccctcaagtgtaagattttactaagaagagaaaaaggaggaaacacgaatcaaaaaattgacacaatcaaaataatgggaaagacgtggggcatgatccacaaaacaacttgcatgaatcaggtggtatatgtacagcttctcaagagaaagagaggaaaagaacagtgatttgtgatgaagtactgcaagctacattatggaatgcactgcaaagtatttattttacatatgaacaaaagtagatttgttgtggaatacaatggggaaggagagacaaaatttttactataaaacaaagagataatgtgtgtcacccacaagaccattatcaatttccttggccaacagggcttcttaactgaaaaagctttatattactaaaggaatcattcctgagtgcaggataggttattacaaatgttgttcactaacattaattagcgttttactatgtcaatcactatgctaagtatcttacatatattctcttaatcttcacaataacaatgtaaggtaagtactactgtcctcattttatagatgctcaaagaagttaagtaatttgcccatgatcacacaactatgaagttgcaggggcaggatccataatgctaaagccgatgcttttaactactacactagatagtttaaggcttaaactgaaacggtcttaactgcctgacagtaaattctgaattttagtctttagaggaaagtcagtcaaagaacaccaactacctactgagtatctccaataaatattaaaatgcctagagtattcaaagcaccacagtaagtacatacaaggatgacaagcagcagtaaagagagacactactgtgtgatttgggggatggaggcaatcctcatacaggctgagaagtaggcggagtcagaaaatgcttttcagaaaaaagaacatccaggctgaaacctaaagaatgagtaggagctgggtgcagtggcaggcgcctgtatttccagttactcaggaggcaggaggatggcttcaggcaaggagttcaaggccagcctaggcaacatagcccccatctaaaaaagccacccaaacaaaaacactaattttttttttttaaatgatggcctaccatggtagctcacacttataagcccagcaccttgggaggccaaggcaggaggatcgcctgagcccaggaggagtttgagactagcctagacaacacactgagacccagtctctaaaaaaataataattagctgggcatagtgggagggtcacttgagcctggcgggtggaggtcgcagtgagctgttatcacgccactgcactccagcctgggttacagagcaagattctgtctcaaaagaaggaaaagaggagaggggaggagagaggagagaggagagaggagacaggggagaggggagaggaggtgagagaagaaaaggagggaaagaaggaaggagggagggaaggaagggaaggagtagggccgggagaggtggctcacgcctgtaattccagcactttgggaggccaaggcaggaagatcacttgaggtcaggagtttgagaccagcctggccaacacagcgaaaccccgtctttgcctgtaatcccagctattcagaaggctgaggtacaagaatcacctgaatctgggaggcagcggctgcagtgagctgagatggcaccactgcactccagcgtaggcgacagaatgagactgtctccaaaaaaacaaaaagaaagaaatgagtagaattcagcattgcctatacaactacttcaagcatcccatattcaaaacccattccctgccccaacaccaaatccaaaacttcctcctgctcctcaacattgtctatttgagttaatcatgacctcaaatcaccaacttactttttaccataaatatttaatttaaacatctactaaatgccagatacaagatagtaaaatataaattaggtgtgaaggtagcctagcttgataaagtactgtatttcacctgaaggggtcaaggaaggcttctagaaaagatgacatactgactgaattttgaaaggtgaggtggtgcacagagggtgagggttggcaacacacagaatgacaggcacattcattccatccttggtgccaatgccctagtgcagaacctcattatgtactatagtaattcaggcagtaataatctcccaactattcttccttcttcctgtctcagcaagcctctaatctagcgtccactaccaaaatgattattagaaagggaagaaaaaaggaaaggagggggtaaacctaaatctaaccatttaaaatctttcactgactctagagtaaggatgagtccaaattccccacacaccattatctgtcccctttttacattagacctcatctccagcctgtcctcactgcagccacctgaaacatatgtttcctggctcttctatgcccctgcacctttactcatgctactctttcacggttcagctcaaggttacatgctctttcaagtattccccattactcccaggttgaggtggggtccctccctctaggctcttacctgcacccccatgacaccctggctattgctcatggtacaatataaactcacaattttgtcttgtctctttcttccccagagtatgtacttttttttttttttttttttgaaacagagcctctcattgtcacccgggctggagtgcagcggcacaatattggctcactgcaacctccacctcctgagttcaagcgtttctcctgcctcagcctcctgagtagctgggattacaggcacccgccaccacatctagctaattttttgtcttttttagtagagacagggttccaccatgttggcctggcctgacctcgtgattcgccagcctcggcctcccaaagtgctgagattacaggcatgagccgccacgcctggccaactatgtacttcttaaaaaaggagggttatagcttgttttatctctgtcccctacaagcagcacaatgcctggcagacagcagaccaacacacgttaagcaacctgagcattctatgctaaacccatcagatgaagatccattaggacgttaatggggatgtctgaagtgatcaaccacctaacaagaagaggcatcaactgaacctaggataggcttcacccactacaagttccagttatttacttgaccaagcacctgtacccagactaggaaactttttaactacactttttaagctattattaaatgtggttacacagcattataaaggtaatagccatcaaaatcacaaatgtaattgctcaaacttttacccagcaactgcacttctagaaatctattcaacagaaatattctcataggtactcaaagatgtatacacaatgctttcactgaagaactggaatacaaaaaaaaaaccctaattaaaaagatcaagccatataacaagtatgatcccattaaacatatatatatacacatatatatacacacacatatatacacacacacacacacacacacacacacacacacacacacacggataggctaggccccatggctcatgcctgtaataccagctactctagaagtcaaggtgggaggactgcttgagcccaggaattcaagaccagcctagacaacatagcaagataccatctcaagaaaacttttttttctgaaggatgtctatatatcaaactattaatggtgttaatcctacttctatgctagcactgaattcaaatttcctaccactctttagctgacaaaagacagaggaaaaaaaaatcatactttttatcatatctctttccaacaagccctaatggttggtgtaagtgctcctgaacaatcctaaaatcagcgacttctggaagattttaagaattctaaaggaggccgggcgcggtggctcatgcctgtaataccagcactttgggaggccgagacgggtggatcacaaggtcaggagatcgagaccatcctggctaacacagtgaaaccccgtctctactaaaatgcaaaaaaaaaaaaaaattagctgagcatgatggcgggcacctgtagttccagctactcgggaggctgaggcaggagaatggcatgaacccaggaggcagagcttgcagtgagctgagatcccgccactgcacctccagcctggggcacagagcgagactgtgtctcaaaaaaaaaaaaaaagaattctaaaggaaacaggttattctgggagggtccatggccaaattcctgagttcccactgaaacctaccttatacctttagagaaaagtcaattaatgacttttaaaagtacatttttccaatgccaataaaatgttaagtcaatactaatatccatttttcattctcttgggaggcaaggggtaaggagtaaatcactaagtgcaaaaaaatacagtccaattttttggagacatgcttaaggtcttcaaagagcttcagttctccatggtaacatatggagagtttaatgaaactttcctgacagttcaacttatcagactggtatttcttttttcttttttttgagacgaagtctctctctgtcgcccaggctggagtgcagtggtgcgatctcggctcactacaacctccgcctccaggttcaagcaattctcctgcctcagcctcttgagtagctgggactacaggcatgcgccaccatgtccagctaatttttgctgtttttttttttagtagagacagggtttcaccatgttaagccaggctggtctcaaactcctgacctcaggtgatccgcctcggcctcccaaggtgctgggattacaggcatgagccaccacacccagcccaggctggtatttctatgaagtgtctctcctatactagaaaccagaaactagctacagtacttagctttgagcctctttcccttcacaccctctggtggaggtgctaacaaacagtcacaaaggccaaataacaagcagcaagaggaaagtctagatatgagttcttagcaatttttggtttaacatcctaacaacaaaattgttattcctcttttttattccctaatacttaccttccaactgaatttaaccaagtctaaccttaagctctcccctttttaaaaaggaattaaaaggtgagggactccattaagtttgatgtcactcaagcaactttttccaaataagagcagaatctgctgtaattaaaattcagagtaagatctcattttggattcctggttcaggttacaagaaccagagtttttaaaataacatttagataaaactgcactcaatctacctccactttgcatttcctgaccctcaaaatcttggaaagaaactttaattctaaaaaaattacagccaggaaaaaaaagggtaagttcacagtcagcaacaataaaatacacagctaaataatttcctggtagagggctttcaaatgttaacactgtggaagcagcttaaaatcttggaaaagcaaggcttgcagaaagtaacatttattaaacaactattttgccgcattgtgctactaaatggggaaggtctactctatttaaaaggtctcttccaccttaaagggactctttgcataaaggtttaaaatcttcatataaaatgtttgatttttttctttcagactgcccaaactcatttgtttttgattcataaacatgagctgtgttttctactttggtcaagtcagtttccgcactctattttagctttacctttattctaccaaagacaagaaaatgcttaataaaaaaaaatatatattgcagctctttttggagtccaagtattttggtaaatcacaccttttggcttattttctcctatgtattttgttctacatcctaaaaggcacatggcttaaaaaagaaacaaataataatagttaccccctgccatactagtcatctcctatgacccacaatcctcccctcaatctgcaagtgacacccaaggatatcacttacctcctatatcttctgatagccttcaaacgctggtgaactctagtacagtggatatttgtcttttctaattcatactgtcttctacagccatagtgtggttcaactgagttttgatctcacatttcagggaatgggaagtactgatgagggaaacttatcttgtcatataaactattgttctgcacaacttttagtatgcccagaggtatatacgcaacttatcagcatagaaactgtaatttaaacatacatcttcagaagcaacatgagaactaaaaaagtcttaaaacagacttccaagaaacagttatgaagtccaattttaggaaaaagacatgatccaagtgttctttgcactgacacagtaggcaagccaggtgtctggggccattttacttaagaacctgccctgtactcctttcttaaggtaagtaagtaaagaggcactaaggtaaaatacgcttcccaagacatagactaatcaaatcactcaaggcaggaacatttaaaatgaagaaagagtacaacgaaagctgctttaaaactctaaataagacaagcaaggggccaggcccggtggctcacgcttataatcctagcactttgggaggctgaggtgggtggatcacctgaggtccggagttcaacaccagcctggccaacatggcaaaaccccatctatactaaaaatagaaaaaaattagccaggcgtggtggtgggcacctgtaatgccagctacgcaggaggctgaggtaggagaatcgctagaaccctaggggtggaggttgcagtgagccaagatcgcgccactgcactccagcctgggcaacagagcaaagattgtctcaaaaaaaaaaaaaaaaaaaaaaaaaaaaaaaaaaagacaagcaaggttatatgctcccgttgctcaacctactcaggaggctaaggcaggaagatcacttgagccccggagttcaggcactctaaactgtagcgcacaatgattacatctgtgcacgccaacctgggaatcacagcgagaccccgagacctcgtctctaaaatgaaaaagaaacaaaatctctaaaccactcaataagatttactctggggcaatcaacagacaaccacttattcagtttaccctagtccctcccctctaaactcaaggaatggaacggagaggtcctttgttggggggtggagagggacaataaaactatatacatctatctagcaagaaagtcgcttatttctgtgtcttaatggactcaccaagaagaaaaaaatagcccctacccatctccccacaagctgaaaaaacataaaaggaatacgcattactctttaaacatggcgtttactatgtttagaaaatccagtgtggattagtttggtgttttatagcacattttaaaaattgcttgtctaggctaagcgtagtggttcatgcctgtaattccggcacttctgggaggccgaggcaggtggatcacttgaggtcaggagttcgagaccagcctggccaacatggtgaaacccccgtctctactaaaaatacaaaacttagctgggcatggtggcacacgcctgtagtcccaatggcacatgcctgtagtccctgctacccaggcggctgaggcacgagaatcgcttgaacctgggaggcggagactgcaatgagctgagatagcaccactgcactccagcatgggcgacagaacgagaccctgcctcaaaaaaaaaaaaaaaaaaaattgcttgcctgatataacaaggtaactaagctttactcgcaaaggggcctaatcagaacctctcaatactaaaataccttctcaaacaaccacaacacccctatgtttacagagtacacaaatcaggtcataacgaacagaacaaacctaaaacttcttattcactttaaaatgcaattaaaacctgtggtcaactcaatcctctacagaagacgcagagacactggttacaatgtagcattactagagatggaagagtagccttagtgacagtgaagaaaaaagtttagtatagttacttcactttcttctcaccttgatatgagttcacaagtgaactaaggcctactcattttctaacttccagaattttcctcaacaggaaacactcacgtaacaaagagtgctctgcaggtttaaccagagaaataacatgtgtaggcaggaagaaagaaaatcagacaaaaatttaacatctcacgttggtaaagcaccaaagtcaaatacgaatgttctgaacgtggctttcagaaaagatgcaagaaaacttctaaaatacttcacttcagtggactcatatagatggaaagaccgaaaatcccaccctaccataaaggctctaataattcttaactgatcattcttttaactggtcacaatcacagacactggtatatactcaaatgaggtggccatcagtgacaaccatcttcaccataatatagacattaagaacctttgtaacatttaatgtttccctccaagtagttcaaaaaataaaaagtcaatcacctcaaattatgaggtactaacaaatacaccaaatatgctaaaggtcgaaggaacggcacactttgttgcataaacctagtggaaatccaattcagaatttcatgactgaaggtagttattccacatttataatacattttttaaattcccaagggatgagcatttttaccttgccttatttttagaactacacatcacactgcacatatcacatgacatgatgtaactgttagcaaagaaaatggtccaaaccattgacaatgtacatggtaaatcaggatcaatgcatactcaagaaccacatttcgtatttactttaaaaaaaaagtttcttaattcaaaatgttttttcaaattgaaaaaatgtctagtaacctatgtagaaaaaaccagaaatgtacttcgtattttataaaataggagtttacccaattatgggaaaaactgatataaagaaacagataaaggaataacatacttctaaaactacaggattaaaagtaaaaattttctagatcaacaccgaaatgctaataaatacacttagcattaggcacaaaacaattactactcaaaagtattcactgttgataggttaaaaaaatagttttaactgacaacgcctgtagacaattgaaattttctaaattggtcagacagcatgctagaaaaggaaccaagtagagcctataggaaaggggaaagggaaaacacacccacttaagcctttgtaaatagtggtcctttaactgacccaaaaagcagagaaaacagaaattacagaccatcctgacaaatggaaaacatattctaacgtactagtttccatacttgaaaggactttcaaaatgaagttcagtagcaatctataactatatcatgattatgcaaggcaaagattatgtaattttatcgtttattttaaaatgttctccgactctaaaactaaaacaagtaaaacgttttgatctctccaaagcgaaaaggaaaggttcctctgagctgcaatttaaaaatataaacacacaccccaaaacaaacaaaaaaacacaatgattgctagccacgtgacaaaggagatggcaacaccaggattgtgaatggaggggagggaggcgaggctggaggaagagagatttctcggaactttggggaccgcggcagtcggtctgccgaccctaggagcactaaactccagcccctacgagttgtgcttctaacaccctcaagtacagttttattaataagtcacagaaaatgctccagtgacctccaggataaaggggggtgggggggaccgaggaaaaggaaagagagcaatttaaagtggcgccatcatgtcaccccttctcccctaaagcaatcagtaagcaatagttaagtagcacgtttctctataaatccacattgggattccaacattggaaaacgaggatttttaagtaagacacgggagtagcgctgtttatcgtatggaaaacaaactatttgctaagaatcaaaagaccgtcagccggaaaacaggcccccaaaaaggcagttaagattccaactcacttaaaagcaaataaatccctcttcctctttagtttaaaaaaaaaaaaagtccgcctgagggagactacatctgaaaacgtaagtgacctgaatttacaggcaacaaaaataataaatgaaacaatcagagttgtgatacaaaccgtgcaacgcgccaagatgtgtgtttcgagcagagaaaggccttttgcagtcaagagaagttcaaggcgagagccagagtttgtttggggggttcttttacgggaataaatcatgttcttcaggccgcctttttaaatagaacgccaaaggaaaagctggcgaacgaggcggcagctcctggggaagggcccccgcacacccccgcccttggggcgactcccagcccggacccgcagcagggaagcccggagaggccatttaaagttccgggggatttttctaccctgccctgcctttctagttacaactaacaaagagagagagaaatgggagccacagggagagcgaggagaaggagaaagggcagcaggaggaggaggagaggagcagcagcagcacctaccacgtgatggaggagcgtagcccgggcggattcagccccacaaaatgggcgcagtttgcaaacagccccccggcctgggcgccgagggccagcggcgggcgggggcgcgcgacggcggctccggcccgggcccgccgctctcctccccccgacgcccggagccgccctgactttccgggcgggggggcgaggcagagggggaggggaaggcggcggcggggagcggctgctttttcttctctttcgggccctttcccggccttgctccgcaccgacggggcccgagcacggctggagaccgcagcccggccgggagggcgggcgggcgggggcagagagtgaaaccgcccccccgccccgcacaaacaagcaccgccgtctgcagcccgaacccgcacccaggccgccacccccggccgcctctttccagccggggagcgcgcttcagccgccccccgcgccgccgcggcgagacgagtcggcttcgctacggtgctcggttctcccgccggctcggcgagcggtggcggcggtggcggcggcactgggaaaatggcggccgagctccttttccctccccccctttaatctgaagcggagggagaatggagcgagcgagcaagcgggcgagcgccggggacacggggaggagggacagcagcgcctccgccggctgcggctgcggcggcgaagggccgctccaccccggcgcgccgccagggggcgcccgccgcgccgcccccgcgggccgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaatgattgagttctaatgttttttagtatttgtatcttactttatgattacagtattttatataactaatcttattatttcttcctcagaaaagacattccatggccaggcatggtggctcacacctataatcccagcactttgagaggccaatgtgagagtattgcttgagcccaggagtttgagaacagcccagggaaaacagcaaaacttcatctcttcaaaaaataaataataaaaaaatttagccgggggtggtggcatacacctgtagtccaagctactcagaggctcaggcaggaggatcacttgagcccaggaggtcaaggctgcagtgaaccatgatcacgccactgcaaaccagcctgggcaacagagcaacaccccgtctccaaaaaaagaaaaagaaaggaagggaggaaggaaagaaagaaaaaaggaaaaggtgttccctcttacacacagctctgtatccatccatctttgtctgtgttctctctacctagaaaaagaggaccatccctcattaccaccattccttgttaattcctctctccaatccacctacaactcatgttatcctcttatattccaccacaccactgttatcgtctactcacttcacttgacaataatgtaggctgggcgtggtggctcatgcctgtaatcccagcactctggaaggccaaggcaggcagatcacctgaggccaggaattcgagaccagcctggccaacatggtgaaaccccgcctctactaaaaatacaaaaagtagccaagcatggtggtgcacgcctgtagttccagctactcgggaggctgaggcatgagaatcacttgagcccggaaggcagaggttgcagtgagccaagatcacaccactgcactccagcctacgcgacagaaggagactgtgtctcaaaaaaagaaccaataatgtacagagttggcactacattacccttggttaaatgctgtctgtaattcctctgagtttgttttcatataccagtcttgccacctcaagccagcctgaaagcccttgcaggcaggaactgtggttgttctaatttaagatctgtaactcatctatagataataaacgtattccaaaaaggcactctctaccttccctgccacagaccttctaaacaagccagaaattcctaaacagaataatctcacaaattcagtacctcgtatgtccaaactaatctcaaaaggacaatgaataactttttttgcacttaagaaaaagcaattattatatattaactcaggacaagttctaaagcctaggccatttagtttcaaaagcacaggggcccatttttttggttacttacctaggacctagcccagggcctggcacaaaagagacacatcataagaactgactgaataaatgaaaaaggtagagtgtagtacttaagcacacaggacctaggtagcccgattctaatcctgcctccctcacttattctttgtgttactttgggcaaagtacgtattctgctctgtaaaatggagatagtaataccacctacctcttaagtttaactattattattagtgaatgaagctattttccacagttctaaactttaaaggttaaaatctgagtgaagcaaaaatcagcacctctttcctaattcaaacttcaaacacctatctacttaggacttggacctactttaattaaaaaaaaaaaaaaaaaaaaaaaaaaagcctggatgtggtgactcacacctgtaattctagcactttgggagaccgaagcaagtggatcacctgaggcctggagtctgagaccagcctgggcaacatggtgaaaccctgtctcaactaaaaatacaaaaattagcctggcattgtggcacatgcctatagtcctagctacttgggaggctgaggcaggagaatcgcttgaacccacaaggtggaggatgcagtgagccaagatcgcaccactgcactccaacctgagtgacagagcgggactctgtttcaaaaacaaaatccctgtctagactctagcaaacaatgttttcattcatgaacttagataacactatatataaaaatacttttagctccctaaaaacatattctgagaatgattatttacaatcataaatctaatgccacattaaatacttcaaatacatttaattcaacaaaaatctagtgagtacctattaagctcaagaatttattctagatatcacagaaatgaacacataaacctatgtaaaaacccatattaaaattataaaagaaacatctttaagctgaaactgaggcatgttctcacattaatatttaaccagctaaatattaaatagccagagtcaactaaaccaaagttaagaaatttaagtcaaaaaatttaggatgtagaaggaatatgttcagccgccacattttattagtgtgaaaatgaggccaacagaaagaagccagttaagagattgccaaagcgtcaaagctggaatcagggtctctcagtcttcaattctcacttttcccacttctaattcaccagtgctactcaattggtgaactggatgtgcaaacatgctaaaggcattaaacctaaaccatactacctatttcacagtgtcacaagtataaagatttagccaaatgcaagtagaagaaaatcctcatactgattacaatgactacaaagctcagaaatcaagattttttttcattaaatggaggccttagctgattcaaaatatcatacagtatttttatgtactgactgaatccagtagaaacaaactttcagtaagattaaacaaaagcatttcataaatggcaaagtattacaagaatgcatagcattccttcatttcaatccaacctaacaagatattttcctcctcatactactgatacaaactgcaggatttacataaagatattattttgccatctcaccacagaactgacccaataattcatacaaaagaaaaactaattattaggcagcctcctaatttaactgtgttagtaatgagaacaatactgttgtaggttaaacctaaatgtactagtaagtctagaaataatttactttaggataattcagaagacaacattaaagctcagctgaatacaattatatcactgaaagaaacaagtcaggttctctcaggccatcagctattgttaaaatctaacacccaagattgttggtcttctccacagtggtggatttaatagcagctaccagcactcatttctagtgcaagcagtttaagcaggattttatacgaacattttaataaagttcctcaatgagtttacacacacacacacacacacacacacaccctgattattttggtgaattttagttaattctaatgtttttaactttagaatattttaaaattctcaaataactagaatgtgtgaacgttcaatgaccaaacatagaaggagtattctaatatactgattttgcagattaagcaatctacgcaggacccaaactttttatcagataataaagctgagtgtcagaatttggccaaaatgtaccaagaaactacctgagttcttttccaaaggaaacataaaggtaaatatgcagaacttcaaggcagctgtgagcagccaagttgtggagggcctgacaaaagtgagtcagaagggaaaatgttcaaagagaaaaggaggcagcaggtgtacaaggcaaaacacaccttaaaaaatatctttacaggctgggtgcggtagctcatgcctgtaatcccagcactttgggaggccaaggtgggcagatcacgagatccggagatcgagaccatcctggccaacgtggtgaaactccgtctctactaaaaatacaaaaaattagctgggcatggtggggggcacccgtagtcccagctactcgggaggctgaggcagcagaatggcatgaacctgggaggcggagcttgcagcgagcggagatcacgccagtgcactccagcctgggcgacagagcgaaactctgtctcaaaatatatatatatatatatttttctttttacgtcagttgctgattctaagttatgatgcaacttgtaaaatcttgttctgatggcatggcaaacctagggactttggaagatggcagacctgtttcctccaatgaagcagcataccattcttggaaagggaattactttttttttttttgagacacagtctcactctgctgcccaggctgccaggctggagtgcatggcaaaatctgggctcaccgcaacctccacctcctgggttcaagcgattctcctacctcagctgcccaagtaggtgggactacaggcgcgtaccaccatgcccggctaatctttgtatttttagtagagacggagtttcgccatgttggtcaggctggtctcaaaatcctgacctcaggtgatccgcccatctcagcctcccaaagtactgggattacaggcgtgagccaccacgcccagcctagaacattatttttaacccactaattcttggattcttgaacttgtttctatgtacactcaggaacatacagctacaaacggggagtaaccaaagccactgaatatatgcaggagcaacttttttggagtatcaatttaatcaaggattatagtaaaatcagatatacttttgttaaaataaacacaaatatattacaggttgaccatccctaatctgaaaattcaaaaccctccaaaatctgaaactttttgagtgccaacatgacacctcaaatggaaaattccacacgtgacacctttgcttctgatggttctctgaaccatcagaaacactgtttatttcaagaacaaaattattttaaattttgtataaaactggtcggttgtggtagctcatgcctgtaatcctaacactttgggagaccaagatgggaggatcatttgagccctggagttcaaaaccagcctgggcaacatagtgagaccctatctctgaaaaaaaaaaaaaaattaagtccaggtacagtggctcaggcctgtaatcccaacactggaaagccatggcaggtgaatcacttgagctctggagttcaagaccggcctgggcaatgtagcaaaacctatctctaccaaaaacacaaaaaattagccaggcatggtggcatgcacctgtagtcccagctacacaggaagccaaggtgggagaatcacttgagcctggaaggtggaggctacagtgagcagagatggcgctactgcactccaacctgagtaacagaatcagaccccatctcaaacaaacaaaaaaattagctgggcttggcaccgtgcatctgtaccagttagtaccagctacctgggaggctgaggcaggagaatgacttgagcccaggagttctaggctgctgtgagctaggatcacattactgcactccagcctgggcaacagtatgagacatcatctcttaaagaaaaaggtaaaaaaaagaaattatcttcaggctatgtgcataatgtgtacatgaaacatagaatttcatgtttagatttggatcccatctccaagatagtacattatgtacatgcaaacatcccaaaatctgaaaaatctgaaatccaaaaaacttctggtcccaagcatttcggataagggatattcaatgtatacagagcaaaaggcagaattctcactgtttcaagatagaaaaggagtcctcagagagatatgtcctgcttgtaacaaacagctccaaacagccctagaccctgaaaagtactttaaggaaagataaagaggtactggtttagaccatttatagataaatatgcatggctaaaacccctgaatgtaatccttccaggcagaagataaaacctgaaatctaacgtataaattgtcatgggtacaatattataaaagagaccataagttaccgagaacatgactggaattcaggaaatgctaaaggtcctgtcttatctctgtaactcatttacaaagaaatcatgtatgattttctcaactgcaatcttttttgtttctgaattagactgacaaaaattatagaatataatattcaatattttccaccatattccaaattctcactatcacatttaaacacaattttatctaatgaaatgtgtcccaaatgaaccaactttaaccagcatcagaaaaaataaaataaaatagttaaatgaaactgtatcttctttggtataagaagtccttcaggccagacgtggtggctcacatctctaatactagcactttgggaggccgaggccagtggtttgctagaactcaggagttcgagaccagcctgggcaacatggtgaaaacccgtctctactaaaatacaaaaaattagccaggcgtggtggcatgcgcctgtagtcccagctactcgggaggctgaagcaggagaattgcttgaacccagcgggaggtagaggttgcagtgtcagtgagctgagatcgcgccactgcactccagcctgaacgacagagcagactccgtctcaaaaaaaaagaaagaaatccttcagcacagagggtaggaaaaaacaactactcacacttcccagaatacctaccgtggcaataccaaaatatgaccatgcttgttaatatttgggctacggcattaaatgtttataacataacacaaacacttgtaatccaaatgtgaatgattatcttcaattttcagtaaaataagaccctataaaagccctaccattaatacatattcattcataaacatactgagtaccagtggatgttaaacactgtagaatctctaaggaaagaatactcggtcactttataagctatgtggtagtcaagaaaaatcctttctactcattgatacgttaaatgatcaaaaaatccaaagctaaaaaatgatcagagaacaatgaaaaaattttagtggctttatgcttccaattccattttcttctggactcttttctgaagcttgcctaaatcatcccaggaatgctaaaattgggtgttatttatggcataaccaaaatgaaataacaaagtaagtaccccaaataaaactaggagaaaaaatccagggaaccaagcaggcagtaaggatctaaagttctatacttggaacctctaccctgaatgttaaataatagatgttttttaaatagttgactaccaagtgtggtggcatgtgcctgtaatcctagctacttgggaggctgaggtggagagactacttgagcctaggagttctagactagtctggacaaatagcaagaccctgtctcacgggtaggggagcaggggaaggcaaccaagctgggtgtgccatgtgcctctagtcccagctacttgggaggctgagacaggaggagtgcttgaaaccataggccactgtactccagcctaggcaacataggaagaccctatctctaaaacaaacataaacaaaaaggccgggtgtggtggctcacacctgtaatcccagcacttgaggaggctgagttgggaggatcacttgaggtcaggagttcgagaccagcctggccaacatgataaaatttttgtatctttagtctctactaaaaacaaaaattagctgagtgtggtggcaggggcctgtaatcctagctacttgggaggctgaggcataagaatcatttgaacctgggaagtggaggttgcagtgagcggagatcacaccactgcactccagcctgggtaacagagcaagactctatctcaaaaaaacaaacagttatatctttaattattatcttcattcagtaattaggcaattagaatttacaattgctaaatgaatgttcaaagttcaaccaaaattagtccaagatgaagccaagaacacatctcaactcattcaataaagccattattactctgatgccaaaaccagacatagatatcacaagacaactacagaccaatatatcttatgaatacagatgtaaaagtcctcaacaaagcaaaatgaatccagcaacatattaaaaggcttatacaccattgctaagtatgacttaatcccagggattcaaggttggcttaacttctgaaaatcaattaatgtaatacaccatattaataaaggatacaaaccacatgatcatttgaatagatgcagaaaaagcacttaacaaaatccaacatgctttcatgataaaaacactcaacaaagtagaaattgaagaaaacatcttcaatctaataaaaaatacctatgggggaaaaaaagaatacctacaaaaaccccatagctaaaatcatacttaatggagaaagcctgaatgctttctccctcaggtcaagaacaaaacaaggatatccactcttaccactctgtttaacactgcactgaaggttatggccagggcaaataggcaagaaaaagaaataaaaatcactcaggcttaaaaaaaagaaggaaaactacctttatttgcagatgatataatcttgtatatagaaaatcctaagaaaatcccacaaataaactattagagccaataaacacatccaacacagttacaggatacaagctcaatatacaagtagtaatcgtatttctatacacaagcaataagcaatctgaacatgaaaagtttttaaaaattccacttacaatagcatccccccgccaaaaaaaaaagacttagaaagccaagcacgatggctcacacctgtaatcccagcactttgggaggccgaggcaggcggatcacttgaggtcaggagttcaagactagcctagccaacgtggtgaaaccccgtctctactaaaatataaaaattagttgggtgtggtggcaggtgcctgtaatcccagctactcaggaggctgaggcagtggaatcacttgaacccaggaggcggaggttgcaatgagccgagatcacaccactgtactttagcctaggtgacagaatgagacactgtctcaaaaaaaaaaaaaaaaaagacttagaaataaatttaacaaaagcagtgacaatcttatactctgagatatataaaaattacaaaagaagttacagaaatcctaactaaatggaaaggccaggtgtgatggctcacacctgtaatcccagcactttggtagactgaagtgggtgggctgcttgagcgcagaagttcaggatcagactaggcaacatggcaagaactcatctctacaaaaatacaaaaatgagctagatgtggtggcatgcacctgtaatcctagctgcttggggggctgaggagggaagatcacttgagcctagtaggttacagctgcagtgagccatgattgcattactgtacttcactgcagcctggatgacagaacaagactgtgtcccccaaaaaaaaaaaaaaaaaaaaaaggaaagatatcccatgttcatggatgagaatggatcagaagatacaactctgttaaaatggcaatattccctaaattgatctacagaatcaatgtgatcccagcatacccaaaagaaatttgaataggaaaaacaaagttgggggactcacacttcctgatttgaaaacataattcaaagctatggaaatcaagacagtgtggtagtggcataaggataaacatacagatcaatggaatataagtgtgggttcagaaataaacctttacactgacagtcaattgattttatgacaaaaatgccaagacaattcagtggaggaaagaatggtctttttaagccaagtgctgtagctgacacctataatcccagcatttggggaggctgagacaggaggattgcttgaggccaggagtttgagactagccagggcaacaaagcaagacccccatctctacaagaaacaaacaatggtcttttcaacaaaccatgctgggacaactgaatattcacatgcagtagaatgaagctggaccactatatctcacaccatacacaaaaattaattctaattaaatttaaacacggattatagacctaaatgtaacagctaaaacaataaaattcctagaagaaaacaaagctaatcttcatttcatttggtggcctgacatcaaaaccacatgcaacaaaggaaaaaacaagtaaatttggcttcatcagaattataacattttgtacattaaaggacaccatcaagaaattgaaaacacaacccatagatgggagaaaatatttgcaaatcatgtatctcacaagggatttgtatctagtatatttaaagaactcttacaactcaacaataaaaagagaatccaattttaaaatgggcaaaggctgagcatggtggctcacaccagaaggagaggatcccttgaggcaaggattctgagacctgccagagcaatatagcaagaccctgtctctacaaaataaattaataataataaaaaaaaacaattagccaggcatggtggcacacacctgtagtcctagctactcaggagcttgaggcagaaggaacccttgagtccaggagtttgaagttccagaaactatgattgggccgggtgcggtggctcacgcctgtaatcctagcactttgggagtccaaggcgggtggatcatgaggtcaggagttcaagaccaacctggccaagatggtgaaaccccatctctactaaaaatacaaaaattagctgggcgtggtggtgggtgcctctaatcccagctacttgggaggctgaggcagagaatcacttgaacccaggaggcagagattgcagtgagccaagatagtgccactgaactccagcctgggtgacagagcaagactccatctccaaaaaaaaaaaaaaagaaaagaaaactgcgattggccactgcactctagccagagtgacagagcaagacctagcctaaaaaacaatagtgtataaaaataaaattaaaatgtgcagagaatttaaatagacatttctccaaagaagatatatgaatggccaataagcacatgaaaagatctcatcaggttgagcacaggggatcaggcctgtaatcccaacactttgggaggccaaggtgcggggactgcttgagctcaggagtttgagaccagcctgggcaacatggtaaaaccccatctctacaaaaaatacaaaaaggccaggtacagtggctcatgcctttaatcccagcactttgggaggctgaggcgggtggatcacctgatgtcaagagtttgagaccagcctggccaacatggtgaaaccccgtctctactaaaaagacaaaaattagccaggtgtgatggtaggcgcctgtaataccagctactggggaagctgaggcaggagaatcacttgaacctaggaggcggaggttacagtgagccaagatcacaccactgcactccaacctgggtgaaaggcaaaaatccgtctcaaaaaaaaaaaaagtttcaaagataaaacaaaaatcttgttaaagataaatacacgagatgctaaagaaataatctacttcttcaagtcatgctatcaatttgcaccaaaattttcatttcctatgtgtaggtgttgagggtcttgtacccatgataaatgacatacacctgttctgggctgacttttgttccccaaaagagatatatagtactccaaggggctgggcacagtggcacatgcctgtaatcccagcactttggaaggtcaaggccacagcatcgcttgagctcaggaattcaatatcagcctgggcaacatggcaagaccccggctctactaaaaatataaaaaaatagccaggtgtggcagtgcacacctgtagtcccagctacccgggaagctgagatgggaggattgcttgagcctggggtttagggggctggaggttgcagtgatccaagtgccactgcactctagcctggatgacagagggagaccctgtctcaaaaaaaaaaaaaaaaaaaaagatatgtagtactcctaacattcagcacctcagaacctgatcttagagacaggatcttcaggccaggtggcttcccttcctctccgcgtcagtctgtcccacctcagctcagcccaccggagacagagggtgcaggaacctggaggcggaggttgcaggaagccgagatcctgcaactgcactccagcctgggcgacacagcaagactccgtctcaaaaaaaaaaaaaaaaccttacaacaaaatgatgcagcccgggcgcagtggctcacgcctgtaatcccagcactttgggaggccgagtggggcggatcatttgaggtcaggagttcgagaccagcctggccaacatggtgaaatcctatctcaactaaaaaaaaaccaaaaactacagaaattagccaggcgtgatggcgcatgcctgcagtctcagctgcttgggaggctgaggcaggagaattgcttgaacccgggagtcggaggttgcagtgagccaagattgcgccgattgcactccagcctgagtgacaagagcaaaactccatctcaaaaaaaaaagaaaatgcaaagtcacctaagagacagtttaaatacataaaaagctcgatgccaaataaaactggatgggtcacttgataagtgggattgataaaaagcaagacagctgatattatataattcttatttgcttcgatatttactggggaaggtagaggggaaaagctatctaaattactcttaataagcatacaaatctctaatagtgaatcaaatgcatcattaaatatactaaattcctcaaactgatatgtcagatgtcaggtagtcatgaagacccaaaatagtctccatgggttttttgttgttgtttttttgagacagagtctcactctgttgcccaggctggagtgcagtggcaccatctcgactcactgcaacctctgtctcccgggttcaagccattctcccacctcagcctcccaagtagctgggattacaggcatgtgccaccacatttggctgatttttgtatttttagtagagacagggtttcactatgttacccaggctgttctcaaactcctgacctcaagtgattcacccaactcggcctcccaaagtgctgggatttcaggtgtgagccaccacgaccagccccttctctgtgttttaaaggcatttaagtataaattattaaactgcaggacagaacatattagctgacggtcatatgagtgaccttctctaaatgccaggaggatagaatccacttttcctttatcaatattttccttgctcaacttctgacatattaggtactcaataagtatgtgctgaaccaaaacgaacaaaaaaatgctgtcatcaaagtaacttccatctactcaagtaggctgcaacttcaaactgcccaaactagcaaatctctaataaagatgggctcagaagacatatcagcatgaataaccttctgaggaaaagacaacatggattctaaaagtggacatcacaccacaccagttcacccaaattctctgagaaaataaatatgtgtggctgggtgacggtggctcatgcctgtaatcccagcactttgggaggctgaggcgggtggatcatgaggtcaggagatcgagaccatcctagccaacatggtgaaaccccaactctactaaaaatacaaaaattagctgggtgtggtggtgagcacctgtagtcatagctactcgggaggctgaggcaggagaaacgcttgaacccgggaggcggaggttgtagtgagccgagatcgcaccactgcactccagcctgggcaacagagtgagactctgtctcaaaaaaaaaaaaaaaaaaaaaaaaaaaaaagacctgagtggccacaggatgagaacatttactgtagactggacataactgagacacagaaaattataggtagatgctgaggtacttccccaaatgaagaagtaaaaacagaagattgaaaatttttttagaaatgctatatttaacattttaatatattgtacaaaaaatatacagagaattccccattttgcagatgggatgatgagattcctaataatgaaataccacacgagttggaaaaataagggaacggagtgatggaaagggtttctaaatatattaaatgagaaacatttgcaaaaactaagatttatattcagcttagagaatgctttggcaagtataaaagctgtctaaatatgtgaagggttatctagcagaagacaaaccagacttgctctaagcagttcccgtgtagacaaaattgggcccaaagtggcaattccagaagggcacgcttcaactcaagctttctaaccatcagacctaactaaaaaggtggttcttaccttggattacctctaagagcccactgagatatgagtgttaaaaaattacatgcgaggaaatggcaggtatgttacagcatggacaaatgaaaagtaaggcatttacaggaaaaaaaatctaagctatacttaaaagactcatgccttcaagtcaaaaaaggaatttttgaataattatagaatattccctaaagacaatgtgatgttctatgcaaaaaaaaaaaaaaaaaaagggagggagggaggaccaaatcctattaggaaaaaactgtaaatcaagggtacccaatcgtttggcttccctgagccacactggaagaagagctgtcttgggccacacataaaatacactaaagtaacaatagctgatgagctaaaaaagaaaatcttaaaaaaaatctcataatgttttaagaaagtttacagatttgtgttgggccacattcaaagctgtcctgggccgcatgcagcctgtgggccatgggtcggacaagcttgctgtaaatagaacatattttcttatccttctaccaaatcacagtgtagttataactaaaatgcagttctgagtagttatcataaatccagaaagggaaagcaatgctgacaaagatcctggaaggaggtttcactggagattaaattaaaaagtcaagcatcttcagttgagaaacatgaaagcaaaggggcaatgtgatcaaaatcagaaaacgtatcaatatggtaaatactaatttattcaccttttatgcttgaaaagtatttctttatataacagataaaagaaacttgtggattgtgttaccacaatctacaagttaaaaatagattcaagtgctcggataaatgtaggtatattaggtccattcaggtcctacaggatagaagtgctatcagacgtgaggccctaaatttctgaggttaacatcttaacagataacaatgtttcacctgaaaacatcacttggtgccaatttagacagaacaattggttggacagaccccggacagacagactcaaggaggctggttggtatagacttccttccattcttttacctcagtatgtatgtgtgtgtaatatatacatacatattatactagaacatatatacattccttatctttatacacttagaatgctccttatatagctctgcaccctgaatttttcatttatcatttactcaacatcctaagacattaaaaattctttttttttttttagacagagacttgctctgtcaacaggctggagtgcagtggcaccatctcagctcactgcaacctccaactccctggtccaagcaattctcctgcctcagcctcctgagtagctgggatttcaggcacgtgccaccacgcccagctaatttttgtatttttagtagagatggggtttcaccatgttggccaggatggtctcgatctcctgacctcataatccgcccacctcggcctcctgaagtgctggaattacgggcatgagccaccgcacccggccagaaaaattctttcaaatactattccatggttgtaaatgtccatccttaaatataccatgatttattttcctataaatcttgctgctcatttaggtttattctcaattctcactaatatgaataatgttacaatgaacatctttgttcacaaatctttctatgtatcttaatttttcccctttaggataaattcctagatgtgcaattactgaattaaagaacgtttttaattttgccaatatatgttgccaaaatatctttcaaaaaaactaggcccaatgcacactccactagcagtttcagagattgtcccctcaccaccttcgacagcacagtcaactgtaaatctgataggttaaaaaaagagtatgtcatttaatctgcattcctttgattacttatcaggataaaaatgtttctcatatgcttcttggtcatttgtatttcttccttatgaactctgatcatgttctttgccagcaaaacttttctttctcttggccgacaaactttctgtggaaaaccagctgagatggaatcatttaaatatcagcaactgcagctccccctgctgacagataaattaccaccaccatcaagtgcccagtaaaaaaaagtgagctagaaccatacgcttgcctgtcttctgggctgctgctacaaatacaaattatacacggtaataaaaaagaaaatactgtgtatctaaactcatacttaacagagctgtgatggagaaggcaagggggacaagcgttttatttgttttttgttgttgttgttgttgttgttgttttttgagacggagtctcgctctgtggcccaggctggagagtagtggcgtgatctcagctcactgcaagctccgcctgctgggttcacaccattctcctgccacagcctcccgagtagctgggactacaggcacccaacaccacgcccggctaattttttttttttttttttttttagtagagacggggtttcaccatgttagccaggatggtcttgatctcctgacctcatgatgggcccgcctcggcctcccaaagtgctgggattacaggcgtgagccaccgtgcccggcccaaacgttttctaatgtgcaggaactaggcggggtgcagtggctcacacctgtaatcccagtactttgtggaggccgaggtgggtggatcacctgaggtcaggagttcaagaccagcctggccaacatggtgaaaccctgtctctactaaaaatataacaatcagccgggtgtggtggcacgtgcctgtagtccgagatactcaggaggctgaggaacgaggattgcttgaacccaggaggtggaggttgcagtgagccgagactgcgccactgcactccagcctgggcaacagagtgagactccatttaaaaaaaaaaaaactaatatgcaagaactaatgtcacaaacaattctaaaaatcaattccctgccaaatatactacctggcacatataaacatcacagacctaaatattcatttccctatactttaactatgtgaaaacactctaaattaccaaatgacactgggtggtcagcaaactagttctctttttccaaaagcaaaaacaacaaaaacacttttgccctttagcattcaaagaaagagtattaaaaatcttaattcttggcaatccttattccaaagttgcttgcacttatcagactgggaccaatagatccaaagagtaaggccaagactggcaaatgcatgtgactctcagcttttccactgataccctcctaaagatgcatgtcccaagtccagcaatacagtctttaacactcatttactaagtgccatcaagagcaagcagtgatggccgggtatggtggctcacgcctgtaatgccagcactttgggaggctgaggggggtggatcacctgaggtcaggagttcgcaaccagcctgaccaacatggtgacaccctgtctctactaaaaatacaaaaattagctgggcgtggtggcaggcacctgtaatcccagctatttgggaggctgaggcaggagaatcacttcaacctgggaggcagaggttgcagtgagccgagatcgcgccgttgcgctccagcctgggcaacaaagagcgaaattccgtctcaaaaaaaaaagaaacaaaaacagcaagcagtgaggataaaagacaagagcaagtcctcactctcaaagaacctagacactagctgggttcaaagtggagcaaactagcaatcagtacaatagaagtgctaggtctgcatatgcacactcacatgcacacacactaacagtttcagagattgtccccttaccacctttgacagcacagtcaactgcaaatctgataggtaaaaaatagtatgtcatttaatctgcattcctttgattatttatcagaataaaaatgtttctcatatgcttcttggtcatttgtatttctttatgaactctgatcataaagtgataatacctgggtccagaggaagcactcagtgtcagctactgttattactattatcactactgttattttgttttaaggctaatcaagtgaagcagtgggagtggagaaggaacaaagaaatctgtaactggctgtgatcaattaatagtaaacaccaatatacttggaccagccactactgttattaaagactagggggagtaagtttccagaacagggtagagtccatcttaagcagaggtaactgcttgtgtgaagacccagaggcaaagaacaacagggttcacagaaggaactgggcacaagctatctgtactactgcgtacaggatgctcaggaagaagtggagagatgatctggcaaaacatttcaactctaccttcaaagctagttgagccatggtggaagagggagggatatgatcatacgcttgaacatgcattttacaaggatcatgttggcagcgacttggaagagagaaagcagtcaaggagaatgattacaagacaacagaaggtcacgcagccaaaagggcgatgaaggtctggactcaaaaaggagaagtaggatgactaggaaaatattatgagctaggatctcaagaatgtggtgactagaatggcacaagaaggaacccagaggcctctcaaatccctgatttgagtgactggctgggtgacactaccgctcactaagatacgaagataggaagaggttggactggggaagtggataagatcattttaaaatgcccataagatggccagatgcagtggctcacgcctgtaatcccagcactttgggaggctgaggcaggtggatcacctgaggtcaggagttcaagcccagcctggccaacatggtgaaaccccatctctactaaaaatacaaaaactggccggacgtggtggcgcacacctgtaatcccagctacccggaggctgaggcaagagagtcgctggaacctgggaggcagaggctgccgtgagccgagaccgtgccactgcactccagcctgggggatagagcgagactccgtctcaatagtaataataataataaaaaaataaaataaaatgcccataggacatccaagtagagatgtccaggaagcaactgtgtatatgggattggagatcagaaaactagtcagagctggaaaaacacacatttgcaaatcatcggcatatagacggcaagtgaggcacaagtttatctaaggcattcctcataaactgcacagggtgagaggaagaagggtcaagggaaggcaaatactaatgtttttaggagcaaaagaggaaaaaagtctgcaaagaaaaccaagagtatgggccagacttggtgactcacacactttgggaggccgaggcaggtggatcacctgagatcaggagttcgagaccagcctggccaacatggtgaaacccatctctactaaaactacaaaaattagccagatgtggtggcgggcacctgtaatcccagctactggggaaactgaggcaggagaattgcttgaacccaggagacggaggttgcagtgagccgagatcacgccactgcactccagcctgggcaaaagagcaagactccgtctcaaaaaaaaaaaaaaaaaagtttcaaagataaaacaaaaatcttgttaaagataaatacatgagaagctaaataaataatctacttctttaagtcatgctatcaatttgcaccaaaattttcatttcctatgtgtaggtgtcgagggtctagtacccatgataaatgatatacacctgttctgggctgaattgtgttccccaaaagagatatgtagtactccaggggcctgggcacagtggcgcattcctgtaatcctagcactttgggaggccaaggccacaggatcgcttgagctcaggagttcaatatcagcctgggcaacatggcaagaccccatctctactaaaaatatttaaaaatagccagatgtggtagtgtgcacctgtagtcccagctactcaggaagctgaggtgggaggattacttgagtccaggggttagggggctggaggttgcagtgatccaagtgccactgcactccagcctgaatgacaaagggagaccctgtctcaaaaaaaaaaaaaaaaaaaaagagatatgtagtactcctaacattcagtacctcagaatgtgatcttagagacgggatcttcagaccaggtgcagtggctcacgcctgcaatctcagcactttaagaggccgaggtgggtggaccacttgaggtcaggagttcgagaccagcctggccaatgtggtgaaaccccatctctaccaaaaatgtaaaaattagctaggcacggtggcgagcacctgtaactccagctacttggaaggctaaggcagaagaatcacttgaacctaggaggaggaggttgcagtaagctgagatcaccccactgtactccagcctgggcaacaaagagagactctaaaaaaaaaaaaagagataggatcttcaaagaggtcataaagttaaaatgaggtcatcagagaggactctaatcccaatatgacttgtccttataaaaaaggggaaattgtggacacaaagaaatacacacagggaggctgggcgccgtggctcacgcctgtaatcccagcactttgggaggctgaggtgggcagatcacttaaggtcaggagtttgagaccagcctgggcaacaaggtgcagccctgtctctacaaaaaatacaaaatttaggctgggtgctgtggctcatgcctgtaatcccagcactttgggaggccaaggcaggcagatcacctgaggtcaggagttcaagaccggcctgggcaacatggtgaaaccctgtttctacaaaaaatacaaaaaattacctgggcatggtgacacgtgactgtaatcccagctacttaggaggctaaggaaggagaatcacctgaacctgagaggcagaggttgcagtgaaccgatattatgccactgcactccagcctgggcaacagagcaagactctgtctaaaaaaacaaaagaaatacacacagggagaactctacataaggactggagttatgctgccaccagaagctagaagagaggcttgaaacagatcctgtcccagttgcttcagagaaagcatgcctctgcccttagatttctagcctccagaacagggagacaataaatttctgttatttaagccactcagcatatgtcactctgtggcagcagccttagcaaacagatgtcataagaaaattcgcagctcaggtttactaagtacctaccaggtgctgttctaaacactctgcgtgaataaactcatttaatccttataaagtccactctaggatctaggtactatcattataccctttttacagtgtggacaccaaggttctaagaggttaatgagcttacccagtatcacatagccagagccctctctctcaccactagtgtatgaggagctattattaacagtaattacaataagagctggcgtggtggctcacgcctgtaatcccagcactttgggaggccaaggcgggtggatcacttgaggccaggagtttgagaccagcctggccaacatagtgaaaccccgtctctactaaaaatagaaaaataagccgggcatgctggcatgcgcctgtaatcccagctacttgagaggctgaggcaggagaattgcttgaactcaggagacacaggttgcagtgagccgagatcgtgccactgaactccagcctgggcgacacagcaagactccatctcaaaaaaaaaaaaaattagtaattacaataagaacagtagtagtccactgaaccaaacactgccctatgtcctttacagatataatacaaaagtcctctgaagtaagtgttattatttccagtatgaaggaggaacctgaatctcagagagattaagaaaatcgcccaaagtcacacggttaagagtgctgagattaggccgggcacggtggctcatgcctgtaatcccagcactttgggaggccgaggcgggtggatcacctgaggtcaggagtttaagaccagcctggccaagctggtgaaaccccatctctactaaaaataaaaaaaaaattagctggccatggtgacaggtgcctgtaatcccagctacttgggaggctgaggcaggagaatcacttgaacccaggaagtggaggttgcagtgagccaagatcacctggacaacaaagcgagactcttgtctcataaaaaaaaaaaaaggaagaagaatgctgagattatatctaattgctaacttaaggggatatacaatgaaaacctgtttttactaaaactttaagaacaagttaattttttttttttctttaatgagacaagagacaaggtctggctctatcacccaggctggactgcaggggcgcaatcacagttcactgcaacctccacctcccaggctcgagccatcctcccacctaggcctctcaagtagctgcaactacaggtgcacaccaccatgcctggctaattttcttttgtatttttagtagagatggggttttgccatgttgcccaggctgttctcaaactcgtgtgctccagcgatctgcctgttcagcctcctaaagtgctaggattacaggcgtgagccatcgcgtctggccaagttaaattttttaatgcctgactttgcagttcaatactagaaatatacatctataaattcaaaattcttgaagatcccaagagaacacatgtcctagattatgggcccttttgcgtgtgtatcccctcaaccactgttcaagaactattctctcggctgggcacggtggcccacgcctgtaatcccagcactttgggaggccgagttgggcggatcatgaggtcaggagatcgagaccatcctggctaacacggtgaaactccgtctctactaaaaatacaaaaaattagccgggcgtggtggcgggcgcctgtggtcccagctactcgggaggctgaggcaggagaatgacatgaacccaggaggcacagtttgcagtgagccgagattgcgccactgcactctagcctaggtgacagagtgaggctccgtctcaaaaaaacaaaaacaaaaacaaaaaaactattctctcagttagaacccttgccatttctctgacttccagacacagaaagagaagaaaaggaaggattgagatgctgttctttaaaatttttttttttttttgagacggagtctccctctgtcgcccagactggagtgcagtggcacgatctcggctcactgtaaactccgcctcccgggttcacgccattctcctgcctcagcctcccaagtagctgcaactacaggcgcctgccaccacgcccagctatttttttgtatttttagtagagacggggtttcaccgtgttagccaggatggtctcgatctcctgacctcatgatccgcccgcctcggcctcccaaagtgctgggattacaggcgtgagccactgcgcccagctaaaattttcaattttctatttaatttttaaaatctgatacaaacatcagaaagtgtaaaaagatataatgcaatgagaagtctccttcctactctgtcctctacctgaacaattcctagacctaacaggtaaccagtgccaccattttcttatttattcttctaaaggtttgtgttgttgctgttgtttgagacagagtctcgcttggtcagccaggctggaggacagcggcgtgatctcagctcactgcaagctccgtctcccgggctcaagcaattctcctgcctcagcctcccaagtagctgggattacaggtgtgtgccaccatgccccagctagtttttatattttcagtagagacggggtttcaccatattggccaggctggtctcagactcctgacctcaggtaatccacccaccttggactcccaaagtgctgggattacacgtgtgagccaccatgcccagccctaaagatcttttttttttttttttgcatacatacaccaatgcaaattatctttttctcctgtttttttttttccaaaaaacacaaagggtatcaaatcatacatactgttctgcatcttgctttcatcacttaactgtctgccttgcagatctttctatatcatattaaattatgttttaattctctcgttttgcttgtcaagaacagtttttacttcatttcaccatagttcagtctagcacacaaggcatccagcagccctaagaactacctgaaacaactgatgatggctccatgctacacactaaagaccctgtatcttttctctcctcctcatcttcatttcactcttttctccgactcactcaattctccttcctttccctattcctctcccatctcacccactccttagccctaaccctgacaactagaccctagtaacatcactgacattgcttagtcgtggctagaaatattcaggctttaaaaaggtacagacccctaacacagagaaaaagggataaataataatttccatgagaacttctaattaacgagagtgccttaaattgaggagttttggcttggagttattcttccttgttacttgcctcctctggcattttcatttgtgaagactgagtgagtgtgacgctattttctatacgcatggaaacaagcacatactcagtctaacatttacgcaatgcctgacagaacgacagagttcattctacaataagataattggaaacaaaatataagatctatataaaataaacatttgggctccaaaatatgcactttaattaacctatcatttctttttacttaaattaagtagctccaatctgaaactacatcttagaaatgttttaaggatattcaccaatgaaaaagagaataaagttccctctccccacttttattttccagcccacaaactcaatgctatcctccccgcaaaaaggacctttttttctgaccagacgaacactgtaatttttaaggtttctaagtaataaaaataggaagaaaacattaccccccaaaattggtttacacttagaagatgtttcccactgagcaaaggattggtaaggaacataatattaaggcaaccacctaactgcattcttaagtagtaacaggtggtaactcacgatatggagctgatttcctttctctattcctgccatgccagagacctctagtagaacttctgaggttactgtattacaacccaggttcagagagatttagaggtaaaaccttaaacactggaaatatctttaaaagtagggctttgtgtaccaaatacattcgttaaaacctaggaaactataaaatgaaatccaatgtattgatctcaatccccttgcctgcttcctaaagaggacagaggccaccaacactggtgctcaacacttgctaagtcgaaacactcttacacaggtcctctgattcttaacgggttcagaacttctggttgcattccccatgcaacccctccaactctacagggagaatgctggaaaaactgtgtcactttggcttcctgtatattaatataagcactcttatccagcaatagcagctgaaacataaatgaagatgagaactcagcctacatgacctaagatttcccacaagtccagatatttaggttacacacactgcactattgtctgatttctcctctgcatcaatctggaagtccacagagcagattagcacccaacaatcttaactaagctagtatcctactctgaagaaaggcgaagctggtggagggtttccaagactccttatccttctctgtccttcctcccatcccctccttacgtcttttctgtttgtttttatttaattttttttttaatgtatttttagtcacaagaaaatcaaagaagccacctacttaagtcttaagctctgccctttgcttagtcctaatggagagttctttggccatctatgtacaagagattagaggagccaaagagactggagaaccacatcaatgggagctttttcatctaaaggtcatctgtccacactgtccaaatgaggtttaccctgtgaaataaaacttggtgtaagtgctacctgctgagaaaaatagtatgaaatgtcacacaaaggactggggtgcagcaggaggactctgaaagagtcatacgtgtaaaccagcaggtcttagaatgccctaatatactatatgaagtttcagagtaaacaaatggttaatgacacatcttttgtaacacatgaatcagctactgatttgcaagagtgggacacaccctagtacctatgactctaaagtacctgtttgaaaagtggacctagatgtttgaattgccaacccatcctaagaccggaacataattttacaactatgtaagttgccataatttaaagttaaaaagatcactgcctttcattataatggaagttaatttgagaacttcattaaaacattcacaccgataatcaaagaacagtagagatacaaagtaaaatatagccaatcaatcctaggaagcaaacacaagaggcaagagaaatggcaggtaaaggaagtgaagaatagcaaattcaaaaactacaatattcccaattctaaagaaaaatgaataaaatgaggctggtaatgaaaaaataacacatcttaccttaagaggcatccaagtagcattcatagtgtcaggatataaagacaatactcagaaatgagcaagaagtcttagtaattccctcggttaccaagtataagcaggtaggaaaatcttttgtttcgagaaggtatctgaaagagaggattttcatttagactaaaaaataatcaagacaatgcaaatagtttaagctacctgggcagggattttgaagtactatttgcctcatcgcactaaaaaagtatagaaaatacagtcccctttagaaaagggcaaatgtgtgtctccatatatatgtgtgtagaaacatactttacataaaaagagaaataaatatgtaacacgtattttagataatgtaaaattgcttatcaaacaattagccaaaatcccagagagaataaagtaattttccagggtacttcataaacactaaacgtgatttgttaactaaccgtctaaagaaagacccttgccacatttaattatatttagtaaagtaaaacttctctaatcatcccgactgtcccaagattatgcttaagtttcagagtcaattccacatgaaaagtaaaacctattcttgactgaagtactagaaacaaataaaagacccttcttccccagagatcgttaaaagcagaccgagcaacttaattttgagggtgggaggaaggtaaatttgcctggaggcaggaggatggactaaatgacctctggtaggatcctcgttcaagtcctgggcctgtatacaattccagcttaaccagttactgcttcgcttaaaatggaggcttgcctgcgtagggacaaaaataacagcacccacttcttaaaaataaatgtcgaaaagtacccctttttaaataaaaataaaaaataaacacctctggagtggatgtgttcttgctatgcgtttgtcactgaggcttcgaagacttggcatcactttccttaccgctcaccggattttgggggaggagcggggggcgacagtttgactcttgacccaagtctcaggcggacttcagagccccacaggggcccccaactccagagccagagggagcggagaggcgagagcccgagatcgcacctccccccaccgcggaccccagtcccaaacccacccctcacctccccgcagtggggcgcctccttctgccccattcccattgttagggagggcagagcgcggggtgggctcagggcaggggcgcccgcggccgttgcccggctcgcttcaggaggggcgccccgcgggatgcggcttcccttcctctccgcgtcggtccgtcccacctcggctcggcctggcgccccgaggtccgctccgcgcccccggccgcggccccggcccgccccccgggcagccaggccctcaggccagtcggccggcagccggcgtcccaggcctacgagtgggcgctgggcgggggtccccgtgccccacacacgcgtcccctctcccccagccccgccgcttccagggccctcggcggcgcccgctccccgggccccgcggccccccgcctcccagccgggccgctccctcgagctcgtcgggtcagggacacctcctctacctcaccatcaccctggcccactcgtgcccccacccccaggggcaccagtgccaaaggcagctcccccagccccggacctacctgcacggttcaaccaagcctagaagtgggggcg

SEQ ID NO: 740 - DNA, 3152 bp, Homo sapiens
cgccaggaggcgcggccgccgccgcctcagtcatggctcctcgccgtggccgatgtttttgtacctccatctgcggaggccgcggcgcccggccccagctgccccggacgtgcggcgacggcacgcagcactgcggcagggggaagccagccctcgctgcggccgaggtgagtctaacctgaggcactgacgccgtcacatgccctccgtgctggggccggcggtgcggctcgccagttgaggggcagggcgggccggcgccgcggagcgagaggacgtgagcgaggaactgtttgcactgtgtagtaaagagggtaaggccgtcggcaccacactattccaaggctaaccctgcagaaagctccctgaccagtgaagcggcttccgccgcccgccctttgtccctagcagccagcctccgtatactgcagcacggctgggcactagccccagcaccgcgctccgcagccaccagagttgggcggggtggggagggtgcacgtagtcactgcgcaggccccagccagggcccgcgccgggccagcccgggaagggacagccgggagccagaggggaagtgatggccccgccggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagtttatcagtacagaactttatattgtccccaaaataggacctttaaaataatggaacctttcctagacttaaagaattcataaacataatgtaatacaaagtgtcacacaaagtgtaattctaccaccctttaaagttgccaaaagatgagtggagtatcttgagatttaaaagactaatctaggattcatcaaaactggcttaaatgactgaagaaaaaatcgttcaaatcattaaatcatcaaattcggcagataagaagggtatgtatgctctactaccaaaaaggaagacgcaaaatgcttcacacttttttgtggcttaccagaaccaatatccggcattatacgtcacttctgcttatcaaaaaacaccctcacagtcgttacagaacggttttagtcttcccacaaagttacactaactcacctgcccctgcaacatctgcacctaggtttctgcgaatttccatttgtactcctaaaatcacactctcaagcatagtcatagttctcaaataccaaaggcaggcagtttggagtcatagggtcaaattacacaaagaataaactaatatttgtatacacatccaaaagaggtctttagtcttggatttttaatttacaaccctggggaaaaactttgacttttttattgtacacacatacacacataaatagtaattccacaaaatacagtagaagggtattggaccaacagatggcgaactagagccccaatctgaggctcctgaaatctaaattagcagaatgaaaaataccaaataaggcaaagccctttgcagcgtatacttaaatattaaattcagacacaccataacaaaataatcttactgctgctccaaatttttaagactgaactgtcagatttaattaggcaaccaaataagcaagattatatgaaatatatttttctaatggattaggagaaaactggaaaatgctcatttttaaaaccatgtatttgggggaactataaattccagtttcccctttctctcattgcttagtgcaagagtcaagagttcacagggtttatggcacttaaatcagtcaacctgttgtatattcttatctaaaatcagacatctttcttattaggcatccacttgtacttttatttttttgacagggtcctgctcggttgcccaggctagagtgcagtggtgcaatcaaactcactgcagcctcccaggctcaggcgatcctacctcagcctcttgagtagctggcactacaggcatatgccaccatgcccagctgttatttttttcactcctttttgttttggtagatacagagtctccctatgttgcccaggctggtctcgaactcctggactcgagtgctggcattacaggcatgagccaccacacaaaaatcttatgaagagaaacaaattttcttaaatttccccccaaaaaatagtggatgtccaaaaggctgattgaaaacacctacatacaaaataaaacaaacaaacaaaaaaagatttaaagaaaaaggcctggtgcagcagctcactcctgtaatcccagcactttgggagggtgaggtgggaggatcacttgagctccggagttagagaccagcctgggcaacagagtgagaccctatctctacaaacaaaattttaaattagccaagtgtggtagcatgtgcttacagtcccagctactccagaagctgaggggattgcttgagcctgggaggtcaaggctgcagtgagtcatgatcatgccattgtagtccaacctgggcaacagagcgagaccatctcaaaatgaaaagtgataaaaaaataaaaacaccaacatatttcaaatcactcttggaatagtcatgttgactctccaatatccactctattctgattagttttaacccattctctttgccaatgattggttaggaatggccatgagatgtgagtagaagccccctggacagcctccaaaagagaactgtgagaaaaggttcttcaatcctaaaaatgatggaggaaaaaacagtccctcttcctcagacagtgacacctcaaactgctacagtcacctttgcagcaagcctgaagatgccaccaacatcaaagggaatagagagttggtccttggtgatagcattaagccactgtatcaaccaatcctgacaatttgtatgacttctggatttccagccacattacaacaatgtaacaataaacatttattaattgcttaagccaatttgagttaggttccttatataataaatgaagtcaaaaaacaa

SEQ ID NO: 741 - DNA, 49979 bp, Homo sapiens
cgagcgcagagctgcagccgccgagccggacgtgtccgcgaagatggcgggccgggtgagtgccggtctgggagcccaggcttgaggcaggggcgccgggctcgcgggcactctggggtccaggcggccccagaggagtgggagtgaatccgagcaatggggcgcgaggccagagcgggacttgagggtagcaggggagcggtggcaggggattagccctcctcaacaactccacccccctcgaggggagatgacccctcgttacacgcgtctgctgcgcctcccgtcatcctcccttcccatcccttggggcttgttccctcgtcctccacacagccgcagggtcgcggtcgccgaagccccctctgacgggctctgggggtctttccgcacccccttgcgagggcttattagggggcgccggagtaactgccgggagcacctctgctgcattcggggcaaggggtgtaggaaggatcttcaggaacccatgtctggctcttcacaaattaaaggtcgttgggaaagaggagggggtgccaatgacttttagtgttaaagcccggccatctgggggacctgtcaactgtcgggtcaggcaggaattggctttagcttggagtgaggatggatttggggtgtcacgttttgtttttatggatgacagtcgcttcgaatgcagcaggatatgctgtagtttcagggttttaaatttacttcctcctttagcctttaggatcgttgggtaggatgggtttggcgaggagagagagctggttgagtgctgtattgcagtctgccttgagctaaaagctctcaagggatgagtcctgcccggagattacactggtcataaacctgaggacattaactgcgtcattgggggcgaaagatgtgattgactgatctatttataacagaatttttgaataagtttgcatagatttatgcatatatgcaaatgccctatctgaagggacttgtaggtcatgagattctagagtaagaagggatcttaaaggtcatttagtttggcttctttctcttccttttccccatggcctctccttttaaggctagtccttctgccagtacttcagaccctatctgtatattcacctgctccttcttaacataatcaagcttctctatcttaaacccttcccccacccccacagctgtcaccttttcccgtcccagtttacagcaggaaatttgatagagttgtctatatttattgtcttccatttgcttaccacctactcacccttcaacctactgcagtctgatttctgccccatcatcccactgaaacctgtccctcaacttaattgatacctttcaatccttatcttatttgatatctcagcagcgtttgacgttgttgaccatggcttccttgacggaaagcactcttcacatgtgttctggaatgcctcgctcctggtttgactcagacctctcttttgcggcctcaccctcctctactttgttattcattgctggtattcctcaaaggccgtcttctcactctcaatttcccgctcaggcaatttcttctaagcccatagctacaactgtctatatgccagtgattctcaatattttacccccagtccagacctgccctttaagtttcaggttaatatgtccaactgcttatttaaaatcaaggtcccgaaacgcagctttttcaactccgaacccaggatcttagcccacctaacttgtgtagatactcctcgacttaacgatggggctaccttccgataaacccattgtaagctgaaagtatcagaagttgaaaatgcatttaatacacccgatctaccgaatatcatagcttagcctagcctgccttccttacacatgcacagaacacttacattagcctacagttgggcaaaatcatctaacataaacctatattataaaatgttgaatacctcatgtcatttattactgtgctgatagtgaaaaacagaatggttgtgtaggtcttcaaagtacagtttctgctgaatgcctatcacctttgcactattgtaaagttgaaaaatgttaagtcaaaccattgtaagtcagggaccatctgtacctatccagtgagataggaatatctcactgaatgataccatcatccacccagttatataggctgggaatctgagggagggagagggtgggtaaccctttatatctctcttttgctgtacccatgtcctctgccctatcccccggtaaaatttgtcagagttctgctcctgccccccataaaggtatttaattagggccaaagactctggtttgggggaatggttgctttagactagttccaagtcacccactggactatctggattggtcacatgggttctgtcattttaacctaaaaatctccagtctgtccacctttccacatcttcatttttacctccttttcccaaactaccatcatttctggtctggactactgcaggaagcttccaagtatttttttgttcgtttgtttgagatggagtttcgctcttgttacccaggctagagtgcaatggcgtgatccctgctcactgcaacttccgcctcctgggttcaagccattttcctgcctcagcctcctgagtacctgggattacaggcgcccaccaccacacccggctaatttttgtatttctagtagagacggggttttaccatgttggccaggctggtctcgaactcctgacctcaggtcatccacctgccttggcctcccaaagtgctgagattcgtgcccggcctcccaagtagtcttcttagagcatgtggcccacctccaattcattcttgaccttcattgttccttcccgtgcctattactacttaaacccctcctcagcagcatcccattacttttgggagaaaaccaaatccttaatgaggccttcaggactctttgtggttctgctcctgcttctttccactcattctcttactctgtgtgctcaggttatatggtaaacgagcctttcaattccttgaacctgtagtttctcttaccacaaggtctttgcgagtggtgtttcctttctttgtaacgttcttccccccaaccatttacctcctactcagacatcacttagctactcaagggaggcctactctgaccccacattataagtcaggatcctttgttatatactcttgaagaactgtattcctctccttagagatttatctttttgttactttgagtgtgtgttattatttgcttctaccacttcacctcagtgaaaagcagagaacatacaagttatttagtcattatcaactgcgctttgtgtaccttgtgggacttaggtactcaatacatttttgttgaaaatgaatcagtctctgaacactctggtgatagatggtatattaccctaaagcttgcctgtaatgtcatacagctatgttaggtctttgttatctggagttccatgtaacttttatacgtagttactatttctgctgtttcaagccatacggaactaaacacaattctttttccatgtaatagctactcaagctactcatttacttgaatacaggttacatatctcctcagattttcgattttgcaagttaaacatcccccaattcctagcatatttcatattccaaacccttcatcatttaggctaccttcctctggaagtaacctaatgttactgttttgtcaacctttcttctaaaatgtgcccagagtggaacacagtgatcagagaagaatgtacttaagctattattgtcttgagatggacactaccattattcataccagataaaattgtattagcgttttttctatagtaaatcacattcttggctcatactgagcttgtagtcagtgaaaactcatgttcttttaaaatcagctccctagctccattctaggtttagagcagttttattgaacctaaatcaagaccttatccttttacaattcatttttttaggtcagtgcatgtctgctgtttgttgaggtaatctggattcttagttctttcatgttaggaaacataatagctgtctcttccagtttggttagatctgtaggtttaatcatgacttctgtttctacgtttgagttattggtaaaggatagaataagacagggtcagaaataacccttggacatgctgccagtgacatgcctctagactgatacccattaatacacttgggcactgttgcttaaatacagatgtgtctcatttaattccaacaaaacaacctgcaaagtaggtagtattatctttgtttttttgcagagagaaagagagagagatttagtaacttgagaagttcacatagccagcaagaagcagggtcaagatttgaactcagatcagcctggtactgttacctagttcaccagcttagttgcaagagtgtagtaaagactaggtttacctcacctagaactttttggacataataatgttcagaaactatcttctaccttttggaaaatctgaaaaactttggcccatctgattgtctatcatttcttctgatagcctttattttctagtaactactgagtgatttttagcaaaaatagttcaccttgttgcaatacttttatttgtgcatatttatggagtacatgaaaatttttttacatgtgtataatgtgtagtgatcaagtcagggtacatgagtccaatgtattaagtatagtcatctactcagctatcaaacattgaatttattcctcctatcactggatcttttttttttttttttgagacggagtcttgctccgtcacccaggctggagtgcagtggtgttatcttggctcactgcaacctctgcctcccgggttcaagcgattctcccgcctcagcctcctgagtagctaggattacaggcatgtgccaccacgcccagctaatttttgtatttttagtagagacagggttttaccacattggtcaggatggtcttggactcctgacctggtgatccacccgccttggcctcccaaagtgctgagattacaagtatgagccaccgcgactgacctcattggatctttttaccttttaacccacttctcttcagcctttctctcccttactccgccttcccggtctctgttatctatttttccactccctgcctccttgtgttcaaattttgtagctcctacatatatgtgaaagcatgcaatatttgtctttttgtgcctggcttatttcacttaagagaataacctccagttccatccacattgctgcaaatgatatgatttcattctttttatggctgaatagtattccattgtgtacatgtatgacatcttctttatccattcatctgtagatggacacttaggtggttgattccatatttttgctattgtgatagtactgcaataaacatgcaagtgcagctatccctttgatacattgatttcttttcctttgtgtagatacccagtagtgggattgctggatggaaggtaattctatttttagctttgagaaatctccatacagtgttccttagtggttgtactagtttacattcccaccgacagtgtatgtgagagttcccttttctctgcatccttactaacatctgttactttttgtctttttaataatagccattctgactggggtaagatgatatctcattgtggttttgatgtgcatttctctgatagtggtgtggaacatttttccatgtcttcttttggccattgtatgtcttcttttttaatgggattatttgttattttccttttgagttgttcgagttccttgtatgttctggatatcagtcctctgcttgatgaatactttgcaaatattttctcccattcaacaggttgtctcttcattctgttgattattcttttgctgtgcagaagctttttagtttgcttaagtcccatttgtttagttttctttatgttacctgggcttttgatgtcttaatcataaattctttgcttacaccaatgtccaggagtgttttccctagactttcttgtagtatttttatagttttgggtcttaaaatcttcaatccattttgagttgatttttgtatatggtgagagataggggtctagtttcacacttctgcatgaagttatgcaattttcccagcatcatttattgaagacagtgtcctttccttagtgtgagttcttgtcagtgttgttgaagatcatttgtctataattatgtggttttatttctggattctctattctgttccattggtctacatgtctatttttataccaataccatgctgttttggttactatagctttataatatattttgaagtcagataatgtgatgtctgcagctttgttctttttgcccaggtttggtttggttgtttgggcttttttctttttccttttttggtcccatatgaatcacattggtattttgatagggatttcattgaatctgtagattgctttggcaatatggtcattttagtgatattaattctttccacaagcataggatgttttttgatttattttctttcattggtgttttgtagttttctttgtagagatctttcacctccttagttaaatgtattcctaggtttttgtttgttttcggtagctattgtaaatgggattgccttcttaatttctttcttggctagatccttattgatgtatagaaatgctactgatttaaaggttttctaaacctacagatatataatcagcaaagagacaatttgactttctcttgtccagtttggatgcctttcatttctttctcttgtctgattgttctggctaggatttccagtactgtggtgaataggagtggtgaaaatgggcatccctgcctcattccagcttttagaagaaagatctcacctctcctcattcagtatgatgttagctctgggtttgttgtgtatagactttattattttgagatatattccttctatgcctaatttgttgagagtttttttaatcatgaagggatgttgaattttatcaaatgtttttgttgttgttgcaatactgttttttttttttttttttttttttttttttgagacagagtcttgttctgttgcccaggctgtagtgcagtggcgcgatcttggctcactgcaacctccactcactgggttcaagcaattctcctgcctcagcatccctagtagctgggattacaggcctgtgctaccacacccagctaatttttctatttttagtagagacagggttttgctatgttggccaggctggtctcgaactcctgacctcaagtgatttgcctgccttggcctaccaaagtgctgggattacaggcgtgaggcactgagcccggctgttgcgatactcttaatgggttttatatttcctttttgtgggggacagtttattttgcattcttactacttttgatattctgacatcatcttataagtgggatttatattcactatgtaattgaagttttttccaatgaagcaccgtatatagtttatctgggaaattggctgaagaataaaatgtgtgatgttattcagtgtacagtttctaggtcatcagaagataccactaccttcccactactggaaaagaaaaaagaaaagttttccacagtgcctgaactgttttgtatgcttatcttttaaaattgccagaaatctcacttactggagattcagcagtccctttctgaaaatacacatactttagtgcaaataaagccagtggatctctttcttcataagtccttaaacctagtcgaggtcatctgtttggcagagataggagtaagataatgtgaaataggaaccaacgagagagaacttgcttaggagttgaaaggggtatggaaagatgttagaggtaaaatttgtcgaatctagtgttttgactagggcaggccagaatattcagtatcagtatcaatatcagaagcttttgtagcctttgtttagaaacctagtcatttataacattttgtgggtgaatgacatcattaccaaacaaactttcagatgaaactttggaactcaagctgtaaattgtggatagctcatgtgcagtactacaaatcaaaacaaatactataaagtgtttggtagtccatttcctgaatgaaagtttgtccaaagtatatcaactttctgcagtcttacatgcagtagttattagttttgtgtatcgctttagtggatatttttaaaagtatcttcaaatgcaatgaattttaggaaacaaaacaattctttaaagcatcattagatagcttcttctttctgaaacccagaggaatttatgtataggatgactctttttttcaagtagttaagttaaggtgcaaaagtataaggtaaagtatattatcttaccattgaaaattttggcagtggcagaagagcgaacccttacaaataccttcattgggcaatacactaagcacttgctgtaatgctttttaaaacatctatactctggctgtggtattttaagtgaaaatctctcagtgagatactctttcgtattttagtactgatatccttaatattgctctgagagctaccttatactgacttcagtttcctagtgatttaaactactaatttccaacttatttttttttatagtgaaaactaaatattccttttgtagatgtaaccatttctggaagccctaagtatttttgaatgagtataattcatgcacactttaagagatttcaagcatgacaagtacagtgaataacatatatccatgtgattaccactgaggtttaagaaatgttaacatatgatatctgcttcagatatttatctttttaaaaatagaacattacagctgggcatggtggctcacacttgtaatcccagcactttgggaggctgaggctggtggatcacctgaggtcgggagttcgagaccagcctggctgacatggagaaaccccgtctctactaaaaatacaaaattagccgggcgtggtggcacatgcctgtaatcccagctactcgagaggctgaggcaggagaatcgcttgaacctgggaggcagaggttgcggtgagcgagatcacaactccagcctgggccacaagagtgaaactcagtctcaaaaataataataataaataaaaaatagaacattacagatccaattgactcttctttgtattgctccttttttttttttttttttagttttatttaaaaattttttttagaggctgagtctcacttggtggcctgggctggagtgcagtggcgcagtcatagctcactgcagcttcacactcctgagctcgagcaatcttcctgcttcagcttcctgagtagcttggactagcagaggtgtgccaccacatctggctaattaaaaaaaagtttttagagataggatctctctgtgttgctcaggttagtctcaacacctggcctcaagtgatcctcccacctcagcctcctgagtagctgtggttgtaggtggcagccaccacacctggcagtatcccttcttgagaccactgacctttcccagaagtaatcactgtcctgaagttggtatagattctttctgtctacatctatgcatgtttatgctcaaaaacaatatattgctttgtgtgtctttaaaatgtatataatggttttatgctatatctttctttctgcaacctgcatttttcacttaaaataattttgaaatttagtcctgtggatatatagtgagccaattaattctgcttagctactctgtagtctgttttgtgaatataccacaatcatctactttcttattagaggacaatttaggcagttccaattttatttttcccggaatgtacattattttagtcgagtgccattgccacattagcgatattttggttagtgagggactgcagataggaaggtgatcccaaaagattataatgccatatatttactctacctttctatatttacatatgtttagttacacaattacccattatgttacagttgcttacagcatttggtgctgtaacatgctgtacaggtttgtagcctaggagcaataggctataccgtataggtttgtgtaagtacgctctatgatattcatataacgatgaaatcacctagtgacacatttctcagaatgtatccctattgttaagcaacacatgagtgtgtgtctccatgcatatatgtgtaagagttagcatgtgtgtccagaggtagaattgctgggcgataagtcatactcatctttacctagttatgccagtttatactgtcactagcagtatatgagtacctgttatttatatcctctccaacacttaatattgctgacattttaacttttacaatataataggtgtaaaactattgtttaaatttgcatgttgtcctcattactagtgagattaagcatttttcatattggtcattgggatttccccttctgtgaattacttttgtatatttgctcattttttctgttgggctgtgtatttttttagtgatttgtataatttttcgttttttggggggtagggtatgctttggattctaatcctttgttgtaaatagcttctctcagacagtgatggtcttttcatgatgtttatagagtgttggatttaaattttatagttataattaccctttttttttttttaccttggtgatttgtgcttttatgtgtttttcaggaaatctttctccaccctgaagtcattttcttataaaagttttaaaattttgccttgcacattttggtgattgatcaggaatttatttttgtgtttggtgtgaattatgaactaattttatcttttccatatgtataaccagttgtctcaatatcatttattgagtccatttttttcctttactgatttgcaatgctatctctgtattatatccagttcccatatacgtgtgggtctaagtgtcgactctattccgtttcataattctttttgtccatatttgcatcaataacactgttttaattgctgtagctttaaaattattcttgttatttcatagggcgtactttcattacctttcttaatttggcatttcttggctcttttccgtatgaattctgggaacaacttaatccccactcctttaaaaaaaaaaaaaaagacactttggcctggcatggtggctcacacgtgtaatcctagcactttgggaggctgaggcgggtggatcacttgaagccaggagttcaaggccagcctggacaacatggcaaaaccctgtctctaccaaaaattagcgggcatggtggcacacgcctgtaattccagctacttgggaggctgaggcatgagaatcagcttgaacccaagaggtggaggttgcagtgagttgagatcgtgccactgcactccagcctgggcaacagaacgagacagttttttgtttgtttgttttaaagacacttttaaccttccgctatggatttttgacctacatttttcctcttgtattttataagagtagacacagagagcacttcaataaaattcagctcaataactttattaacctgatctccttttctttgactttaagctgaaagtgttaatttctcacaacttgtgctctatagatttgaaaccaaatcaattagcatcagctgtttatgagtaatgcagggtattttggtcttttgctaaattcagaaagaaatgttaaagtgctgatggatttgcactagctgtatagatctttggtggaggaggaaatgggaaaattattaatttcaggtaagaagtcatttttgaaatgcaagattcatttctttttaaaatcaccacataataaaaactttaagggctgcattggtgggtttttaaaaaaaattgtgaagtgtttttagtgttatgtgctgacaaatatttttgtagttgctttgacaagcaatgaaactaccaattatcactaattctgagtcttccaatgaacctctgtgtcaaatttttaaatttaattatcctatttttctcctagagaataatattgatataattttgtgaaccatagcagacagttcccattgctgagaatagagcctggtgtggggatattatgattcttgaatggttgaacaagacatttgcttctgaacatcttagtaaattatcacttctgacaatgtctgtagtttgaattttgatattctctgccaaggtattgaatactctaaataatgttgtttattctattatttaaatcattagtattatagatctagctttaaacagctgctgcactccagtcctttttcttcacctgcagatattgagtctgataactgttttgtatacatagcctttcagtaaatctacttatcagtcatcaaattaacttaattataagttaaatgatgagatggaccaagagtgttattgaaatctcatttccacacatttcttctcttcttttgtagaaggtaatgaaatgaacctgtcagtgttcctgtttttatgaagtttatttctcttagtacagtgattctgatagtgggttctgcagaccagcaaattagcattatctgagaacttgttagaaaagcaaattctcagttcccacttcaggctgactaatttagaaaccctggggtagggcttagcattctctttcaataaattctccaggtgattctgatgtatgttaaagttgagaagcattcacttagtgttttgagctctccaatttagttccttataaattgttgaagatattttttccagatttctttccaaatatgtgctcaaccttgttactgataggtttcaaggttatcgtcttcttcccattaataccttcatctatatccaattttcaaacttttaagaaagcatggctattttgctgcagtatggtgaattaggtactctgactgaccttcccagataaacaatttaaaattctagataatttttttttggagggaggacagggtcttgctccgtcacacaggccggagtgcagtagtgtgaacatggctgactgcaacctcgacctgttgggctcaagcgatcctcccacctcaacctcccgagtagctggggccacaggtgcacaccaccatgtccagcaaatttttttattttttgtgcagatggggtcttgccttgttgcacagactggtctcgaactcctgggctcaagcagtttttccacctgggcctctcgaagtgctgggattacaggtgtgagtgactgtgcctggcagatgaaatattttttaagtaaaaaccttatgtgcatggagatagctggctgaaaagtaaggaataatcaggccaaaaactatgtgaaggtgaaaacccagagatataagccaagtactgctgccttgaggacattatttgcaaatgacattacttggaaaacctagttaacttgtgcttgtgcctcaagaagctcagagaacggaagataaaagtagttttctggtagaacgtcccacctctcctggtaaagatggtaccccaagggtctatacatcataataaatgagaactagtaataaacgtaccttgtctaaggatcggaaagaaaaatttcctgcctcaaactttggtggtgatgggaagggtacagaaattccctgagaagttttacccacaagctgaccttcatgcaggtttgaatcctgattttatattacctggatggtatgaaaatcttaagccagtaattaaatataaaagtggtacaagagtgacgatgccttaaaatgcctaagaatgcctaaaaagcagcaaatacaaagcttcttgggagaacccatcttgatcttaggatttagaaaattcctaaacataaagctgtaagaaatatgaactcacattcacaaaatgcagaaagaaataagatgcaatgaatgagaggaagcagaaacaataaagagcagaatcagaacctgcaaagagttcacatattggagttagcagacacagattataagtacatatatttaatatgcttatagaaaaaaagaaatttaaaataggaatgaggagcaagtatacaaaaatgaccagtgtacaaatttaataacagattagacacagctaaagaaagatttagtaaagtggatctgaaaaaattgcagtatagaggcaagaaaatgaaaagtaataaaagagttaagagaatacagagggtagaataagaaggttcagtctagtcagaattctggggcaggggagcaggggcatggaaaagaatgaggcagaggcagtatttgaagagataatgacagagaactgatgaaaaacaacctacaaatttaggaagctaaagaatcccagaaaggataaaaagaaaaaaaattcacacataaacattttttaaagaaactacatgataccatagagaggtcttaaaagctgtcagaggctgggcatggtggctcacgcctgtaatcccagcactttgggagcccgaggagggtggatcacctgaggtcaggagttcaagaccagcctcaacgtggagaaaccctgtctctactgaaaatacaaaattagccgggcgtggtggtgcatgcctgtaatcccagctactcaggaggctgaggcaggagaattgcttgaacctgggaggtggaggttgcagtgagccgagatcgtgccattgcatgccagcctgggcaacaagagcaaaactccatctcaaaaaaaaaaaaaaagctgtcagagaaaaaagatattaccttcaacaagtatttggctgtcagctgttttcctgtctataataatgaaagccataagacagggagtaatattttccatatgcttagagaaaataattgtcaaccaagaattgtatatcttgtgaagaatgggggcaaaattagacactttaaaacagacaaacactcaatgttgtaaccatcaaaccttccctactagtggaaattcagatcaatttcctgaaggctaaaaaaaaaaaaaaaaagtgaccactgatgtaaagtctgagatttaagaaggattgaagagtaaagaataatggtaaatctgtggatatattgaaataaatattggctttataaaatgatgtatgcggaggttttaaaaatagaactaaataggccaggtgtggtggctcacgcctgtaatcccagcactttgggaggctgaggtgggcggatcacctgaggttatgagttggagatcagcctgaccaacatggagaaacctcgtctctactaaaaaaaaaaaaaaaaaaaaaaaaaaattagccgggtgtggtggcgcatgcctgtaatcccagctactcaggaggctgaggtaggagaattgcttgaacctgggaggcagaggttgcagtgagccgaaatcacgccattgcactccagcctgggcaacaagagcaaaactccgtctcaaaaaaaaaaaaaagaactaaatatatgataacaacatccaaatcaaaagagtggttaaagtattttatgatctttatactgttgaagagaaaggtaaagctattcaattaactttagattttgataggtatgtgtattagtattttcagagtaactactaaaataatataaatattaggaataatttatagcagaaaaaacaatttttaaaaggcaaggaagaagtgaaaaacatagaaaaggtcagataaagaggaaacaataaaatatagaaatcaaatcaaatatatggtagactaaatgcttcattcagacaaagaatgtcagattggattatttaaaagcaagcaggccgggtgcagtggctcacgcctgtaatccgagcactttgagaggctgagacgggtggatcacttgagatcaggagttcgagaccaccctggccaacacggccagctggccatggccagctaatacaaaaattagctgggtgtggtggtgcacacctgtaatcccaggtacttgggaaggtgaggcaggagaatcacttgaacccaggaggcggagattgccgtaagccaagatcatgccaccgtactccagcctgggcaacagggtgagactctgtttcaaaaataaataaataaataaataaaagcaagcaaacaaacttactgaaacaacacaaaatccagctataattttcaagagagatagctaatacatatgaatgtagaaagatagaaagcaaaaggatggaaaaagtctatcaggcaaactctaaccaaaagggaggtaaactaactatattagcatcagacaatatgatctttcagacaaaagagacagctagagataggtccctcaacaatgagaaaaggtttatttatccataaaggtaaaaacaattccaaacttgtgtgaacctaataattgcctcaatatacaaagaacaaaatgacacaattataagatgaaatagacaaatctaccatggtgaggagtttcaaaactccctaattgaaaaattaaaaagacaaaatggttacagctgaaaattaaaattaaaaattcattttctcggttgcaatagccatttttcaagggcttactagtgacatgtgacaatggctgctgtattggacagcacagaaagtacttttgcactgcattaatttagaagacttaatataattaacaatattaataattgagtattgaacaccacatccaaggtgcagatctctgaataatatctgatcataatgtgggcaagttagaaattaatgacaagaaaaggcagaaacatgggagacaggtgaagatttcttaaacagaatataaaaagcactagatacaaaggaaaaaagtgattaattggatttcatcaaaagacactgacttagtttgcttaggctgccataacacaatactatagacttggtggcttaaacaaaagaaatgtattttctcacggttctggaagctggaagtttgggaccggggtgccagtatgactgcgttttggtgagcactgtcttcgtgacttgcacacaggcttcttgccacgtgtctgtgtggcggagagacagcaagatctcaccatctctcttccttttcttataaggccacagtcttgtcagattagggcccttcgcttatgacctaatttagcctcaattatctcccaaagtccctatctccaaaatagttggggtgggggaagcgccttgactaatgaattttgttgggggcagtggggagtgcacatttcactccatagtagacaccattgaggagaaagaccagagtggaagaaggtatttgaaatacatgtatttgacagccaggcacggtggcccacacctgtaatcccagcactttgggaggccgagccgggcggatcacgaggtcaggagatcgagaccatcctggctaacacagtgaaaccccgtctctactaaaaatacaaaaaattagccaggcgtggtggcgggtgcctgtagtcctagctacttgggaggctgaggcaggagaatggtgtgaacccaggaggcggagcttgcagtgagccgagattgcgtcactgcactccagcctgggcgacagagcaagactctgtctcaaaaaaagaaaagaaaaaaagaaatacatgtatttgacaaggacttgtacctggaatatataaagaactacaaatcaagaataaaaagaaaggacagaaagccaatggaaaaatgaacaaaggattcaaacagggatttcacaaagaacttacctgtaacgtatgttaaatgctcaacctcattagtcatcagagaaatacaagttaaaacctcagggagatattactacacacccaccagaaagttaaattaagaacacatttgtcatgacaattctgggtttgattttgttttgttttttgagatggagtcttgctcttgtcgcccaggctggagtgcagtggcataatcccagcttgttgcaacctctgcctcctgggttcaagtgattctcctgcctcatcctcccgagtagctgggattatgggcacccaccaccacgcctggctaatttttgtattttagtagagatggggttttgccatgttggccaggctagtcttgaactcctgatctcaagcgatccacctgccttggcctcccaaagtgctgggattacaggcatgagcccgcgcacctggcctgtcatgacaattctaagtggtgatgaggatgtgcagcagctggaactgatgaaaatgcatgagcacaacctctttggaaaactagcagaattccctaaaactgaatgtaggcatgatgcccatgacccagcacttatagtcctgggggtgggaggagtgaatatatttctattcatgatttctatctctgatgacagaaattaagctagtgggtatctgtggttgagtagaaggatagtgactaggagcgggcagtatgggatgctggtaatgtcctcttgacctaactgttggttaccctgggtgtgttcacttgtagaaattcattgagccaaacacgtacaatgtatgcatttttgtgtatatatgttcttcttcaataaaaacttgatttaaataatgttctttttcttaaactgggtagtaggtttatggtgttttatgtgttgcctgtgttttatacatattttattcctgttcagtgtccaaaaaatataaaaagtagtcactgctttgttgttaatttgagcatctcctgcacctagcacagtgcctgggacattatagatatttattaaatatttgttctatggaaaagaagtaggctagtaatttctttttgctttccaacagccagtttttgattcaattatttgtaaatatgatttctactcagttgtttctaaataataaaatatgtaaatactattatgtttatatttattagtaagctgaatttattaaatgagaaacctctcaatattaaggacacatcataaattattagcatgctgtgttataatgactaaaagtagtatcaacaatttagataagtatagtgtggccttacggatgtaagtccgtaagatcatgcagcattgaagatgtgcagtttactagatcttctaatattctcgggtgtctcactgtttcttttttcttttttttttttttttgagatagggtatcactttgtcacccagtctggaatgcagtggcgtgatcagggctcactgtagccttgacctcctgggctcaaacctctcaccttagccccctgaataacggggattactgatttgtgccaccaagccaggctaatttattttctttctttctctctttctttctttctttctctctctctctctttctttctctctttctttctttctttctttctttctttctttctttctttctttctttctttctttcctttctttctttccttctttctttcttttctctctttctctctctctctctctctctcttcctttcttcctttctttttgtagagtttgggtctcactatattgcccaggctggtcttgaactcctggcctcaaatgattctccctccttggcctcccaaagtgttgagattatagttttcagccaccgcacccagcctcactgttttcttcagttgtttctgaacaactggaatctcagctgtctttttccattaaatcccgtgttcgttcctccataccatgctgcctcttgcccatttttgcatttctcctttctgctttcctgaacattctgagtcttactgggctggcattcccttgttgggacaggggagaggctctaggccttggatccttgttctgattccttctccaaagagttttccctttttcttcccctttcaaaacaacataagtgcaaaagctttgtcaggatgttgggaattaaaaaagcttcagaaacattttgattcatttaacaacattactctgaaactttttagagtaagagtaccaagtcactgaataagacgatcttgaaattaaacgatattttacagttttaaaaacaccttcacagatcttttcttattagattctcagcacaaccttatgagttggcactgtcaaaattcagttcaacaaacaaaatccaactaacaggaaaactcacagctaacatcatacttaatggttgaagactgaaagctttcccccttaagatcagaacaagacaaggatgctcttgccactcctattcaacactctattggtggttctaggtggggcagttaagcaggaaaaagaaaatacatttatatcagaaagaaataaaactatatttaccgatgacatgatcttacatgtagaaaaatcctacagaatttaccaaaaaaaattggaactaataaatgagttcagcaaagttgcaggatacaagattattatctaaaaatcagttgcattcctatatgctagctatggataatctgaaaatgaaatagaaaaaattccatttataataacatcagaaagaataaaatacttatgaataaagttaaccaaagaagtacactaaaaagtacactaaaaaacagaaaacatgttgaaggaaattagagatctaaataaattgaaagacgtcctgtgttcatggcttggaagacttaatattgttaagatgacagtgctacccagatttatctacaggtttaatgcaatcactatcacagttcaactgcctttttcccggaaatggacaacctgatcttataattcatatggaattgcagagccatatttgccacaacagtcttgaaaaaaagagaacaaaattgtaggactcatacttcctgatttcaaaacttattacaaaactacagtaatccagatggcatgtcactggcatgaggagagtcttgtaaaccaatggaatgcaatttagagtccagaaataaacccatacatttatggtcagttgattttgaccagggcgccaagatcattaactggggaaagaataatcttttcaacaaatgttgctggggcaactggatatctacatgtaaaaaaataaatttggatccctgcctcacatcacatatgaaaattaactcagaatggatcaaagacctaaacctgttaagttcttcgaaggaaacataggtgaaaatctgtatgaccttggattaaatggtgatttttaaagatataacacaaaaacacaagcagtgaaagaaaaaggtagataaactggactttgttaaagttaaaaactttcatgcatcaaaggacactgtagaatgaagacaactcacagaatgggggaaaatatttgcaaattatatctctgataagtatatatattttatatatatgttgtttatatccagaatatgcaaagaaccctttcaactcaacaaagataagacaatggaatttaaaaatgggcaaagcatttgaatagaatagacatttctccaaagaagatgtacaaatgacctataagcacatgacaagatcttcaacatcatagtccatagggaattacaaatcaaaaccacaatgagagataacactttacaccctctaggatggtcatacttttttttttttttttttaaagacagtaacaagttttgataaggaagtagagaaattggagccctcattgctgatgggaatgtaaaatgatgcagctactgcacaaaagttttgcagttccttaaaaaactaaacatagaataactcagcaattctactcctgggtatagacccaagataattgaaaacatatgttcatacattaacttgtacatacattaacatgtggcattattcatagttgccaaaaagtggaagcaacccaaatgtccatcagctgatgaaatgataaatacaatgtggtatatccatacaatgaaatcttatccagctgtaaaaaggaatgaagaagccaggtgcagtagctcacaactgtaatcccattgctttaggaggccacgatgggaggattgcttaaggccaggagttcaagattggcctgggcaacatagacccagtctctacaaaataaataaataaaaagaatgaaatactattacgtgccacaacatgaaccttggaaacattatgctaggtgaaaatccagtcaccaagatgacgaattgtatgattctgcttacgtgaaatgtccacaataagcaaattcatagagacagaaagtagattagtggttgagaaggagtgagagaagggatgaattgagattaacggctagtagggacagagtttctttttggggtgatgggactgttctggaattagatagtgattatggttgtacaacatagtaaatatactaaaaaccactcaaaggctgggtgcagtggctcatgcctataaccccaacactttgggagactgaggcgggaagattgcttgaggccaagaggtcaagaccagcctgggcaacacagcaagaccttgtttctacaaaaaaaaaaaaaaattgttttaattacctgggtatggtggtgtgtgcctgtagtcccagctactttggaggctgaggtgggaagatcacttgagcctgtgaatttgaggttacagtgagctgtgattgtgccactgtgatccagcctgagtgatagagcatgaccctgtctctcaaaacaaaaccctccaaaaaacaaaaaccacccaagtatacattttaaatgattaattttatgtgaaatatatcagctgggcgtggtggttcacacctgtaatcccagcattttgggaggcagaggtgggcggatcacgaggtcaggagatggagaccatcctggctaacatggtgaaaccccgtctctactaaaaatacaaaaaattagccaggcatggtggcacatgcctgtagtcccaactactcaggaggctgaggcaggagaattgcttgaacccgggaggcagaggttaaagcaagccgagatcatgccactgcactccagcctgggcgacagaacgagactctgtctttaaaaaaaaaaaaaaaaaaaatctcaaaaacggcaatgagaactcaattaatatttatcatactgtatattccctgagtggtgcaggagaatcagagcttagaatcttgtgaggaaggcatggtacttaaataagtctagtgtaaggcagcttgtaataagtagtactaagactgctgaagaagcacaaataaaggagatattctatcttactaggaaccagggagtttcacaaacttggctttgcaaggtgggaaagattttcacaggtggaaggggtttgaaatagggaattcagtcaaaaggaatagtgtgagtgaaggaatggagtttggaatgtggggtacatggggttggggtggggtattgaggtagatgacgcagaaaaataagttaaagatagatcttgcataggtggctgtgagtagcatgctaaggagtttgggctttattacttatgaatcatatttttggtttcaggtcatgtctggtggcagagggaaggctgaattggaggagaacaaaagctagaaccagggacaacaattattaccattgtagttttttaggagaggtgatatggctgaactaggttatggttgtgaggctggaagggaggcacatccacgtgacagtgcagtagacttagtagactcttgattgtttatgtgtgcattccagggataggcagtgaagggaagaatgaccctgaaatcttgaatttaatgacttgaaaggataatgatggtattaacagatgaggaacatagcaagacaaacaaatgaaaaagtgaatactgaggagaaggaggtaccactgaatttggcatttagtcattggtgattttgaagacagcagttacagtaaagtggctgctggaaaggatttcaaagaatggttgaagaagatagccataggatgagaacatggaaggcaaggaagggagacttgagagatttggtaataaagagaagagagaaaagggtgctagtttgaaatgagttaaaagaactacagagtagaattaaaataaagtagaattatgggatttttgctttttaagtgacccatgagaggcttactggcagtgtgccaagattcaagagagcaaagattggcagggtgggattaagtgatgggatagccgggtgcagtggctcatgccggtaatcccagcactttgggaggctgaggtgggtggatcacttgaggtcaggaattcgagatcagcctggccaacatggtgaaacctgtctctacaaaaaatacaaaaattagccgggtgtggtggtggttgcctgtaatcccagctatttgggaggctgaggcaggagaattgtttgaacctgggaggtggaggttgcagtgagccaagatcgagccactgcactaactccagcatgggtgacagagtgagactccatctcaaaaaagagaaaacaaaaaacaaaaaaaaacgacggtagggagccttctgcctctttaaacatttgagatgcatgtcctgagatgcttctgtgaagttaagaatattaattttttgatacgaatctgacaaaactagacatcaaaatatgccatatatggtaattaaaacaatgtggtattagtatagaaagcagacaaatagttaatgaagtagaacaaccaacccagaaatagaaccagatacacctgaaaacttcatatatgaggtttaaaatcagtgtggaaagctggaaatcacccatagtttcgttatccagtcagttgtttttcacattttggtgtgtttccatttagttggtttgccatacttttttaaaaataatgctttaaggctgagcgtggtggctcacacttgtagtctgaagcaggcagatcacttgaggtcaggagttcgagaccagcctggccaatctgatgaaaccccatctctacaaaaaatacaaaaattagcctggtgtggtggtgcttgcctgtagcctcagctacttgggagactgaggtgggaagatggcttgagccagggaagcaaaggttgcagtgtgctgagatggcgccactgcactccagcctgggtgataaagccagaccttgcctcacaaaaaaaaaaaaaatgctgtaaagtaaaagttctgtatacaattctgtgatatgaaccctaccttagtgtgttatgaggattttgatccttatatgatatgatatatataatcaagtgcgggtacgttgtagtttacagaaccattactttgaaacaagacctttaggttactcctaattcatcactgttaaaataatgctgtagggaaaaaattacacataaaagttttctatatttaaaatgatttttgtgagacaaagtttatttattgtaaaaacagttccagcagttcagaattgtaaagagttttacagaattgtaaagagttcagaattgtaaagacattttcttgtctttctccttggtggtaaccactgttaacagtttagtgtgtatcttttttttaagtttagtttttatttttttgtagagacagggtcttgctttgttgcccaggctggggtgcagtggtgtgatcatagctcactgcagcctcatactcctgggctcaagcagtcctcccacctcagcctcccaagtagttgggactaccggcatgtaccaccacgcctggctaatttctgtatcttttgtagagacagggtttcaccatgttgcccaggctggtctggaactcctgggctcaggcgatccccctgcctcggcctcccaaagtgttgggattacaggcatgagccactgcacctggactagtttctttttaatttctgagtagtagtcaattgtatggctctcctataatttcttcattcattcatcttttggtagacatttgtgttgtttccatttttaggctattatgagtacagctgttgtgatcatttgtgtgcgagtctttgtgtggatatattttcatttcttttgactaaaaacctaggggtgcacttgttgggtcacattaactttgtagaaactgcattgcatctttgccgatattgaaagttgtcagcattttatatttttctgtgcatgcttttccccccaaaagaccaaaatgggaattgtttttcttttcattataaacttgtaaaggaattttaaagttctaagggatgccaggcaggaggttcatctatgtgaacagttattagtttgagatagataatgtcaaggatatccctaaaggcttttcaagagataactataggacatctaccccatcacttctagtcacatgtgacttcagaattttaacagaaattattattataggaatatgtagcacagagggattccataggcctgaagattagtactgatggcctttcttacattattctaggctggtgctatccgatgaaactttctgcagtgataaccactagccacaggtggcttttgaaacgtagggctagttcaactgaagaattgaatttaactttaaattaatttgaatagtgaaatatgtctagtgattaccgaacagtgtagttctgaaatgttatttttcaggaaagatcctctagcaagaagtagttgagtgagacctgttagctgagctggccctggggcaggtttgtgttttcagtccttccctttcctgtgggagaaatgaaaccaaagcctagagcaccacagaagaagaaccagtggattcataagggtgacagttcaggtaggggaagctgtttggtaatgagctcttttggtcagatgccacactatttttctttctgtttattttgccctattaaattatttagtaaatagtaaagcgtactttaatccagtttttaaagtggacgtttggatgaaagtatgtgatttaaattccaaaactgtgcagtgttgtccagaagagtcctgattaaatcaccccagtttctttgatgaagataagcaaataattttattttttgctgtaatcccagctactcggaaggctgaggcaggagaatcgcttgtaccagtccggaggctgctgccctctcacagggcttcctcctcttgcacagacgcaccagtgccttcagccccactggtctccctcttctcctttcctggcccctgctggcccagtagatgggccactggaggccactagatggggactggggaatgtgatgttggcgatctgcggtatcttcagggtgacagccatacccaacgcgtgggacctggcttccacatctatagacctgacctaaggaaatatgtgggcgtgtgcataaggatgccatctcagaactgcatattaataaaaagctgaatcaaacagtgtccaacaagggtggctgttccagctggtcatctacaatctcagctcactgcaacctccgcctcctgggttcaagcaattctgccttagcctcccgagtagctgggactacaggcacacaccgccacacccggctaattttttgtattttagtagagatggggtttcaccatgttgcccatgctggtcttgaactcctgagctcaggcagtcctcccaccttggcctcccaaagtgctgagattataggcgtgagccaccgcacctagcctgtactttcatttcttaataactgcatgactgtagtggttggctttcattattgtttcctaggggcaaggtcaatgttagaaaaattgtggaattttcccttggcattgctgtggtgagtagacagctactatttatagagacttatacttcgttgaaaaaatgagataccatgcttggcttaccataaaaacacagatgtttctggattccagtagggaggccttttgttcacagcatctgttttggttggccagccagatgacttctgtggattttttcactccttttgaaggacacttgacaaataaacaagtttataaatgaaagagttaacagcattttgtaaatttattttattactttagctatatcgttctgtatattttgaactatcagatcattttagctcaattttatcacttcctaaataaccttgagacgatcagtcctttgttacatgttctttggattgtttattctgcagttgagacagatttttattgatctataaatttttgtgttcaacaaacatttaatgagtattcactgtgtactaggccctgtactaacactgggaactacatatgtgagcaagatatagtctcagtctttgagaagtttagtgtcttatatgcagtgcaaacatgtagacagaataaaattatagttgagtgcttccatttgaagtttatttcatcagtttagtggggaggggtaggtgtctaggaatgccttccagaaaaagtagtgtctaagtggagaattgtagaatgagtgggagttgtccagggatggaacaggggttagtggcggagattatataaaagaaagaagcttgcaggtgaaaatgaccctgggaaagtgggaaactgaaaaagttcagtacatttctgtcatatggctgatcaagctgtgactgggcaaaatgctgtcagcatttgttgaacacataaatgctgtctcattcacaaaggagacttgtgacctagactttattcatcttgtgctaaattagtgatttccaaacatttgatcatgaatctcataagtaaaaaatgttttgattatgtatcctcatatattgattatatgccaatatttgtttatagatgatatgtagtactaaaagttatatacgcagtagaacatgtatagaaaacaaaaaaaattaaaaggatgagctaaagatggcatgtacaatattctcacagtgttaattttactgaaaatacggaaagtaggctgggtgcagtggctcacgcctgtaatcccagcactttgggaggctgagggaggcagatcacttgaggtcaggagtttgagacaagcctgaccaatatagcgaaatcccatctctactaaaaaatacaaaaattagctgggcatggtggcacacgcccgtaatcccagctactcgggagggtaaggcaggagaattgcttgaacccgggaggcggaggttacaatgagccgagatcatgccactgtactccatcctgggcgacagagcaagactccatctaaaaaaaaaaaaaaaaaaaaaaaaacccagaaagtaaagtggtacatcattatttaaaatcttcgtttaatattatgtgatacagctgctcagagggctgtttctaaattcagtttattttgatactttaatggcagtcaaagcctggatcaaaatggaagaatttggctgcactttctaaatcatattctttctttctccaaacttattcactatttatggaaatgctttattgaaatgtggctggtaaatatccatctattagtttttcttgcagattaataaaaatatattatacttttattgtgttaataaatgggttccaaaaatcactgttaagtcttcatttggaagatattttaaaaagttttagaatattctgtttctgactttataaagcatgaagatacgagtttttggtgtctttattttttagattttgtatatattgtttcaacagcagaataacttagcaatggaaatgtttccaattatccaattttgaaatgctctattaggaaagatttttttttctctcgctctcttttttttttttttttttttttttttaaagatgaagcctctctcttgtccccaaggctggagtacaatggtgccatcttggctcactgtaacctccgcctactgggttcaagcgattctcctgcctcagcctcccgagtagctgggattacaggtgcccgccaccacgcccggctaatttttgtattttaagtagagatggggtttcaccatgttggccaggctagtctcaaactcctgaccttaggtgatccgcctgcctcattctcccagagtgctgggattacaggcgtgagccactgcacccggccgatttttttctctttttcttttttctggaaaagctgaaaataattctgacatgttgctaaacatttttattttgtaggggcagagtgagtttttttgtttttttaatatcttcttggtagcatactacttataacctcctcagaaatatttagcaagtttggaactctagtctttttattttaaaaaaattgtgtaactcatctacatttaacaaatcttttaaatacatttcttgtggtaactagtgaatctgtgtggatttaaaaacaaaaaaaagattatgaggccaaggcaggtggatcacttgaggccaggagtttgagaccagcctggccaacatggtgaaaccccatctctactaaaaatacaaaaattagtcagaagtggtggtacacaactgtagtcccagctactctgagctgagaatgcgccactgcattcaattctgggcgacagagcaagactatctctcaaaaaaaaaaaaaaaaaaaaaaattcagtggctactctctatctcccagagtataggaagattctatattcatacagttaacctcagtgacatctgaggtaccttgttctgacttaattgcagcaatagtttacctgtgaatgaagctgttaaaggcttttgtatcagatgctatcactgtaactttgttctggaattttttttttttttgagatagggtctcgctctgttgcccagactggagtacagtgacacgatctcagctcactgcaagctccgcctcccgggctcacgcctttctcctgcctcagcctcccaagtagctgggactacaggtgcccgccacaacgcctggctaattttttgttattttttagtagagacggggcttcaccgtgttagctagcatggtctcgatctcctgacctcatgatccacccacctcggcctcccaaagtgctgggattacaggtgtgagccaccgcagctggccagaattcttttttaaaattccagtcaaagcagtcatttcatcagtggttacagttttcccataaagcaccttgtttcatttacagttaagaatacctcccttttaatacattgttccttggtatcttacaaagttgtatttcctgtatatttcataattacccagcaaataccctaagatgaaagaatcatctgtatttttatccaattgtatagcaaaccccacacactgtatttgtcctgatatcttcaagtctttagggttttctaagagcttttgactatacttaccaataaaagaatacatttagtttgtcaccacttttatttctgtgtataatttcagctatggtccttggctttttttagggaaaccttagcagtttcgacactaactttcgtacaattttgtgaagtgtcacattaaatagcctgtgactttagacataggtggaaaaattatagacgtttaactcttgcagtgaacacttaaaagcctggtggattatgaggactttgttcgtgccatcagattatatcttaaggtagagtagacatgtagagtgaggttcatctttaataaaaaatgggctgggtgcagtggctcacacctgtaatctcagcactttgggagaccgaggtgggtggatcacaaggtcaggagatcgagaccatcctggctaacacggtgaaaccctgtctctgatgaaaatacaaaaaaattagccaggcgtggtggtgggtacctgtagtcccagctacttgggaggctgaggcaggagaatagcgtgaacccgggaggcggagcttgcagtaagccgatatcgcaccagggcagtccagcctgggtgacagagtgagactctgtctcaaacaaattaaaataaataaataaataaataaataaataaatggtgtggctggacgcagtggctcacgcctgtaatcctagcactttgggaggccgaggcgggcggattgcctgagctcaggagttcgagaccagcctgggcaacgtgatgaaacccccgactctaccaaaaattcaaaaattagctggagcatgcctgtaacccagctacttgggatgctgaggcatgagaatcgcttgaaccagggaggcagagattgcagtgagctgagatccaccattgcactccagcctgggcaacagagagagactgtgtcaaaaaacaaaacaacacataaataagaaattgtgtgaagtcaatataaataccagtactaatattttatttttataccccaaaggattatcgtataatacaaacacccttcaagtacacatatcccactttggagactaatgccctaaacaacagggataatgatattgaaactggccttttagttaaaataaaagcaaagccaaaaataattcactttcctctataaatttatatttgggagacacatttaagaataatcgtcctggccaggtgcagtggttcatgcctgtaatcccagcactttgggaggccaaggtgggcggatcgtgaggtcaggagatcaagaccatcctggctaacacggtgaaaccctgactctactaaaaatacaaaaaattagctgggtatggtggcgggcacctgtagtcccagctactcaggaggctgaggcaggagaatgacatgaacccgggaggcggagcttgcagtgagccgagatcacgccactgcactccagcctgggtgacagagtgagactccatctcaaaaaaaaaaaaaaaaaaaaaatcagctttggcttgaggtttgaagaatgaacccttcagtcatagactatgactacctgtcatagctcactaggaaaccctagggaatcatggaagggttattggttaaatatattatataaaggaacattttgctagttgctattgaccaaaaaggctgtttttttttttttaaatatagtctgtaattatttttgttgaaagatatttggaagatggtttttctcaatctataggagatacagttcgtagccacctgggatctcttataaaaagatactttttcatagtatactctttataatatgcataacatttcataatatacttttgataatatacataaaatttgatacataagtttaccaaatttattgaatttacttcagtgcatttttattagtcaagattctttggaagatatggaaagctaattcaaaaaagcttgagcaaaaaaaatttgttggctcgtaactaatgttcaggactggtctcaagaacttggttgccagatctgtgtttccaggttatctattagcttgtctgtgtctctgtgatagttttacccttttagagtggaaaatcttcctccttgtggtgctctggcttgcagaagaatgcctttggtctagcgccagcatatataaaatcctgtgggtgggatagagtagatgtggttgcatgtgtgctgactggcagtctcactaaaccacatggaatgggaaaggaacagtttcccaaaggaagggtttgctcttaatgcagaggaagggatgctgggagtcaaaaataatagatgttcattatagcaatgagtgatgaagagaggacagaaaggcataaaatattctttaagggaatagaacatgacttaatttgattttcctaatcattgattcttacagagcatgcaagcggcaagatgtcctacagatgaattatctttaaccaattgtgcagttgtgaatgaaaaggatttccagtctggccagtgagtatctgactttgttttcttttaacctgctaagtggcattcgggaaacttccagagagtcatttttaggaaacgttggaaaatatttttaaaaaattcttgctgagttggaaaatggagaagatgagaaaaagttatgtatttgaatcattactgtgtcaaactttgataaatactgtataatgttttaaaaatgttttatgtataaaactctagttttcatcagttttcttagtagagctaaacatactggttgtatgaatcatatatggcagagttgttaggtgtttggttctggcaaactcagattgtttgagttttcctggctctaccaattacaaactgtgtgaccatttctgtacctctatgtcctgatctgtaaaatggagatgatctcttcctcaaggtagctatgaagattgagttacataaataaagcacttagaacagttcccaacatgttaacaatcccttagtaaatattagctgttatgattattattaccatgataatccaagagacatgaacattggaagatgggctgggtatggaggcttacgcctgtaatcctagtactttgggatgccaaggcaggctgattgcctaagctcaggaatttgggaccaacctggccaacatggtgaaaccccatctctactaaaaataaaaattagccaggcatggtggtgtgcgcctgtagtcccagtttctcaggagactgaggcatgagaatcacttgaacccaggaggcagagactgtagtgagccgagatcgcgccactgcactccatcctgggtgacacagcgagactctgtctcaaaaaaaagtaaaggaaaaagaaaattggaagctgcaaagcaaatgtagaatccttaaaggcattttgcactgtaatttattttaactgatccatatcaccgcactgccaggacttctaaagaccctgctgcaagttcagtgccatccatatgcttctgagattggtacagataaggagatgaaggggctgtagggaaataagaggcaaggtggtagggttttaactgagcatttttcttaaaatgttatctgtgaaatacctgagtttcacagagttagaaatgctaatcatctttggtttccagcttcagagtaagaggctgtactatatggtgatattaacattgtttccagtgctaaacattctgtgatgctaaattgagcacaggattttcaacagataaactgaagtatagataatcaacgtgagaatttgtggaattcttttacatatgttaaatgttcactgtactcatggtggggttactcaaaatgtagttgatataaggaacatgtgttctagtggcaaaaaaaatacgtatagaaacattagccattgatgtgaaaaattacagcattctgaaaagataatgtttaaaaagatagtgagctaggcatgttagggcatgcctgtagtcccaactactttagagactgaagcaggagaatctcttgagcccaggagtttgaggccagcctggtcaacatagcaagaccacatgtattaaaaaaaaaaaaaaaaaaaaaaaaaaagatactgctgctgcataacaggatttgaagcttctatcttacacatagtactttttagttacctggtataggagattatcatgagaggactgttttttttttttttacaggtaatttctgaacagggaattagcacaaaattttttaaaacagtaaatattgatatctacatgaaagctgatgtattttgggaattttttaaatcttttttttttttattttgtaggttgtttttgttttagcctgttgagagagtctgcaaataaatttaatgagtagtctaaaaactaacttttttttgattgctatatcctagctcttttatctttggctctcttctccttattaggatgtgaagtaattctcaggagaggaaatgcatctagtttttacttgatatcaaggactctaaatcactggcttcagttttatgtaaactggaaatgtaaggaagttggtattttggatggtattttggctggattctacttgatgagtgtttgacccaaggtgctccttatatctggaaaacatttgggattgctgatagtttgggaaactaaatttgtggttctatttcttcaagacacagatagtgtcgtttccacctgatactcattaaatatcagtttgacaagaaatacattttgaaattatgttcttcatttccttcaatgtggagtactaactgtgtttctgtcctttaggcatgtgattgtgaggacctctcccaatcacaggtacacatttacactgaagacacatccatcggtggttccagggagcattgcattcagtttacctcaggtaactcagatgttaatttgttctcttctgtttttgaaagtcatagaatatgaataatctgttcattttaagcaagcatcaccctgtgactgtattgattcatattgaagaaaaatatctaagtattatataaggaatttaaagatacagtcttctttttttttttttcttttttttttttaagacagggtctcgttctgagacccaggctggagtgcagtggcacgatcatggctcctggtctcaagcaattctcatacctcagtctcccgagtagctgagactacagtcttgtaccactgtgcctgactaattttaaaattttttgtagagatggtgtcttaactgtgttgcccaagctggtctttaactcttgggctcaagtaatcctcccaccttggcctctcaaagtgctgggattatagggtgtgaatcatcatgcccaacctaaagacagattcttaattgccagtttttgctatggctgccttcttttggcttgattttttttccctaatttttaaagattttgcagtaaaatcagtcagctatcacataaagcgtcaagttattttaatgttaactgccagggtaatagaaaagtagaaaacattttatttgtgaagttgatatctaagaatggtgattttataatgtgatggcgttatactaaagaatttggaaagagtctcaaattacaacataatttgctaggctcccataacaactggatgggttgtgattacagttacaactgttgatggattctgtagaatccagagaattagattgcttagtgctgtcccaggcacatcatacataatataaagcaccaagaatactagtctgtatcctcttctcccttatcattttactcaggctgctgactgtccccagtcctaagtaatgtaaatggaattcctacctcctcctagtatgctaatgagcattggttgacttccctgaaggtttagagaaagagctcaaacactcatttaagaactattaggctgggtgcaatgactcatgctggtaatcccagcactttgggaggccaaagctggtggatcacttgagtccaggagttcaagaccagtgggcaacgtggcgaaaccccacctctactaaaaatataaaaattagctgagtgtggtggtgcatgcctgtagtcctaacttcttgaggggctgaggcaggaggatcacttgagcccgggaagttgaggctgcagtgaggcgagatagtgccactgtactctagcctaggtgacaaagtgagaccctgtttaaaaaagaaaaaaacaaaaacaaaaactattagatgggccaggtacctcacgcttgtaatcctagtgctttgggaggtggaggaggatcgcttgagaccaagaattccagatcagcatagcgagacccttgtcccccgcactagtctctacaaaaaaaaaattttttttaattagctgggcatggtggcacatgcctgtagtccaggctacctgggaggctgaggttgggaggatcacttgagcctaggaagtcgaggctgtagtgagctatgattgtgccaccatgctccagcctttgctccagagtgagattctgtctcttaaaaaaaagggaaaaaaaaggaactattgaagatctcttgaagccctcaaaaattacaggaaattttcacttactattccacctgtctgtttgatgcctcttcattatccagaccactttcacgtttgtttctatagattaaaagtttgggatattccagggttctccagcttttacagagttccatttgggattctgattgttagcaatagcttgaggtgtgacagtttctccttgtctctgttttgtaaaaaaaaaaaaaaaaatttccccgacattcactgtaggccagcctctattctaggtactttggcatgtgttagctcatttaattctccaaacaaccttatacaatagctactgttgttatccctaaggactgttgtattagtccattttcatactgctatgaagaaattctggagactggataatttataaggaaaaatgagatttcatggactcacagttccacatggctgcagaggcctcacaatcatggtggaaggcgaaggaggagcaaagtcatgtcttacatggcggcagacaagagagcgtgtgcaggggaactgccctttataaaaccatcagatcttctgagacttactcactatcatgaaaacagcatgggaaaacccacacccatgattcagttacctcccactgggtctctcccataacacatagggattatggaaactacaatttaagatgagatttgggtgggggcaaagccaaaccatatcagctgtctttgggattgaagtacagaacctaaatgtggcttccttgtgacttaaagtctaagcttaacgagcatggtgctaaatttcaggttggccagaagtgggatggggttttacagaagaggtcttctgggggaggtgaagggcagagtggagggaaacaggatgtggtaagaaagccacaagggagagcacttgttgcacatattcacagttcagtgtcttctaaattacccgccacaaagtctgcagtgtttggatgggcaggtgaactactgattttcaaccaaaaattgtttttctcattgttctttggagtgttaccagtaattactaattttgaatctataccaagcaaaccccagattcctgcctaaacacaatctggcctgccttcatacttcttgccattgtaaacagtagggatttgggaaagcctgaaatctagctgtaaatgtctaaaaatcttctggctagtatacaaagagtagccatgaccatctaatgatttcagtccctgactgggtttcaaaatagattttctgaccagttttaatttagtcttcatgaattgaatgtcttcctttttgagatactgtaacaaacagtaaaactaactgcagcagtacatttagaacactgaagtgtgatctgatacagtgaagaccttctgtagcatcatattgtgcaaaggaacatcctcctcagtggtgccagctttactgcaaaaggcaagctttgcacgttttgaaacagatgttcagatgtaaactgtagcacatgctttactttcctagggtaagtaacaaagaaccattactgggtagcttaaaacaacagagatttattctgtcaccgttgtggaggccggaagtctgaaatcaaggtgtcagtagagctattccctctctgaaggctctagggaagaacctgttctgtgcttagcttctggtgttgccggcaatcctttggtgttccttggctgtagctgcatcatttcaatttctgcctctgctatcacatgatggcattctgtctgtgtgtctatgtctctttcttagaaggacaccagtcatatcggcttagggttcaccctaattcattatgacctcatgttaacttgatacatttgcagagattgtatttctaaataaagtcacatccacaggtgttgggggctaagacttcaacatactttggagggggagagcacagttcaaccataatagcataccatgttttgatctttgagtgtattcctaaaattcattaaaattcctctttttctcttgtctaattttgatggctttggttttaagtatctttttttctcctttacagagaaaatgggctgggctttctattgggcaagaaatagaaggtaggtatattttttagccacctgataaagattttctatgtgattttctcacagttattgagatctgtacaattttctattactagtggtcagatcttaaacattcattgtatcagaagactggttacatctatgagaatgggaaggaaatagttatggtacctctgttcctatatcttttatgaagtgtgtgataaggtcgtcatagttcaaggcaaggaaagcaatttgtgacttccagttgggggcgtggcggggtggaaagactaagctgctaatagataataagccaaagaactaataagcaaaaagtggcattgtctcaggcaatgtggcaaagttaggaaatggagtatgagtcgtctttagtcagatgattttatgtcaacttcatggatacagtaggggaaggaaagaaaatgcaagtgtaattaaaccagcttttcttctgcttgtctttaaaacttaaaaaaaaattgtatttatagaaaggttgcaaaaataatacgaagaatttctgtatactgcctttacccagctttaccaattgtcatattttctttatcattctggctccctgtcttcctctctgggtctctgtctctctctgtacacacacacacacacacacacacacacacacacacacacacgcacacacacacacacacatcttttatcctactcctcatttaggaacctgacaacttgtaattttttctaagttagatggaatttaaacattggggttattttattttattttatttttgagatggagtctcgctctgttgccaggctggagtgcagtggcgcaatctcggctcactgcaacctctgcctccagggttcaagcgattctcctgcctcagccttgcaagtaactgggactacaagcacttgccaccacacccggctaatttttgtatttttagtagagatggggtttcaccatgttggccaggctggtctcgatctgttgacctcgtgatccacctgccttgacctcccagagtggtgggattacagatgtgagccaccacgcccagccaacattggtgttatttttagttagctttttctttgtggaagtatgaacacttgttaaatttaatgagaaagtggggtagtatgtagcttaggtttctaattttcataaattaatttttctaaatatgaggctaagagtacttaaaactttgaatctagatattttctattgtgacaagatacagaaattcaagattataaattttgatgagttgagaaatgtgttttgcggtttaagttataaaagcattcttctgctaacagaaatgcttatctggattgtaaagtcagatctttaaagaagtggctcaaacagacttaataagcaaaattgtaaaacccagtgataggtgggactaaagtggagtaagcttgagggaaggtagggttttggggcccaagtgatgtggatgatgtagccataaagatagaaaactggtttggtttaagtagtgatgtagaccaagataggataggaggtgtggtttgaaggagtgctcaagtattctggaatgggagttccgtaaggtgaaacattttagtcaaatcagtgattttagtctgagggaatcttctggaggaatcatttagtcggtcttctttccatctggcaatgccatattttaagtgttacaggctaatgttttgaccactatatatacacctattattgtaaagtccaagtttattcaaagaactggatacacttattttttgcttataaaatctttcttattagtcttttatattaaattactattagccgtaaaataagaaaacattctcaatcttctttgatccaggatgaaatcttcaggactcttgtccctttgggactgaccatggtgctgactgtggtgctgcctgggatactgtccatggtgctgcccatagcacttgaaattgtaacagtttggtcttttctatttaggaacattggccttaaattaaaatgcatttgaaaactacagtcagtgcattactgcagtcagtagtaattatatttttatttatttatttttgagatggaatctcgctctgtcgctgaggctggggtgcagtggcatgatctcagctccctgcaacctcctcctccccagttcaagcaattctgctgcctcagcctactgagtagctgggattagaggcatgtgccaccacatctggctaatttttgtatttttagtagagaaggggttttgccatgttggccaggctggtatcgaactcctgacctcaaatgatccacctacctcagccttccaaaatgctgggattacaggcatgagccaccacgcctggccaatattttaaatatacttattcaaatttctcagtatgaagatgacatgaatatatgtatatacacacatatatatgcattatgacattatgatattgttttggtgtctttaatgcacaaaatggtattatactgtacaaacctttctgcagtagacttttgtcactcaatattatgttttcaagggccatccacctttttttgagatggagttttgctcttgttgcccaggctggagtacagtggtgtgatcttggctcactacaacctctcctcccaggttcaagcaattctcctgcctcagccatctgagtagctgggattacaagcactcacccccacgctggctaatattttctatttttattagagatggggtttcaccatgttgaccaggctggtcttgaactcctgacctctggtgatccacccacctcagcctcccaaagtactgggattacaggtgtgagccaccacgcctggccaggccgtccatctttaataaatatacataaagttggtttttgtttttttgttttttttttgtttttttgacagggtctcacttggctggagtgcagtggtgcagtcgtggctcactgcagcctcagtacctggctaattttttaattttgtgtagagatagggtttcactgtgttgcccagtctggtctctaaatcttggacttaagtgatcttccctccttagcctcccaaagtgctgggattgcaggtgtgagccaccgtgcctggccaagttttaatttcaataaaaattgctgtaaagtattctacattatgaatatactacattttattcattgttctcctactgataaacatttttcaatgtttaagtactataaataatgctgcaatgaacctccctgtagatgtgttgttagacaaatgttctagcatctttctgggacagacatctagaaatggaattgctgaatcatcatattcatttttacattaatatttcaacctataaatgttttcaaactacatgagggaaacaactaagctcttttgcctatcaaagttactcagcatataacctgtactttctaggatttttttttttttttttttttgagacagagtttcactcttgttgcccaggctggagtgcaatggtgcgatcttggctcactgcagcctcgcctcccaggttcaagcgattctcctgcctcagcctcctgagtagctgggattacaggcatgcaccactgcacccggctaattttgtagtttttagtagagacggggtttctccacgtttgtcaggctggtctcgaactcccgacctcaggtgatccgcccaactcagcctcccaaagtgctgggattacaggcatgagccaccgtgcctggccattctaggaaatgttaagaaggagcaagccatccagaattggagacaggagagtattctgaaacttttagccaaaatttgaacttattatttgatcttcagtgagttttatgttccttcctcaggctttgttattttgcttttgaagtagttaaaatatgtatatgtccccctttaaatacagaaatctgattatacaaacaatttcatttaaagagtttacagaaaatcggccgttcgtggtggctcacgcctgtaatcccagcactttgggaggccaaggcaggcagatcacttgaggtcaggagttcgagaccagcctggccaacatagtgaaatcctgtctctactaaaaatacaaaaattcgctgggcatggtggtgtgcgtccgtaatcccagctacttgagaatctgaggcacgagaatcacttgaacccgggaggtggaggttgcggtgagttgagatcgtgccactgcactccagcctgggtgacagagcaagactctgtctcaaatataaaataagagtttacagaaaatccttgtacataactcaagggtctagaatttaagaaataagtttagaacagaatttagagtgtgaaacgaccataaagacttatctagttcagtcttgatttatagatgtgacaaatcaaggcacagacaacttaaattatttacttggattcttctgattgctagcagaatctgttgaaacacacatactcaaagtccctttgaagaaaacagctttgtttgtaaaccactagaatctttgcaacagacatttaatactgcacagtgacttcttttgtttacctcttgctatttgacctcagtaactcacagaaatgccatgcctgttgttcaaagcaagtgtgaaaaaacagtctttgtttataacctgcttttgtggtgagaactgtagaagctcacttacccaatgtgacttggactggtaattaagtgaaaagttggttaaaggctttttcttggaggtgtggtccatggattggagttctgtattatcttttgtgcatacactttacccataatttccaggtggatttctttgaaatggctggagaacttagactttgtagagcatctgagagtgccaaaacctcttggatttttgtagagttcactcccaaccttttctaattttaatgcttatacctagttagcagtattttttttttctagaagaaacacttcatttaaaaaattttcccaaagctttcaacttataatatctattctagaatgtcaaagtcattgtaataacagttcaacaaccaggccttcagaagtttttatactatttaattatatttcataattaactgtaacaagtgtaactagcacagacagataccagaatgaacttggttgacccatgatgtgtagcaactcctgtctacaagctctgagcgttaggcaaaccataggctgatgggtatatgttggagggataaaagttggtcagctttctgatgactcagctcagtggaggttgcttaagagagctgctactgtatccttaaggggccattggtaaattttaggacaagtatcttcagggaacctaaagggaaaataaatgtgtgtgtgtgtgtgtgtgtgtgtgtgtgtgtgtgtgtgtgtgtgtgtgctcgtgtgtgaagccttattgaagagtagcaatagactctttcttactaggcgtaatcaagttgccctcctggggaaactcaaatgcaaaaatcctcttgaacttttctgggtagcctactctactctttcctaatagtaccactacagtatacagcactgtaaaattttttgctttaaaagtttgtttataaactggcatttataagtatactttttgagctgatttaagaatcaagtttttttttctagggaaatgcttctttgtaattatctgtcactagcaaaatttgttttaacatatatttttctaaaaatatgatatgtaaactgtgttgtagttgtacaattaaaggtttttggtcgaacagttattacatgatgtaaaatcatgtgtaacactttaatattaattacattgtaacctaaaattcattttaaaactttttatgtggcttgaacaggaattttcttatccaaagctttgtatgtatgctttattgcctcctttgttattagcatggagaccatgggttttctgttattgttgtttcatttaaacagttcatgaatatattaagcacctgaaagaaactgttagatgctgttaataggaagaggagttaaaaacctcgtccttgcccttatctacatgtgtacatgtagaacttactgtagttccctagatgtagcaggtgctcaggaaacatttttgtagtagtaaaaaagaaatgtcaaactctaacttgctctggagcaaattccgctagtaaacattgtttttcaagcttcttttttttgccttgcgtcctactttcttaggccaaaataattcatccacatcccaccttagctgtttttttgtgtcaaacaaaaatcttatttggaaatagcatgttacgccaactgtgttggggcatcccatactgtattgcattaaatgaggagaaagatgcagaggccatgtggggaggattgtgatcctgataagagtgggatgagggataacaacagagagactgccgttcaatatttctttctttctttttttttgagacggagtctggctctgttgccctaggctggagtgcagtggcgtgatcttggctcactgcaagctccgcctgccaggttcacgccattctcctgcctcagcctcccaagaagctgggactacaggcgcccgccaccacgcccggctaattttttgtatttttagtagagacggggtttcactgtgttagccaggatggtctcaatctcctgacctcgtgatccgcccgcctcggcctcccagcgtgctgggattacaggagtgagccaccgcgcccggcctgccattcagtatttctaattaattcagatggggaagaaaatctctagtgactattattttttaaacctgtacctgtgtgtccctccagtgaaggccatttaaaccccatttttggtgaagtagtttatgattcatttatgtgaaacttttagttactagaaacactacaggtattttgtactcctgtgatttttaaaaaaatgcttctttttttcccctagtctccttatatacatttgacaaagccaaacagtgtattggcacaatgaccatcgagattgatttcctgcagaaaaaaagcattgactccaacccttatgacaccgacaagatggcagcagaatttattcagcaattcaacaaccaggccttctcagtgggacaacaggtagtttttaattttctttcattcctttaactttataggtattctaatttctgcagttttccaaaattaattccaccttttaaaaagtgagaggggctttgcgtatcaactcgtatatccaaggtgagtgataaaagtgagggagatgtatttactgaacttcaaggagtctgttcagaaaaattctaaagtagcttttagattaaaatgtcatgtataattatagcagcttttccctcagcaaatttgggaaccctgtggacatatatatctgaaattcctttttatatcataggacatttgttttgcctctggaatgtctgtctctttcactaatatagttctgtagaaaatgtagctcttggccagacatggtggctcatgcctgtaatcccaacactttgggagactgagttgggaggatcgtttgagcccaggagctcaagatcagcttgggcaacaaagtgagaccctgtctctacaaaaatttttttaaaagtagctgcgtgtagtggtctcaactactcaagaggctgaggtgggaggacggcttgagcctgggaggttgaggctgcagtgagccatgattgtgccacggcactccagcctgggtgacagatcgagattgtctcaaaaaaaaaaaaaaagttcttattttggttatgggcttatttgagaatcttaaaaaactgaattcctgctagataggaaaaggatatagtacattattttaaaaagagtactagaattggaatgaacctcaagagattaccttatgtaactccacatatacaaatgaggaattttatttttttattttttaaaattttatttatttattcatttattttttgagatggtgtgttaccctgtcatccaggctggagtgcagcggcaccatctcagctcactgcaacctccgctttctgggttcaagtgattttcctgcctctgcctcccgagtaactgggataacaggcatgcgccaccacacccgactaattttgtacttttagtagagatggggtttcaccatgttaatcaggctagtctcgaactcatgagctcaggtgatccatccgccttgacctcccaaagtgctgagattacaggcatgagccaccatgcccaaccattttttttttgtatttttagtagagatggggttttgccatgttggccaggctggtcctgacctcaagtgatcctcccacctcggcctcccaaagtgctgggattacaggtgtgagccatcacgcctggccaaatgaggaatttaagatctaaagaaggtaaatggtatgcccatggctacacagctaagggacatagttgagataagaattaattaaacacatatttgatagtacctagtgcctagtaccagtcactgttttagacactgcagatcggcagtgaacaaaatagatatgatccctgctgtcatagaacttactttctagttgaagaaaacagaaaataagacaggaataccatgtacagttaggtctctgatgaaagtagatcaggacaattcaccagagagctattgcggtgctgttgtgtattggatgaccaaaattgtgctcagattgcctagctaaacttgatggtttttacctttgcttttagttttagtatcctaatagaaaatgtttaggagaatgtttaatagaaaatgctttggtatttataataatttaaaactcagtagcatgtagaagtcagtaaatccatgaaagagaatctttcgtaattcagagaagaagtaaatatcttactccagatcactgtccttaactgtttcttctcatttgtggtatctcgtagtagcagaatggacagacagcccaacctgtaatatttaccattataccccagcacatagaagaagaccaaacttttagaagggactcagcaaagatttggtgaatgagtaattgagcattcagaagctgtctctgcacttgtagggcaagcattttgtactagtgatagaaaagcaggaattgtagagtcacagacccagggttgacttctggcgctctcatttactgtgactttgagccttgttgcatagcctgtttctgcatctcagcttcctcactagtaaaatggagtcgtagtttctgcttccaagagtgtttgtgaatattatataactggctgtagtgtttgaataaaatactaagaaactttattctttgttagaaatagtaaatgtggtactcttgaattactttaggtggcactctgacatttaaattagatattttttatccatgtggaagaaattttaaacatgagttttgcagtcattttgtaaacactgatcgtaagtgctaattcccttttcttcattggctgtgagtagtttgtttgaggagcagattggagaggagtatataagataaactggttttctgcatttgaaaaacattggtgatgatctgaggatcaaactattatattatgaagtgatttttctccccttacctcttttctacatagcttgtctttagcttcaatgaaaagctttttggcttactggtgaaggacattgaagccatggatcctagcatcctgaagggagagcctgcgacagggaaaaggcagaaggtagcttttatttctgatcatctttactagatcatctttataatgtaatttgtgcagattgattataattttcctatctgttgcttagtgatttttttcatattgtgtacccttttaagatagtagggagaaaaaattgctttcatagccatcattgttattaaaatatagcttaaaatgtatttatttgcagacctaatattaatgtaaaatgtagacatatatgtacatataatttgcttgaatgcagatatttattgtaaataaataataagaaacgcattattggaaagatataggcatggaaataaggcatgtaagaattgtagaagaaagttatgagaaaagtaaaagtagctcagatgatagtctggaaggtttgctttgcccagagagacctcatttccccctcacttttggccttgctttgagaagtccagaagtttgctattagactactaattattgtctttctctacagattgaagtaggactggttgttggaaacagtca
